United States Patent 10,767,156 (POLYNUCLEOTIDES ENCODING BREX SYSTEM POLYPEPTIDES AND METHODS OF USING SAME) - sequence listing, part 14

SEQ ID NO: 6221 - DNA, 2401520 bp, Carboxydothermus hydrogenoformans Z-2901
aacctgaaaaaagtgtgaaaaaaattttgtggatttgtggataaaacaaggtttttgctaatttttgctaataaaaaaaatttataaagagattcgtgaaagcaaagattgtggataacgaaaaactcaagaaaaatttcttgacgggtcttatcccatcttctataatttaggtgtatctataggggatataggcttttttagatagattaggaggtgtgaaaatgaaaagaacctaccaaccaaaaaaccggcggcgtaaaagagtgcacggcttcttaaagcggatgcggaccccaggcgggcgaaatgtaattaaaagacggcggcttaaaggtagaaaaagacttactgcataaaggcccaacgggcctttattctgtataagcttctcgaatttgggaaatccttttaaaagatgtgctatgaataaatgccggtttctttctaaaaacgaagaataccgtaatatttatcaaaatggccgttccatcgcatcccgctactttgttgtttattatctaaaaaatgaggatgagaaaaaactgccctcttttggaatttcggtaagtaaaaaaattggtaaagcagttgttcgaaaccgtttgcggagaagattaaaagaagctttaaaaaggctttgctttgaatttttgcccggctatgattatgtaattatacctcggttatcctttaaaaatgatgaattttctgtgattttagaacagctgttatatataattaaattaatgaagcggtcgatcgataatgcgtaaaattatcttacttcttattcgcttttatcagaaatttgtatctcctatattaggcagtaattgtcgtttttacccttcttgttcccagtatacatatgaagctatcgagcggtatggagttatctacggaagttacctgggaattaaaagaatcctacgctgtcatccttttactcccggaggctacgatccggtacccgagaaaaagctaaggaggtaaaaatgttttgcagccattaattgatgctataacctggattttaaataacctttatttgtttaccaaaagcataggaataccgagttatgccctggctattatcatgcttactattttgataaaaattatcttatatcctttaaatcatgctcaaatgaagtcgatgaaagtcatgcaagaactgcagcccaaaatgcaggaaattcaaaaaaaatataaaaatgatccgcaaaaacagcagcaggctttaatggaactttataaagaatacggggttaacccgatgtccggttgtttaccgatgttaattcaattacctattttaattgcattataccgtgctctttacaattttaagtatttaaatccggctcatgctaaatttttctggattgccaatataagtcacaaagacccgtattttattttgccgatactggctgctcttaccacttacatccagagtagaatgactatgacatcgggcaatgaccccaaccaaaaagttatgctttatgttatgccgctaatgattggctggattgctatgtcgttgccggcgggattgggtatttactgggtggtattaaatatcatgggcattattcagcagtatttcgtcaatcaaagcacccacaagattgttgaaaggggtaccaaagaaaatgcgggagattgaggttaccggcaagactgttgaggaagcggtaagtttgggtttagagcagctcggggtagatcgatcgctcgttgagattgaaattttggagcaaccttccaaaggtattctgggtctttttggacagaaaccggctaaggtaaagcttactattaaaagtaaggttatggaaaaggccagaaaatttttggatgatgttatttcggccatgggtgttaacgttggttacgaagtattagagagggacgatcatcttttaattaacctctatggcagtgatgttggtatattaattgggtaccggggagaaactttggatgcgttgcaatatataactaatttagctgccaataaaaatgaaataactccccggcggattattttagatgcccagggttatcgcgaacgacgggaaaaaactttaatccgccttgctgaaaaagtggcggaaaaggttcggcaaaaaggacgtccttttgctttagaacctatgaccccgcaggagagacgaatcatccacaccgctttacaaaattttgaaggggtttatacctacagtgaaggcgaagacccaaatcgtaaagtaataatagcacctaaaagataggcaggtttaacacctgccttttttcatcgattaaatattgttataattttttaaaaagcttttaggagtgaaggaaatgatggaagataccatcgctgccatttccacccctttgggggaaggaggcattggaatcgtaagggttagcggtccgggcgcgattgaagctgtaaaaaatgtttttatacctcgacaaagcaaagatttgtctaaagttccaagctttactctacattatggaaaaatcgttgaccctgctgacggcaaaatcgttgatgaggttttggtatcggttatgcgggcccctaaaagctataccggtgaagacgtggtagaaataaactgtcacggcggtattgtggcggtggaaaaagttttagaacttattttaaaacaaggaatacgtttagccgaacccggtgaatttaccaaaagggcttttttaaatggacgcatcgatttatcccaggccgaagcggttatagatattatccgggccaagaccgaagcaagtttgaagcttgcgggacgacaactttctggcgaacttcgggaaaaaataaatgctgtacggcaaaaaataatcaacattttggctttcattgaagtaagcattgactatccggaatacgagtttgatgaagtaactcccgaaactgcccttaaaaacatcgatgaaataataaacgatgtccgaagacttctttcttcctatgaacggggacggattttaagagaaggtattaccgccgttatagccggaaaacccaatgtgggtaaatcgtctttattaaatgctttattacggaaaaaaagggcaatagttaccgatatacccggcactacccgggacgtgattgaagattatttaaatttaaaaggcattccggttaaaatcgtcgataccgcgggtatccgggaaacggaagatttagtggaaaaacttggagtagaaaagacccgggagtatttaaatcaggcggatgtgacgttatttgttgtcgacgttagtattgggattgatgaagatgatgagaagattttaagtttaattaataaagataaaagcttgttggtcatcaataaaattgacttgctgcagggtaaggtaaattttgagcaatatgcagtaaaaacaggtattaaaaatttcgttcctttttcagccaggaactttgaaggtctggaaattttggaaaataagctttacgaaattctcattcccgagcaggaaggagaaggtgaatccgctttaatttccaaccttcgccataaaaattacctggaaaaagctttaaattcgttattaagtgccaaggaaagtatagcttctggcgagccggtagatcttgtggccattgatttaaacgaggccttaagggaattaggggcaattaccggcgatgctctcggtgatgagatcataaacgaaatattttcccaattttgtgttggaaagtaggggtgtgaaatggaatatcatgctggcgattatgatgttattgtagtgggagccggtcatgctggggtggaagcggccctggcctctgcccgtatgggacttaaaacattgcttttaactttgtccctggataacgtggctttaatgccctgcaatcctgccgttggtggtcccgcaaaaggtgtggtggttcgggaagtggatgctttaggcggagaaatgggaattaacaccgacaaaacttatattcaaatacggatgcttaataccggaaaaggaccggcggttcgtactttgcgggcgcaagcggataaaagacgttaccaggaggaaatgaaaaaaaccattgaacgtcaggaaaacctttacttaaaacaggcagaaaccatcaaaatcttggtcgaaggggaaaaagttcggggcgtcctcactcgaaccggggctgtttttacttcgcgagcggttgtcgttacctccgggacttatttaaattcccggattattattggagatgtccactatccttccggaccggcgggatttccttacgcaagtctcctgtcaaaaagtctggccgatttaggatttaagcttgggcgttttaaaaccggaactcctgcccgggttgataaaagaaccgttgatttttcaaaaatgattgaacaaccgggcgatgaccggcctctttatttttcttatatgagcgaaggaataaagcgacctaatgtatcctgctggcttacctacaccaatttagaaactcatacgattatcttagaaaatttgcaccgttcccctctttattcgggggaaattaaaggagttggtccccggtattgtccctcaattgaagataaggttgtacgtttttccgataaacccagacatcaggtgtttttagagccggaaggtcttgatacctatgaaatgtatgtccagggaatgtctacaagccttcccgaagacttgcagataaaaatgctaagaacccttcccggccttgaacgggtggaaataatgcgccctgcttatgcgatcgagtatgactatattgatccgactcagttaaagttaaccttagaagcaaaacacattcaaggacttttctttgccgggcaaattaacgggacttccggttacgaagaagctgccggtcaggggatagtcgccggaattaatgctgctttgtacgttaaagaaaaagaaccgtttatcctcaaaagatctgaagcttacatcggggtcatgattgatgatcttgtaaccaagggtgttactgatccctaccgccttttaacttcccgagcggaatatcgactacttttgcgccatgataatgctgatctccgcctcaccgaaaaaggttataaaattggccttgttaccgaagagcggtggcgaaagttcaatgagcgggtcgagaaaatcaataaattgatggagtttttggaagagaaccaggtaactcctacaaaaagaaatcttgaaataatggaggaatacggtacctctccgcccaaacacgggatttccggtaaagagtttttgaggcgtccggaaattaacatggaagcaatcgaaaaaatttttgccatcgatgggcagtttcccgatgatgtaaaagaacaggtggaaatcttagtaaaatatgaaggatacatcgaaaaacaactgaaggaaatcgagcgctttaataaatacgaaggtaaaaaattacctcccgattttgattacagcaaggtaaaaggtttatctgcggaggcggtccaaaaacttaatgctataaaaccggaaaatattgggcaggcttcgcgggtttccggggtaactccagccgatatttcggtgctattaatttatttagagagtagaaaaagtgaggataacaatggaagcgaagcttaaaactttttttgccgagtttggactgtcaattgaaaaggaaaaaatccagctttttgaacggtattatcgcttattaatatctgaaaatgaaaaatacaacttaacagcggtaaccggtgaagatgaggttatcgtaaagcattttcttgatagtactgctgttctaatttaccgtgatctaacggatttaaacgcggtggatattggaaccggtgccggttttcccggaattcccttaaaaattatggttccgggtttaaaactactgcttttggattctttaaaaaaacgttgtctgtttcttgaaagggttgtgcgggaactaaatttaacgaacgtaacggtaataaacgagcgcgcggaaaaccttggacggcaaaagccgtttcgggaactttttgatgtaaccttttcccgggctgttgctgaggttagagtcttactggagtttcatgctccacttttacgcctggggggagaaactatactgttcaaaggtcccggggtcgatgaagaattaaaaaaagcagaaaaggcagcaaaacaactgggcatggagttaaaagatgtatattactaccgccttccgggtaactttggagagcgctcactggtggtttataaaaaattgcaaaatactccggaaaattatcctcggcgtccgggtattccggaaaagagacctttataactataaatgtttcacgtgaaacttccgattggtctcaagatgtatttttaagaaaaatttaatgtttcacgtgaaacatcaagaaacattcccaaaattatgttaaaatatgtttagttaagttttacagcgggaggataatatgggaaagattattgccgttgccaaccaaaaaggtggcgtagccaaaactactacagcaataaatctgggggcagccctggcattagcagggaaaaaagtccttctggtggataccgacccccaggcaaacatgaccagtggtctgggttttcccaaggaaggattgccggtaacaatatatgacatgctggtggatggctttaaggaagaaggggttttagaaacggaaatttccgggctatatcttattccgtctacggtggaattggccggtgctgaaattgaactggttatgcttgaagaaagggagcttcgcctaaaaaaagtgttgcatcccttaaaagataaatacgattacactttaattgatagcccgccatctttgggccttattaccttaaacggtctggcagcggcagataccatcctcattcccattcagtgcgagtattatgctttagagggagtaacccagttaataaatacaattgacctagtaaaaaaacgtttaaacccggatttaaaaattgaaggggtattacttacaatgtttgacggtcggaccaacctgtcgattcaggtagtagaagaggtaaagggatttttcaagggtttagtttacggtacggtaatcccgcgcaatgtccgtttatcggaggcgccgagctacggcaagcccattttcttatatgatccaaagtgccgcggagcggaagtatatcatgaacttgccaaggaagtgatggaaagaaatgaaaaataaaaaaggtttgggtcgagggttaaatgctttgattcccgagggaaaaataaatttagagcgggaaaatggtcttgtggaaattaatgttgaaaaaatagtacccaatcccaagcagccccgtacgatttttagcgaggaagctttaaaggagctggccgagtcaattcaaaagcacggggttttacagccaatcgttgtccgaaaaatcgccgaagataaatatgaattggtggcgggagaacgtcgctggcgggcagcgcagttagccggcttaaaacaaattccagcggtggtaaaagattttagcgatgaagaagcaacggtggttgccctgatggaaaatctccaacgggaagatttaaatcctctggagcaggccaaagcattaaagcgtcttatcgaggagtttggtttaacccaggaagaggtcgctgagaacctggctaaatcccgcacgtacgttacgaatcttttacgcctgttaaatctccctccggtaattcaggaaatggtggagaaaggggaattgacatacggccatgcccgcacgttattggctttagacgatccccttaaaatgagtgaagttgcccgggaaattatcaaggagggactttcggtacgggcaacggaagaattggtgaaaaaaataaaaaatagtcctgaggtaaaagtaagaaccaaacgacaggtagctcctgaaatccaggaaattgaagacaaattgcgagccttttttgcaaccaaggttgaaataaaaagtacagctaaagggcggggaaaaatcaccatagaatactattcgccggaggagttgcagcggattcttgatttattgtatatcgaataaactccagtaagttaaaagaggtggaaaaagtgcccacgatttactttgacaacagtgccacaacctaccccaaacccccggaagtactggaagcaatgatttattttgccgaaaaagtaggggcaaatcccggaagaggaagtcaccaaagggctttaaaagcctcccaaataatcctcgaagcccgcgaagcggtaaaaaaactaatcaatggagtttcggcggaccgggtaatttttaccgccaatgccacggaaagcttaaacttggccttaaaaggccttcttcaagcgggagatcatgtcatagcgtcgccctttgagcataatgcggttcagcgtcctttaaaccgcttacgccgggaaggagttgaggtgagttacttatcatcgtcacctgcgggagaaatcgacccggacgaaataaaaaagcttttaaagcccaatacccgggctgtggtcgtaacccatgcgtcaaatgttttggggtgcatcacaccggtggcggaagtgggaaagatctgcagggaagcgggagttgcattaattgtggatgcggcgcaatccctgggaacgattccggtggatgtccagagctataacatttccctgctggcttttaccggtcataaaggattatacggtcctcaggggaccggcgggctttacattgctccggaatgggaaaaagttttaaaaaccctgaaggaaggcggtaccggcgggcattcggaggaagagctaccgccggaaattttgcctgataaatacgaaagtggtaccctcaatacgattggtattgcaggactaaaagccggggtggagtttgttttaaagataggtgtggagaaaatttttcaacatgaaaagaaactgacccggaaactttatcaggggttaaaggagctgggagcggaaattttgggtccggatccggaaaacgaccgggcaccgcttgtgtcttttaattttcccggggccgatgcggcaacggtaagctttatgttagataagctttacgatatagctacccggcccggacttcattgtgctccaaaagcccatgaagttgccggcactttagaccggggagccgtacgggcaagcttttcgtattttaataccgaagaagaagtagaggaatttttagaggcaataaaggagataaaagatgaattataaattgagccaaattttttggctctttttttatttgccccttagtttaatgcccagaaaatcgaaaacggaatacttataagttttacttataaaattcattgttacttgatatttctgctggcgccattaatatgatattctaatggctgtaaactcaattccccggggaaaaattttaagagggggtagcgtatgtcgcaggaagccatagtattgataaataaaaaaaataaatcttttaatatggtacggggcttaacattaaccctaactttaaccctactggcccggcagttaagcagccttccccttttttccgttatgggaaccatggtaatcgccatccttttaggcatttcctggcgtgcggtgctgggggtgcctcgaatagccaacgaaggtatcgattttgcggccaaaaagttgttaagacttggtgtgattctaatgggcatccgcctggatttcaatatgataattgcctccggacctcgaattattttaattgatgccttggtcatagtttttacaattaccctgttctggtggcttggtaagcgtttttccctgaacaaacgcttgaccgctcttctcggggtaggcaccgctgtatgcggggcagcggccattgctgcggtagcgcccctggtgcatgccgatgataatgagacagctatatcggtaggtattgttgctttgcttggtaccctgggtgccttggtttataccctgctccaaccctttttacccttaagcccctatgcgtacggggtgcttaccggttctaccttgcatgaagtggctcatgtggtagcggcttctatggcgggaggaaaggaaagttccgaaattgcaatcctggtaaaattaggtcgggtagcactgctaattcccgtggccatggttatgggttatctttttaacaaaaaacaccgagggtcttcgcagcaacactccaggcaattacccattccctggtttgtcttcggtttcttcggttttagtttggtaaatacctttaacctcctgacacctgcgatggaacagtttatcctgcaggtaagcatttttctcctgacgatggctatggctggacttggcctgcacgtgaggctacaaactttcaggcgggtagggggtggctcgctgctggtgggtgtgatcggatctctggcattagccctgtttggctggggattgctgatattattttcaattacttaagccttaaaaaataatgcaaaaaggaggttcctttttgaaccgaaatcagctggaaattttccgggtggtggcggaaaagaaaagtttttctgaagctgctcgcttactgcatatttctcagcctgccattagtatgcatatccaggctttagaagaatattatgggacaaagcttcttgacaggaccactaagcgggttaccctcaccccggcaggagaaattctctataagtacaccctgcacctgttatccctaatggacaaagctcaacgggatattagccaggctgctggtatcattaagggcaagcttattttgggggcgagtttaaccatcgggggtcatgttttacccccgctgcttagctccttttaccgaaaatacccggatgtaaatattaccatggaaataatgaataccgaaaaggtgctggaacgggtaagcgatcttacgttagatctgggttttgtagagggagaggtaaccaccggagaacttcacgtggaagctttagcccgggatgaactggtagtagtggtagcggccaaccatcctcttgctggacgcgggcggatttcctgggaggaattagcaacattacctctggtaatgcgggaacccggttccggtacccggaaggtgatagaagagcgactgcaggcagctggctttaaactgccggaactaaaaatagtaatggaactgggcagcaccgaggcaataaagggagcagtcgaagcgggattaggagcggctatcctttcaaagtggacggtaaggcgggagattaactgggggatatttaagcagcttctgatagaaaatttaccgatttaccgggaattttatgtagttttaaataataataagtttcactcgccggcgacccaggccctgattcaattctgccgggagcatctatcgtaggtttaaagctaccaaaaaggagccggaatacggctcctttttagcaattaacttttaaactgcttctgccaaacggccagagcttcctcataaacttcccgaaaggaaactttaaattcttgagctgctttttggcatacctcaaattccggatgaacggaaataaccctgccttgatagcgaccaatttttaccggaatcaaaccgtagcgggtatttagctgaattatttctcgttcggcttcatagcgttctatcgtttgtcttcttatccccagacttcccgtttcggaaaagataatttcggcaaatttttcttcgtcagcttccgaacaaagtaccgaaaggataacccccgggcggtttttcttcatttgaattggagtaataaatacatccaaagcgccttcgcgcaagagccggttaaaaataaatcctaaagcttcgggggagagatggtcaatattggtttccaaaagaactactgtttttgcttttaccggacttccggcgaataaaattccccgcagtaaattaggataaagaaaatccctgcttccggcaccatagccggtttttaaaatacttcccgaaggcggaacctgttccgttttttgtaccagggtccggtaaagggcagctccggtaggggttaccagttccccttctaccggtgcgggagttaccggaataccggtcaaaagttccaaggtggccggagccggcagggggatgggaccgtgagcggagtttacaaacccccgggaaaggggtaacggtgaggcgattaccgtatctacctctaaaagataaactccaagaatactaccacaaatatcaacaatggcatcgaccgcccctacttcatgaaaatgaactttatcaatagtggtaccgtgaatttttgcttctgcttctgctaaaagtttaaaagcgtacttgcttttatcctttacctcagagggaagggaacttttttcgataatttcgtatatatcgtttaaatgacggtggtgatggggctttggatataacaccgaaactttttttccggaaatgccgtttttttgaacggttttaacgtctaaaaaaaactccaggggcaatgtatttaaaagattaagaaacttttccacgttaactcccaggtccaaaagaaggcccaacatcatatctccggaaattcccataaaacaatcgagatacagcaacattttacttctcctttaagcccaaaattgaaattgctaaagcggctgctccaaagccgttatcgatgttaactactccgattcccggagcacaactgtttaacatcgttaaaagagcggaaagtccctgaaagttggcaccgtagccaaccgaagtagggacggcaataaccggacaggagacaagcccggcaactaccgaaggcaacgctccttccatacctgctaccgctataataacatcggcctttcgtattaagtcaatactggcaaataagcggtgaatgccagcaacaccggcatcaaaaagagttagcggtttaaatccggcaaacttgagggtttcctctgcttccaaagctaccggaagatccgaagtaccggcggtgatgataagaggattaccgggccgaggctttccctcctggtagtaggcagcggttttagcccgttcattgtaagtagccgcgggaataagttttttaattgcttcataatggtctttacttaccctggtggctaaaaagcgaccgtgacgctcataaagtttttgggcaatgagggccgtttcctccggcgttttattttgagcaaaaattacttcggcaaactccgtccgcttttcccggtgaaaatcaacccgggcaaaacccaggtcttcaaaaaactcgttccgcaaaatttctaaagctttagcggcagtaatttttcccgtttcgacctcttttaaaacattataaagatcttgcatttaccgcgcctccaaaacttcattcatactgccggtacggtatccctggagatcaaggcaaacatatttaaagcccagctcgtgaaaatgattaagaatttccgtacgcttttcgacagccaaagacagctcttcagggtccaactcgattcgggcaacggggtcgtgaaagcgaaccctgacgatattaaagcccagatcctttaaatatttttcccctgaataaatttttcgcaaactttccttcgtaattttcgtatggtaaggaaaacgggaggcaaggcaggcttctgccggcttattccagttgggaagccccatttcccgggcaaaacggcggatttcttctttggtaaacccggcttcccgtaaaggggaacggaccccaagttcggcaattgcccggtgcccggggcgatagtcgttgttatcgtctaaatttgctccatcaacgacatagttaaaatttaattgttcttttaattcaataagtttggtaaaaaggtttttcttgcagtaataacaccggtccgggggattattgacaaagttgggatccgaaaattcatcggtataaaccttcagtaatttaacttcaagcatctttgctatattttctgcttctaaaagttcgtcgggcttataagtatcggaaatgcccacggcggctaccactttatctcccaagacatctctggcaacttttaaaagaaaactgctgtcaactcctccggaaaacgctaccacaaccgactccatttcggttaaaatagaagtaagttttgtgagcttctgctgcgccataccgcacctccggtttgttattaattaattgtagcaaattttcaagacaaaaaaaaccaagaattacggagggatttaaaatgctaaattttacagctgtaatgcggccggaagtaattttaggcgcatttggtttaaatttaatattttttcttttgctgcttaacttatatataaaaacggttaaactaagacgggaactaaaggatttacttaaaggaaactccggacaaaatctggaaaatattttactggatttagcccggaataatgaggtactaaaaggggaagttacaaacttaaaaaagtataccgaagaattaaaccaaaggcttttagtggcagtgcaaaaagtaggaatggtacgttataaagctttaccggacctgggctcagagttaagcttttcggtggcgtttttagatgccaacaataatggggttgtaattaccagtctttacgggcgggagcagtgtctggtgtatggaaaaccggtggaacggggtatttccacctatccgttaacggaagaggaacaaaaggcaattcgcaaagcgatggaagaagggagataatatgtattttaaagaccgggaggatgcaggtcgggtttgcgctgcaaaattatggcaggaaggtattaacggagatgttattgctgcaataccccgggggggagtggtagtagctgcaccaatagctgaaaaattaaagatccccttaaaacttatcttacccaaaaagattggggctccgcataatgaagaggtagcaattggggcagttactgcggatggttcgctggctttaaatgaagaatacataagcttactgggtctttcaccggaagttgtagggaaacaaataaaaaaagcccagcaaaaaatcaaagaaatgcaaaatatatacaatatggattatataaactacgactatacaaataaaaatgtccttttggtggatgatggtttagctactggttttaccgtcttagcggcgggcttgtctttaaaaaagagaggtgcaaactcaattactgtggtggtaccggtggcaagtgctgaagcgatttcgttactgaaaaatcacggctttatggtattttccttaatagtaccggaagatttttacgctgttgggcagttttacaaagatttccggccggtggaaaccgaggaagttttagcgcttcttgctaagaattattcaggataagcagagagaaaattgaaaaaaataagctcaccgggaggtgagtttaatgaaaaaggttgcggtggagcaaggactcagtaacttacatgaaatactcagagaatcaggttatcaagtggtggacccaagacaggagcaacgggtggatgcctttgtggtttcgggagttaaaaataaccttatgggtatgcaagataccaacactaaagctccggtaataaacgccagtggccgtttccctgaagaaattgtaaatgttctgcgggagaaaattggtgactaagctcgattaagacctcgcttaaaaagcgagccatggccattaccgttgagagacgggtgttttgcagcaccatgaattccataaaaccaccaacattaaccaccccggtgagacttaaatctcctaccgggggtaattttttatttaaggcagctcctgggtttagaggaccgtcttttaaaactatttgtccaacgctgtttaatgaccccaaggaagcgtccacagcaatgagaaagggatttttatattgatgataaatattttttaaagtttcttctaagtttaccgcatgaaccggttcttctaaacaaccgtaaacatgaaaaaaatttatccgggcgttttttaaaaagcttcccactaaagggccaaaagcatcgccggtggaacgatcggtacctatacacaaaattaccaccggtcgatttaaagcttttcgcagaatttcccgacttattgctgtttttaaaagttttttatcttcagggttttgaaaataaaacttcaacttcctgccctccctccgtcttgttactataatatccagataaaggaaaaattatactgtttttgcataaaatttagtagtacacggggagggtgatggttatttggttaaaacttggaatgattattataggtagtttggtaggggcaggttttgcatcaggtcaggagatcatgttattttttaatcgttacggagaaaaaggttttttgggaatagttttaaccggggggttattgagttttttttcctggggaacattaaaggtgagccataatttaaaactaaaaaattaccgggaattaattgagttaagcttaagttcccgttatcagtttttagcggatttcgcttttaccgcggttttatttgggggattaggggtaatgctttcggccagcggggcaatttttcacgaatattttaaccttccgggtctctttggtattggctttttgcttttaattgttctcttaacgggtcaaaaacaactgcttggtttatattatataaacataatcttaactcccctcttggtgatttttttgatagtaatttcctgtaaagaattaagtgcgtttaagtatgttgcggcagaaaaccattggctgcaaaactggctatcggcagcaattatctatgcttcgtataatattttgcttttggggtcggttttggtgccactggggcgggaaatgaaagctgctgatattataggaggagtaatttttggaacaatacttttttggttgttagcggggttaatctattttgccttggccgctaactatcccgacgtccttaaatatcaggtaccattgttgtatttggcaggtaaaaagcattttgtttcttattggctctttggaatttgtatttggcttgcagtggccaccactgcagtttccgatggagtggctttggcccttcgactacccaaaagccgaagattacttttttttgtatattttttgagttttttagttgccttaataccctttcagtacctggtgaaatatctttatcccctttttggctatgccggttttttatttttatattgtttgttaaaattattaataggaataaaatggtaggtggttagtatgagcttcaatacccttgattatttactgctgggattgtttttatttttattatttaaaggaagccgggaaggaattttgggacttccggtaaaaattactgcccttgcaggtggggtcatagtttcatttttatggggggacatgctgtttcccaaagttattcctgcttttttaccctatcttccgcaaagcctgaaaaatcagtacttaccggtgttttttaaaggggttttatttttagtaacggcagtcttaatctggaaagccgggggaagtataagacggggtcttagaaaaactccattaggaattatagattctcttttgggaattttttataatggagtgaaaggggttatttttttagtggtgttatctcttattttaataccgttggcaggggttttgattaagacttctcttgggggagagattaaagactttttaagtttggttcaaaattctctggttttaaattacttctttaccttagttaaagatggcatttcaacctttacaggaataaaggaggctaagctatggatttaatgttaaaacgggaaaatattttttccaacacaaaagaccaaaatccaatctacctgtttaatagggagtatcttgattttttaagcggttgtaaaaccgaacggaaagtagcaagttacatagtggaagaggctcaaaaacgcgggtttacgaatcttgaagaggctttaaaggaggaaagaacattaaaacccggagataaagtttatcttttctttaaaaacaaagcggtgcttttagcggtaatcggggaaaagcctttaagagaaggttttaatttagttgcatctcatttagacgtaccgaggcttgatttaaaaccgcagcctctctatgaaaaagatggctttgttctgttaaaaactcactactacggtggaattaaaaaataccagtgggtaacaaggcctttagctctttggggtacggtagttttgaaaggcggaaaagttttagatataaaatacggagaagacgaaaacgagggagttttaacgattaccgatttactacctcatcttgctaaagaccagatggagaaaaaaataagagaagccattaccggggaagatttaaatgcgcttaccggaaatattccggaccaggaggccaaggaaaataaaattaaaacttatatcctaaaacttctccacgaccgctttggtataactgaagaagatttaattactgcggaactatcactggtaccggcaggtccagcccgggaagtgggtttggaccggagcatggttggcggttttggccaggacgaccgggtgtgcgtatttacttctttaaaggcaattttggaagtagaagcaccggtaaaaactgcaatagctttatttatggatagagaagaaatcggctccatgggcaacaccggcatgcaaagtaagtttttagaaaatgctatcttaaagcttttggtagctcagggagaaaaagacgaacttatgcttaggctttcgttagaaaatgcccgggcgctatcggcggatgtgactgctgcggtagacccgacctttgaaggggttttagaaaaaaataacgcagcccagattaattacggcattgttttgaccaaatataccggttccggcggcaagtacggtaccagcgaagcatcggccgagtttatgcgggagataatagatttatttaatcaggaaggaattcgctggcaaaccggggaactgggcaaagtggaccagggcggtggcggtaccgtagcccagtttttagcaaatctcgggatggaagtattggatgcgggagttgctttattatcgatgcactctccctttgaagtagccggtaaagccgatatttatgaagcttaccgggcgtataaagcatttttgagtggtggtaagtcgtaggaatttaaaagtggtaagtcgtaggtgttaagtggtcggtcaataataagggtaacccaagaggtaggggcaactcctgttgcccattgtgatgtgtgaataaactctgccaagaaggagggggcaggtgaaaattgaaaagctatagaaaggaactctggtttaaccttccgacccgccggggttttgtcaacattaccccggacgtagaaaaatgcgtaaaggaatcgggaattaaagaaggcctttgcctggtgaacgccatgcacattaccgcttcggtatttatcaacgacgatgaaccgggactgcaccacgattttgaagtatggttagaacagcttgcaccggaaaaaccttatgaacgctaccggcataacggttttgaggataacgccgatgcccatttgaaaagaactattatgggccgggaagtcgtggtagcggttaccgaaggtaagcttgaccttgggccctgggagcaaattttttacggggagtttgacgggaaacggaaaaaaagggttttggtgaaaattatcggggaatgacctacataagctccaataacggcttaatatcatagcggcggcggtggaaattactccacaggtcgccgtatttttttacccgctcccagatagttttgatattaaactcggcaggggagatctccccttttgttacttcttcccacaaaagaggggtggataccggagcttttggtaggggccgaagactgtagggaaagaccatagtgcgtccccgggaattttgaagatagtcaaggtatactttgcctgttcgctttttaattacccgctccaaagttaccttttcgggataagcttttaaaattaaccggcaaagattaaaagctgcccgggtggtgtctttaaaaccgtactttggttctatggggacaaaaagatgcataccttctttgccggaggttttgggccaggcctcaaggccaagttttaaaaggacctcccgtaaaagaagggctacaggaaggcaatcctgaaacgaaagtggaggttcgggatctaaatcaaaaaccaaaatatccggattttctatctggggtacttctgaaagccagcagtgaagctcgattactccctgatttacaagccataaaagggcttctttatgtgctacataggggtagtttacccatttcttttctttttcgtgccagatagctactttatttaaaaaattaggagcataggcgggaatttctttttggtaaaagctttttccggcaattccgtcaggaaagcggttcatcacaaaggggcggttactgatatagggaaggatgtgatcagccattaagtagtagtaagcaataacatcttttttaaaaattagatccgcaggataaaaaagtttatcgggattggtaatgattttacttaaatccatggttacctcccttggccggagaaaaccccacaattttgggatggcgaagtcccccaggggttttttcaagatattgaatactaacctctaaaagaggataaaggatgatttcccgggggtttttttctttaactatgggggtaagcagatttaaaaggtcgttttgtccccaaaaagggattttatagcttttattagctttttggtcaaaaaccattaagctttccaccttcccctgttttaagaaaacttttgttaaaagaaaattttctttggtataattttttattttaagccagagggcggtacgttttcccgggtaataaaaagaagaaatttttttggcaactatcccttcgtaattttccaaagctgccttattaaaaaaatctattcccttttcaagtacgtacggagcaattttaaaaggcggtggtaggtcttttaaaaagcttttgcgctcaagaagaggtgtggctaaaagactttttccggaaaatcttaaaacatcaaaaattactaaaaaaatattttcttcctttttcgaaaaccccagaagtttggaaaaacttcccttcttaccctccccccagataatttctccgtccagaacggtatcttgcggaaaaaatgtttttacttcggtcaattgaggaaaagaaagggctaaatttttaccgtttcgggaaattaatttaacctctttttcaataaaaacaaggcagcggaaaccatcccatttatattcaaaaagccaggacccatcatcaaagggagcttccctttcttctaaaagcatgggtttaaacaaagcttatgcaccaactttttctccggtaattttttctaaagacaaacgaagagcttcggttaaatcaataacttttgccggaactttttcttcgggaatgacaatagcttcgtgctggattttcttttcaattacctccattaaagcttcccggtaagtatctttatatttttcgggattaaaaggagtggttaaagaatcaattaacattttggccatagaaagctcccgttcctccaccggaatttcctcaggtatttccaatatttcaaacttacgaatttcgtcgggatagaaaatggtggaaacggttaaaacctgttctttaaaaacccgcaccatggcgatattttccttagttcttaaaaccatctttgcgatggcaattttcttgctatcctttaaagcctgcattaacaaggcataaggcttttctccgccttcggaaggtgttaagtaatagcttttttgcaagtaaatagggtccacttcggctaagtttacaaaatccaaaatttcaatttttcgcccttttaacttcggtaaagcttcaagctcttcttcggtaaaagtgacaaactgtcctttagaaaattcataccctttggtaatttcctccgggctaacttcacggttgcatacggcacagaactttttataatgaattggcccgccgcagttttggtgaataagggaaaaagagatgcttttagattcggttgcaggataaagttttaccggaatggatactagaccaaaggcgataaaacccttccagattggccgcataaaatccgctcctttttaatttagtatggcgggaagaaaaatttttaaacttataacgaatagtaattatattgaaaagaaaaatgacaaaaatttatttgaaatataaatattcattatgttattatcttgaaggaaagaaaggaggaaattgataatgggcgaaattatcaaaagctattaccagaaagtaattgcggaattttgggaccaaaagactgcggtcgtacttctgggcattttaagcggcctttactttggaacagtgggcgtagtctgggcggtaaccggagaatttacccgctggggggcaagttttcttaaattaatcggagtggacttatctccttatacttatttaaaaatcatcaaatataaaggtaccgttttaacccggatagacggggtaatggtgctgggaatgtttgcgggagccttgattgcagctcttttcgggcaaaattttaaacttagaattcctactgctaaaagggtgctccaggctttaattggcggtataattgctggctttggtacccgtcttgctatgggctgtaacttggctgccctttttaccggaatacctcaattttcccttcatacctggttttttaccctgggaacaatttttggtacctatattggaataaaaattaccctctctccttattttcggggagagcccaaactggtcaaagcttcggaatttaatgcgggaaatttaaaggcaaatacccagatccaaccctttttgggctggcttggacttattgtttttgccggaattttattgtcccggccggaaatgccgaataatttaaaacttgctaccgtttttggctttgcctttggctttttaattcaaaaggggcaggtctgctttacctcagccttccgggatttatggttggttggacgcacgactacgctaaaggctctggtctggggtatggcggtgcagatgcttctgacagcggcttttatcgccaagggaacgcctgccaaagttctctgggccggtcccaatgcgttaattggtggccttttatttggtattgggattgttattgccggaggatgtgagaccggctggatgtaccgatcaatggaaggccaggttcacttctggtttgtagggttgggcaatgtgattggggcaacaatcttgttcctggtgtgggataagggggtttataaatacttagccgagccgtttccgaagtttagcttgatagaacattttggttacttaccggcctttatattgactggattattccttttagggctgtacttatgggcggatttacgggaagcaagcggcaggtcaatgataaaaaataagaccatgtcggtgaggagggtgtaatatggaagagaaacggtatgttttggatttacggggggaaccctgtccttatccggtggtgtattccctgcaggttctggcagaactggaaagcggagcgcttttggagattttagccgactgtccgcaatcgtttaaatcggttccggaagaagtggtaaaagctgggtacgaaatggtcgaacccccgcaaaaaatcgggccaacgttaaggtttttggtaagaaaaccgtaaaatttgataaattaaaaaggccgagaagcttttagcttttcggccttttaaacgttaaacctgaagtaaatgacatcgccatcctgtaccacgtaatcttttccttccaagcggattaaccctttttcccgggcggcggtcatcgagccaacttctattaattcttcccagggaataacttctgcccggataaagcctcgctcgatgtccgagtggattttgccggcggcctgaggagctttggtacctctttttatggtccaggctttaacctcctgggggccggcagtaaagaaggtaatcaggccaagtaaagcataaccggttctaataagtttatttaaccccggctcttcaataccaaggtcttctaaaaacaacgcccgttcatcttcgggaagttcctgtaattcgctttcgattttagccgacagtacgacaacttcggcgttttcctttgcggcaatttcccgcactatatcgacttctttgggcggtgagagaagatctttttctcccacattggccacgtaaactacgggcttggcggtgataaaaccgatttcccgtaaaatctccttttcctcatcggaaaattcatgggcccgtaccggaagaccccggtcaaagccgtcaattattcttttaagcatttctgcctcaattttgccccgtttttccccgctcttggcaactttttccgcccgctctaaacgtctttgggcggtttctaagtccgctaagataagttcggtatttatggtatcaatatcccgggcggggtcaaccgaaccttcgacgtgggtaacattagggtcggtaaaacagcgtaccacatgggcaataccgtcaacctgccggatgtgggataaaaatttattgcccaagccctctccccggcttgctccccgaacaagaccggcaatatccacaaaacgggtaacggcccgtaccacccgttcgggttttactacttccgcaattttatccacccgggggtcggggacttctaccactcccacgttgggttcaatggtgcaaaaaggataattggccgcttcggctttagccttggtgatcgcattaaataaagtagactttcccacattgggcagtcccacaattcctatttccatctacttcctcctctttataattaatgttttttaattgtttttagtttccaacatccaaccttccaatttctaacttccagtagttttgcgtaccgcccgaatttttctaataattttttcccggggaactaaaataatatggccgcagccggtgcattttaagcgaaaatcaatacctatttttagcacttcccactcgtaatttccgcaggggtgtggcttttttagtttaattatatcgcctatttgaatttcacgcggatcaaccattatccatctccctttcctcccgggtaatgtagacccgtcggggatatggaatttcaataccttcggcgtcaaaagcttctttaatggcttttctaagctcccactcgatattccactgttccatgggctttaccttggcaattacccgaaaaaccatttccgagggtccgaaattaacaatccccaaaaccttggggccttcatagataagttctccgtatttttcttttatttgctggcaaaccctttctaaaacccggtttaccttttccacatcttcttcgtacgctacccctacgtccactaaagcccgctgaggtccccgggttttgttggtgaccatcgttatactgccgttggggatgatatgaagctcaccggtaaaatcccggagtttggtaactctaagccctaattcttcgacaatgccggaggtttgcccgatggtaacgtaatcccccaccgcaaactggtcttccattaaaataaaaaaaccgcttatcacatctttaaccaagttctgggcgccaaagcttacggctaaacctaaaataccagctccggttaaaagggttttggcaaaaccggtattttcaaagacctgggcaataatagtaagaaatgcggtaatgtaaataaagtaactccagagactttttaagatggtacgcagggtttcaacccggttttccttaaggcttaactttttgccgtagggaacaataaaacggttgataaaggagtggccaagcttaagtagtaccaccgagcttaccagaataatcaaaagaattaaggatttatcgagaattttatcccagtttaagtttaaaaggccaaaattcatcagtatccctccggcaattaatctattacaatattatatttaatcttttccaaaaaaacaaatggtaccggaagggacggttcttacagtgaccattttccgttattaaagacaaaaaaattgccagcgaacagctcgctggcagaaccgtcccttaaatacccagtttggcgcggcggtcgttgatgtgggcaaggatatcatcggcaactttgacggggtcgctccccacggctattcttccgccggtgatactggggaggtcccgggttaaaagttttaccaggtttggtgcacccatcaccggaggatccggagctacatgggtatataagccataggctaaggcaaagagggcgtcaatggtagctttttgttccatgtacatgggagcggtcacggctaccggcaaatcggcggtgtcaacgtttaaggcgttggctaaggctgttaccactaaagaaattcggccggtgtcggtacaggtcccaaaagaaagtaccggtggaatatttaagtttcggcatacttcactaagtcctggtccggctaagtttatcgcatccaaattacagagtccggcaacttcaagggcatggttgccgcagccaccggataagatcaggatatcccgcttaattaactcttttgccaggtttacggtgacgtagtcctgaggaccgttctttaaagtagtgcaattgataagtccaaccgctcctttaatctttccggctttaataacttcaattaaaggatttatgctgccacccaaagcttttaaaatagcttccggggtgaaaccggtgatggctttttggatgttggcgggaattttgggggtaatttttccgtggcgtttgtttttaaagctgtcaacggcgatatcaatgattttttgcgcgatttcccgaacttcactgggcttatagtcaaggaaatggtgaatacccggaaaacgtaccagccgggataccgagactaatgttgctccgtatttttccgctaaaggtcctaaattgggcggtgagcagttcatatccatcgccaagacatcaacggctccagtggccaacatcggctcaatagttagccagttgccggttagaccccggaaaacttcgtccttttggaagcgctgtactacttcctggccgctttcaatactgccgtaaattctaaggcttttggcaccggcggctttggctttatcctggtttaccgcttctttagccgctaagattaaagccaccccgacaaacggttcgtgaccgttaaagacgatgttgatgtaatccgcatcaaagatgcccaggtccacatccatttcatggggcataccggtaccaaataaaatatcctgcaccagctcaaggcctatctgggcaccgtaaatacaggaaagtccgagccttagtcctttagttgctaaggatacataatccccgtcgacgttggtaaggcagctggcggcggcatcttttagctcgtgcaggggaccggccggataaatcccaagcttacgccagacttcttttcgttttaaaggagcgtagacctcaatcattttccccggttcgtcatagtcccggtataactcccagattaaaaagtcggaaagacgtactgccacatcttccggtttgccttcggtgtttagctctaaatccttggccatctggtaaagtttatctttatcggtaatggtaaagggggtgttaccgagagcggtcatttttaaagttttataagcttcataggcatggtaagtataggttgaagtacccattacgtttcttaatagcatgtagcgcattgccatgccatcggcgttaattccgcagacccccagggttgctccaaccttttcgtttatccggcaaggaccgttactgcagagctgacaggaaaccccgagctcgcagtaattgcagcggatcttttcctgggggtcaaaacggtcaaaacagttggaaagctggtcttcggctaatcgctgatatagctcgttaaccgatgggtgaatggacgtttttgtagccattttacctacctcctccaaaaaattttcttttttagattggtatttaaaagaaaaaaatatacataaggttgccaaaatagcttgggagtgttataatttttgcggcaaactgtactaccctgctctatccagcgagatagggccatagtccagagggaggaggtgtaagtaatgctgcgccagtacgaagtaatgtacattttgcatccggagcttgatgcggaaaaaaccgaaagcattattgagagatttaaagggatgattgaacaggaaggcggcgaagtaaccaaaatcgaccgctggggcaaacggcgttttgcctatgaaattaaaaagctccgggaaggctattatgtggtaatgaactttaaagccaaagcggaaactgcacaagagcttgaccggcttttaagaatttccgatgatgttgtgcggcatattgttattcgggaagacaagtaaccttttggggtgaattttatgtttaataaagttattttaatagggaggctgacccgggacccggagcttagacatacaccccagggaacgccggtagcatcgatcaccgttgcggtagaccgtccttttaccaccaaagaagggcaacgggaaaccgactttattgatgtggtggtttggcagaaacttgccgaaaccgtcgcccgcgtcttaaccaaaggacggcttgttatggtggaaggaagactgcaaattagaagctataccgataaagaaggccagaaacggcgggtttatgaagtagtgggggaaaacgtgaggtttttagataaacccaagaatgctggattggctcctggcaacttacctgacgagtttcctgcggtggactttgacccgtcggattttggtacggaaatcgagattagcgatgaagatatcccattttaacgtaagggaggttggaccgtgaaaaaagaaaaaggtagccgtcgcaaaaagcgggtatgtgctttttgcgtggataaaatagtagatgtagattacaaagacgtaaaccgtctgaaaaaatatattaccgaacggggtaaaattcttccccggcggatttccggtaattgtgcccggcaccagcggcgtcttactaccgccatcaagcgggctcgaattatggctttactgccgtttaccgtagaataagcgctgaaaaaggagctttttatggctcctttttttagtttattgcaagttccagcgttttactctataataattggcaacttacgattataattaaagttgaataaaaaatgaggtgattttttgaacagcacccggcagttagtagaaagtgcttttttagcggcgattacagcggttttggtcatattaagtgtgtattttccgcccttggcgatagttgtagattttcttacccccatacctattgccgtgttagtggtaaggcattcgaccaaagcaggtattttggcaattggggtggcggctattcttccccttttgactatggctgaccctataacggtttttacggttttatttaagacaggacctcttgggcttgtttatggctattttatcaaaagaaacttaaaaccaaccttaaccgttgccgccggaatggtagcaggaactttaggaacggtaattacgtgggggattacgtttttcctgacaaaaattaatccctttgtcatcgggcgggatatggaggaagcgggaaaacaggtattagagttttactataaaacgggacttataaagcccggtaccgaacaggcgaaaatgttagccgatacttttgcccagatgcctaaaatagccgagctattacttcccggggcaattctaatttcttcgctaatttttgcctatcttacctttattcttacgaaaaagcttttgggccgcttaggatatagttatcccgacctgcctccttttcggctctggcggatgcccttagggcttttactggtgatggcggtgggggtactaatgttttcgggctttcaaaaatacccggtaataagtaaaattggctttaatcttatgtatataaccggctttttgttttttataagtggactgagcattaccgtttttgcctttaaaaaccaggttttgccgcctttgtggcgaacatttttaatagtttttgggatattatatccccctatggccatgtggtttatcctggttttgggcatgaccgatacattgtttgattttcgcaaaaagtgggaatccgggagggtgaatgatgaaggtaatacttctaacggaagttaaaaaacttgggaaaaagggagatgtagtggaggttgccgaaggttacgggcgtaactacctgattgccaaaggtcttgcggtagaagctaccgaaggtaaattaaaggaattacaacaacaaaaagaagcggctaaccggaggaaagaaaaagaattgcaagaggcaagaagcttggcggaaaagcttaaaaatattgaattagtcttatacggaaaaggcggggaaaatggcaagctttttggagcgataaccagtaaagatattgccgaagctttagagaaaaattaccaaattaaaattgataaaagaaaattggatttaaaagaaaacattaaagcccttggagtgtatacggtagaagtaaagcttcatccggaggtaacagcaaaactcaaggtagcggttaaagaagaaggaaggggttaaaggtgaaattttttctactgcctaacgagcggcgcgaattggaaaaaaaagtcgaactaatcggaaatgtattaaccaatttatacggtccggataaacttattttaaaagctgccaaggtggaagccttaaatctcattcaatcggagaagttagaagaaaaggttttgggctatcagaaaatcgtcttagaggatccctccctgacccgggtaccggcggcaggtgaacttgccgaaattttagcaaccattgaagaccatatagcggatattttagcccgccggacggtagaggaagacctggagcgcaaagtagagcggaagatgcaggaacggcatgaggagtatttagaggaaatccggcggcaggttttaaaagaatccggcaacgtggaaaacgctcaaaccttaaaaaaactcgcccgcctggaaaaattagaagaaaccaaaattgctgccacggctatgtcttttctccgtccccggagtttttccgaaatcgtcgggcaggagcgggccattcgggcacttttagcaaaactttcatcaccttttccccagcacatcctcttatatggaccgccgggggtggggaagaccaccgctgcccgtttgtgtttggaagaggccaaaaagcgtaaaggctcaccctttgctccggatgctccttttgtggaagtggatggcactacattgcgctgggacccacgggaagttaccaatccccttttgggttcggtgcatgatcccatttatcagggagcccgccgggatttagcggaaacgggagtgccggaaccaaaactcggacttgttaccgaagcccacggtgggatattatttatcgatgaaattggggagttggaccctttattacaaaataagcttttaaaagttttggaagataaacgggtatattttgattcggcctattacgaccccgatgaccccaatgtaccgcagtacattaaaaaaatctttgaagaaggggcgccggcggactttattttaatcggtgctaccacccgctcgccggaagaaataaatccggccttaaggtcacgctgcgcggaaatcttttttgagccgttggggccggcggaaataaaagagatagttttaaaagcggcgcaaaagttaaatgtcaaacttgctccggatgtaccggagctaattgccggttatacggtggaaggacggaaggccgttaatattttagccgatggatatgcaatagcccggtttaaaaatcccgaaggggatgctttaaccattaccgccgatgatattttagaggtggttaatgtcagccggatttcgcccaataacctggttaggggtagcgatacttatgaaattggcaaagtgtttggcttaggggtttatcagtatttggggtcggtattagaaattgagggaatagcctttgatgctaaaactcccggtcagggaacggttcgttttaacgatactgccggttctatggcaaaagattcggtgtttaatgctttgtcgtctatccgaaaaattaccggcatcgatccccataactatgacctgcatgtaaacgtagtaggcggaggtaatattgacggtccttctgccggggcagcgctgtttttggtgatgtactcggcaattaccaggactcctttgcgccaggacattgctattaccggtgagatttccgtgcacggaaggattaagcccgtaggcggaattccggaaaaaatttacggcgctaaacaggcggggatttctacggtactgattccctttgataatttaaaagacgtaccccggggtcatttggggataaaggttgtgccggtaaagacggtagaagaagtagtggaaattgctacccaaaaaccccttttaaccaccagggcggtgtaggaggatttttttatgaacgagcttttaatgctacctccgcataatattgatgccgaacaggcggttcttgggaccatattaagtaatggtgaaagcctttataaagtcattgaaatcttaaaacccgaggatttttaccgggaatcccataaacttctttaccaggtaatgcttgaattaaatgaaaagggcgaaccgattaccattttaacggtaaccgaggccttaaaacaaaaaggtgacctggagcgggcggggggagtttcgtatattgcttcccttttagccatggcagtgccggaagctaccctggaaagccatgccgagataattgaagaaaaagcagttttgcggcatttaatagacctttcggagaaaataaaaaggcttagttatactgaaaaagatgcggaaagcattttagaagaggcggaacgactggttttagaagtaggaatgaaacggaatcagcagtcgtataccgcggttcgagaaattgtttacgacgccatcgaacgaattgagtttttataccagaaccggggcaatattaccgggattccgactcatttttacgatttagaccggatgttaaacggcttgcaaaaaagcgacctgattattgtggccgcccggccggcgatgggaaaaaccagtttttgtcttaatgtcgcccaaaatgctgcgattaaaagcggagtgccggtggcggtttttagcctggaaatgtccaaagagcagctggtgaccaggatgctgacctccgaagccatggtagaccagcaccgggtaagggccggggagctttccgatgaagattggttgcggttaaccgaagtggcgggaatattagctaaagctccgatttacattgacgatactcccggtttaacgatacgcgagctccgggccagagcaaggaggcttaagcaggaaaaaaacatcgggttaattataattgactacctgcaacttttaaacggcagtcgccgggccgaaagccggcagcaggaaatttccgaaatctcccgggccttaaaagggctggcgaaagagttagacttgccggtggtggcgttatcccagctttcccgggcggtggaggcgcggcaggataaaaggcctattatgtcggatttaagggaatccggttcgttagagcaggatgccgatattgtcatgtttatctaccgggaagagtattacaagcccgatacggaaaagaaaagcatagcggaaattatcattgccaagcaaagaaacggcccaacggggattgtggagctgggatttttaaaagaattcaccaaatttgttaatttagccaaaaagtatacggaataatttttttggcaaaacttgacgatggaaagataatagcggtatactaaatttaaaacgcagcattagacgggacaaagttactttgtcccgcttttgcgtttttaggggaatattatacaaaaaaaagtttttttaagaaaaattatataacagcttaggatggtaaaaatgcgcatagtagaagcctttattggcgaatatgccagcggaaagagtgaaaatgcagtaaaccgggcattggaactaaaaaatcaaggcagaacggtaaacctggtggacttggatacggtagaaccattttataccctgactcccattaaaaaagagttggaagctttgggacttaaagtattggcctgggagcgggatgaggcgcttggctttggggagacaggggtacttttaaagccggaaattcgctgggctcttagatatcctggggacgtaatttttgatgtgggctacggtgtgcatggttcaagaagtttaaacttaattgaaggaatctggcaggaaccaaatttaaaagtttatacggttatcaatgcttcccgtcccatgacccgggaagttgatgatattgtcgagcatgtaaaaagccttggccgggtggatggattaatcaacaatacccacttgggggatgaaaccacctgggatgtaatttgtgacggcgaggaaaaagtgttaagggctgcaaaaattttgggcttaccggtattatggaccgccgtcgaccaaaaactaattaatggtaatgaggaaatgcttcaaaagcttaaaaccccggttaaggggttagtaagatacatgccaaaaactttttggtaatactacgaggaggtgcgaaaaatggcaaataagccaattaccggggagcaaagagtgtttatgaccgggaacgaggttatcgcttatgcggcggtgatggccgaagcggatattatgtacggttacccgattactccccaaaacgaaattatgcactactggaccaggcttgcgccaaaatacggcaaaaagtttttacaaaccgaggacgagctctcggctggttttactaccataggaggggtcctggccggaagaaaggcttttaccgccactgccggtcctggcaacaccttgatgcaggagccgatgtccatggcggaaatgatgcggattcccaccctcttgatagtacaacagcggggtggtccatcaacggctaccgttatttattcccagcaggaagtaacgatgaccacctatggtggcaacggtgaaggctttagaattgtctactctaccgcaagccaccaggacctttatgattatgtaattaaaggttttaataccgcgtggaaataccgtttccccacctttatcttgggcgatggttatcaagccaaaatgcgggaagcctgtgttatgtacgatcctgccgaaagagggatcgaacttgtaaaacctactccttacatgggtgctcccggcactcccggggtagaccgcaaaccaagtcatatgcggaacacctacaacaccgaggaagagctgtatgaagtggtcatgaaccttgccaaagcgtacgaagccataataccggaagtggtagaatttgaggaactaaatgcctttgaagcggataccgttatcattgcccacggtgtcgtttcccgggcggccaaaggagcggtaaaagaacttcttgccgaaggtgagaaaaaagttggctatttccggccaattaccttaagacctcttgcggtaaacgaactacgggaaattgctcaaagagccaagaaactgattatagcagaatcttcctatggtcagcttttaaagcaaattaaagaagcaatttacggaaccgatgttgaaatacacaccatcttaaagccgggtgtgggcattacccaggaagaaatcgtggccaagtaccacgaggttaaataagggagggataaaggtgaactatccgcaaataccaaaaagctggaatatagaatcaaaaccccataagttttgccccggctgtggccacgggatagctttgaaagctttaggtatggtcattgatgagcttggcattcaggataaaacggtttttggtgtagatattggttgttcccttttggcctgggactttttcaatgtggataccatccaaacccaccacggtcgtaccacaccggtcataaccgggataaagagggctaacccggaattaataaccattgcttacatgggggacggtggcggttacgctattggttcgcagcacctggttaatgctgcagcaagaaatgaaaaaatcaccgttatcctgattaacaacaccaactacggaatgaccggtgggcaaatggcaccaacgaccctgcccggacaaaaaactgaaaccaccccttatggccgggatgtcggtgaaactggttatccgaccttaggtccggaaatggtagcggcaattgcccgggaaggggcttatgtggcccgtggaacagtggccaatctccgccagttaaaaggatttatcaagaaagccattgaaaaccagatggccggcaacggtttttcctttgtggaagtgctttccggctgtcctaccaactggaggaccaatgccaaagaaacctgggacttcattgaaaacaccatgacccaatactttaaagtaggggaattaaaagtacccgggaagggggaataaagatggcgaaggtcgttaaaattgctctggccggcgaaggtggacagggagttcagtcggtagcggaaattattgccgaagcggccaacgaagagggaaaagaggcaatttacatccctaactttggtgtggagcagcggggcggagtgtccattgcctttatccaaattagcgatgagcctatcggcagtcccaagtttgaaaaaggggatatcgtggtagccctttccgaccgggcgatacggcggacccggcagtatgtaggggaaaacacgatttttgtttacgacagcagtattgaaggggtagagcaggacctgcctaccaacgctaaaaaaatcctggcaattccggcgttggaaatagccaaaaaagaactccacccccgggtatttaacgttgtgatcatgggagcggtgctggaagctacgggtgtagttacaatggaacaggctaaaaaagctattgagaagaaattgggatataaatttgaaaaggacccgaaattacgggaattaaactataaagccattgaccggggtgcttccctggtccgggaacagtagaaggggggaagaccggtggaatttaaagcaagagtattggagcacaccaaaggtacctggacgatttatccgggcctttgcaaaggttgcggcctctgcatggcaaaatgccccaaaggagcgattagctggtcggaagtcttgggggtctacggcaccccggccgtggaatccgatgataaatgtatcgcctgcggcatctgccagatggtctgccccgactgcgctatctacgtcgaaaagaaaaagtagcaatttcgggacggttcttttctttatacttaaagtataaagatagggactgtccctatttttatatttaaaacctacgacctaaattactacttcttgggtggtggtagaggctggagtggtgagttcaacggtttttaccttgccctggggttgggttactgttagttttaccacggtgttggccggcaccgggagggttaacctaccggttaccgggtggaggtagcccacatctataaagtcctggcctctggcattataggatatcattccttcgaaaggtttcttctgaggattttgacttatgatttttaaataagaagcttcagcaagatattttaataattttccggcatcgggaattccccagccgtagccaaagtttggcttagcggcaaaacttccggaaatttttaaaagactgaaaagggtgtcggggtctaacttatatttttccaggattgctgcaagcattcccgaaattataggagcggcagcggaacttccgctttgcgaagcatatcctttgctccaggtagatacgacacccactcccggggctaaaaggtctggctttaaataatagggaaagcgaaaggtagcagtttgaggtgtgacaaaatcagtgttgctaaagggggccgggtaaagaaatttataatttacggtttttggataaaaatccaaagcgccaactcccaacaccccggggatatttccggggcttgaggatgtttcggggccatcattgccaatggctgctaccggcaagatgcctaaaagcagaagattgaccatgggttgaacgaggagagataaaaatccttctaccccccacgacatattaactatgctaatgtttttttgcagagctataaactgaaggccggcgataatttgctctaagctaccggaaccatcacggtctaaaacttttaccgaaaaaagttttgctgcgggggcaattcccagcgggttatcttttgtaccggcgacaattaagcccccggtaaaagtaccgtgcccattatcatcaaaagcttcacctggtttacccggagtcaccttaccgtcttgctccacctttgcccagcccacgattttccccaaaagattgggatgcctgggatttattccggtatccaaatggcctaccacaattccttccccaaacaatcccttatcccagagggcagtggcgtttaccggtttatactgccagaggctttccttaaaaagagcccgggcagggtggtagattttccggcgggtaacggggattttcactctttgctccgctaaatcaatgcttcttacttcgggattttctaaaagcctttgaatagtatccgcatcaagctcggcaataaaccccggtaaaagccagtaacttcttgcgttatcagctctaacccctaagagttttttaaccttctcctcaagatgtttttccagggttgtgattacttcttcccggtcaagtccccggtaaacaggctcttcgaaaattaccgcaaccttaaccgtttctcctatctttaaggtaaaaagcttttcttttaaagcttttcccattttattcttacctgccatttttgtcacctctttccggttctcttaataaaatatgaaattaccaatgccagggtaactttttattttttgcgtgtttggtaacaatactattggggtgaattttatgtactgtgccttttgtaactcgtttaaggaaaagggtatttggcttttgggccgttttttatgccgggaatgtgaaaaggagttaaccaaaatcctgccggttaatcctgcctatccgttcatcgtcaaaaggtttcgaaactttttcttaaaacaaaagcagttatggtaaaattattgtaaaaggttaaatcttaaggagaagctatgtcaggtttaatagataaaatccaaaaacatatccaaaaaaaacctatctctttccacatgcccggtcataaaaatggccggtttataccgaaaaaagtaaaaaatcttttaggagaaaaatatttcaaagcagatttaaccgagcttccgggtctcgataacctttatgcgccggaagaggccatacttaaattagaggagaaactttcccgctactttggtttaccccgggcgcatctatcggttaacggctctacggcggcggtaatagccttactgctttcgttttttcggccgggtgaaaaaatagcaattgatcggatgtcccacgtatctctgtaccatgggatggttttaggggatttaattccggaatttatctatcctcattgggacgaggagtacggacttccggtaaataagactcctaaagctcacaacaaaagttattttctgaccaaccccgactaccaggggctaatccgggatttaacggagcttaaaaccgaccggctccttctggatgcggcccacgggggtttaattcctctatggcgaccggatttttttaaaaacattgcaggatttgcggtaagcctgcataaaaccggtccctttcccaatcctctggcggcggtggtttttcgggataaagggatagaagtgaaacgggcgctaaacttaatccaaactaccagcccttcgtaccccttaatggctgcggccgagggcggggtggacatgctattaaaggttggtgcacgagcctttcaaaaagccaaggagctttcggaccattttaaggagtacttgaaaaaacgggggatcgggtttcttcaggataaatacccggcggaccctttaaaagttaccataaaagcggcggatttgggtgtttccggagaaaaaattgccgcaaagttaatgaaaaagggaatttatccggaggcttacggtccgggttatgtgctttttatgttttccccgggtaataccgaaaaagatgtcaaaaagcttataaacattattgaaacaataaaaggtacagataaaaaaatctttatcccgaaaaatccttttagttttcagccagaactaaaattaaccccgcgggaagtgtattatgcccaagaaaagcttgtggatttaaaagcttcagtgggttatactgcccgggatggggttacggtttaccctccgggagcaccggtactctatccgggggaagaaattactaaagaagcagtggagtatttagagtatcatttaaacttgggagtaaaggtaaccgggatatatgatggcaggataaaggtggtaaggtaatgcgcggtaaatttattaccattgaaggggtggaagggtcaggaaaaaccacccagatacaatatattgctcggtatcttacagaaaaaaatataccccacattatcacccgggagcccggtggtactgctttgggtaaaaaaatacgggaacttttattaaacccctcctacccggtggtaccggaagcagaaattcttttatacctggctgaccgggcccagcatgtgggggaaaagataattccccatttggacaaaggggtatgggtaatttccgaccggtattttgattccacgttggcttatcagggttacggccggggatttgacctaacccttctaaaaagtttcatagcttttgctaccaaaggtttaattcctgatttaacagtattaattgaccttcctccggaagtaggattatcccgggttaaaggccggggggaatatgaccgtttggagcgggagactttggagtttcaccaaagggtaagggaaggctttttacaacttgccagagatcagcgttttcgagtggtggatggccggaaaaagcccgaggaaattttttgggaaatcaaagggtttttggaggggctaaatggataatctaattatagaagctttaaatcaggataagctaagtcatgcgtatttattaacttcaccggttcttgaggcggtagtggattttgcccgaaggaccgcccgggaaatcttaataaaatcggccaatgaccccgtggaggcagcaaacctttttgaggcgggaactcatccggattttctctggcttgcacccgatgggagctcctttaaaatctggcaggtcaatgaagtgttgattcccaaagtttaccttactccccaaaagggcagccgcaaggtaattgttttagaagaagtagataaaatgacccttgatgccgccaatgcttttttaaagactttagaggagccgccggcaggggttacttaccttttaattgctaccatgccggaaaaagtgcttccgacaattcattcccgttgccaaaaagttaaagtttcagccgaagattttacaggccagtataaagggtatgcggaaaagttttatgagcttttaactttgccctgggaggagttttataaaaagacggaaaagattacccgggaagagctaaataatcttttgctggcaggagaattaattctccgggatgcgctgattgttgataaaggatcggaaaaattgttttatccggatcttttcgataaagcacgggaattaaaccgtttaggtgaagaggaaatttaccgtttacttaatcgtttggaagattttttagccaaaacccgtttaaatttaaatcccaggcttgtgttagaaaacctctacctgaactttagcttttacaagtagtaaactttgaaaaaataatttataataaaaacaattataaatttggaggagtaatatgccaaaagtagttgggattcgctttaaaagagcggggaagatttattattttgacccgttggacatagattttcaatacggtgatggtgctatagtagaaaccatccggggggtagaatacggcgaagtaatgattccacccaaagaggttcctgaagaggaattggttttaccgctaaagccggtgataaggaaagctacccctgaagatttggaaattgtgcgggaaaataaaaaaagggaaaaaaaagcctttgctatttgcctggagaaaattgcccagcacggacttcccatgaaactcgtgggggtagaatatacttttgaccgcaataaagtaattttttattttaccgctgatgggcggattgatttcagggaactggtgcgggatttagcagcggtgtttaaaacccggattgaacttcggcaaatcggagtccgggatgaagcgaaaatgatcggcggccttggctgttgcgggcgggagctttgctgtgcttcttggctttcggaatttgctccggtttcgattaaaatggccaaagagcaaaacctcactttaaaccctaccaagatttccggcatctgcggccgcctgatgtgctgtctcaaattcgaaagcgatacttacgaacaggtcaaagacgattatccggaagttggcgaagcggtgcttactccgatgggagaaggtaaggttaccggagttaatattttcaggaaaaccgtctatgtggagttaaaggaacaaaagcatgtcaaggagttcccggcggaagaggtagtggctaaagaggaagtagaggagggtgaggtatttgaacaatctttcgacccttcttagccagtttgaggaaaatataaaaaagcttttggaagagtatttggaaatcaaatcctatgtttcccagcttgaagaggagaatcaaaagctacgccaggaggttatcaagttttacaagccactgcaggaagaagccaaaaaagaaaaaaagcccgggcctggatttcaaaacttggcccgtctttaccaggaggggtttcacgtttgccatgtgcattttggcgaagcccggggtgatgaagactgcctctggtgtataacttttatcaaaggaagaaacaacgagcgaggggaaggaattgacgaagaaatacgccgaactgccccctgatcgggtggacgatttaaaaagagccgggctgaagatttaccagaacccggcgcttttttgttttgcgattgatagtgtcctcctggcctggtttaccaaaacagctcccaacgaccgggtagtggaccttggaaccggcaacggcgttgttcccctgcttttatatggaagaaaccgggagattgggaaaatatacggcattgaaattcaggaaaagctgtaccagttggcggtgaagtctgtagctttaaacaatcttgaagaaaaaatcgaaataatccttggtgatttaaaagatgcacccgctatcctcgggaagggttttgatgtagtaaccgccaaccctccttatcgcaaaaagggggaggggcgtttaaatcccgtgccggaagtagcggtagcccgccatgagcttttaactactctggaagacgtggtggcgacagcggcaaaacttttaaaaccccgggggagtttttatttagtgcatctgcccgaaaggcttccggaaatctttacccattttacccggtataaactaaatcccgaagtgttactgccggtgcagcccaagcccggagagaacgtaaaccttgttttaataaaagcggttaaggggagccggcgcaaattagagtttttagctcctttgtgggtttatgaaaaagacggtcaatattccgaacaggtgcgccggatttttgagggggaagagtaatgggaaccttatatttggtaccgacaccccttggcaacttaaaagatattaccttaagggcgttagataccttaaaagaagtagatatcatagccgccgaagacacccggcatactttgaagcttctaaaccattatgaaataaaaaaaccccttctatcctaccacgaacacaaccgccgggaagcggggaaaaaaattcttgaacttttagcccaggggaaacaagtggctttggtaaccgatgccggaactccaggcatttccgacccgggagaggatatcgtgcgggaagcactaaaggaagggtataaggttgaggcacttccgggagcttcggctttaattgtggccctggcggccagcggccttactacttcccgcttttgctttgaaggatttttaccccgaaaagccggggatcgggagaaatggttacgggaactttcccgggaaagacgaaccatgattttttacgaagccccccacaggcttcttaagactttggaagatttagcaaaacattttggagaaaatcgccggatggtggtagcccgggagcttaccaaaatccatgaagagtatatccggggaagcattgccgaggttctctcccattttaaagaaaaagagcccaaaggcgagtttgtgttggtggtagaaggagcaccaccggaagaaaaaaacgtggaggaatttgtgcgggaatgtatcgaaagaggtttatcccagaaagaggcagttttacttggccgcgaacttggctttaagaaaaaagaaatttataaattgtatcttcaattgaagtagcagtttcgggacagttcctaaaattatacttaaagtataaaaagagggactgtccctttttttatctaataaaatcggcctttttggtaaacgctaataaaaatgaaagggggccgattatgcgggatgtggattttgatcggggacttcgggaacgaattgaagaagcgcttttaagtaaattaaaagaaagcgccatcggcatgaatattgatgtgaaagatggggtggtcaagcttcaaggaacggtcgatgtgctttccgagaaaaaagcggcggaagaaattatccaccgcattcccggggtcaaaaaggtagaaaacgagcttacggtagcgttggataacggaagctacagcgaccgggaaatagaagaagaattaaacgataaacttgccaatgaccctcggattgaaggagaaatcggagctaaagtttttaatggcatagtcactttacagggcagagtagatgctgcaattaaagaattctgggcccggcaggtagcggaaaggacccggggagtggtggaagtacgaagtcaggtagaagtattgccggaaatggagatagatgacagcaaaattgccaatgaaatctcgcggcagctcaataattccctgcatgttaatcgccgggatataattgtagaagtggtaaacggcgaggtaacgttaaaaggagtggtggatacccctgaacaggctcttcaggcggagctgattgccttaggagtcaaaggtgtaaaacgggtggaaaaagagttagagtttcgccacggagaagatgaaggcgataaaaagctaaccaacgagttaagagaagctttaggtaaagccggccttgccatggtacgggcagtggtggtcgatggaattgcgtttttacacggtaaggttggtacccccgaccaacgtcaccgggccgaagaagtggcagcaaaaattgaaggaatccgggaagtgcataatgccatttacataacggttcattaatcaaaacccaaaaaatcttaaaaacttctccacaaatccttaacaaatttaagcaggaaataccccgcttgaaggcgaatttatacctcaaaataaaaaaaagcggggttgtgtggtatgtactattattacagcaatcaggataaaaaaccgtcatttttaagctatgtcttggtttccctaatttcagctattatcggtggccttttagtggtaatgtttgtaccaggcctggtgaaaggaaatgtatcaactaccgggactatagagaaaagggttatttatgaggataaaagcccggtagttacggtagccgaagaagtagggccagcggtggtgggaatttccaacaaagtaacatttcaggccggggatgtacctcataataatgtagaacaggctaccggttcaggagttatcattgatgccagaggttacattgtcaccaatgagcatgttattcgcaatgctactgatttaacggtaacgctggcaaacggaaaacaattcccggcgaaaatagtgggaaaggatccccgaacggacctggcggtaataaaaattgatcccggcaacgaaaagctcacggttgcccgctggggggattcggataaaataaaagtaggggagctggcggtagccataggaaaccctttaagccttgattttgcgagaaccgttactgccggtataatttcggcgaaaaaccgtattttaaacatggacggccagcagtacgagctgattcagaccgatgcggcgataaaccccggaaactccggcggagccttagtaaatgctgccggtgaagtaataggcattaactccattaaaatttccctgtcgggagttgaaggtttaggctttgccattccgagcaatatcgctaagcctatcgttgaagagctcattaaaaacggtaaggtcattcgcccctggatggggattgaaggacaaaccattgacgaagaatttgctcagtataagggcttaaagcagaaaagcggtgtgtatgtagcccgggtagtaaaagacggaccgtcggcgaaagcaggtttaaaagataacgatattatcatcgaatttgacggggtaaaaatcgagaagtttgaagatttaaggaatgccgttttaaaacacaaagtcggtgacgaagtaaaagtgaaagtattgcggggcgataaagaaatgacctttaaagttaaacttggcgaaatgccggcggagtaagggatggtaccggcaacctgtgacttttgcgaccttatacccgtttatctggtggtgtaaatggaaattacaattgttgcggttggcaaaatcaaagaaaggtatttaaaagaggggatagccgagtatttaaaacggctatccccttatgcccgtttagcggtaattgaggtggacgatgaaaacgctccggaaaacctatcgccggcggaagccgaaaaggtagtaaaaaaggaaggggagcgaattttagctaaaattaccccttcttcttttgttattgcccttgatcttaaaggaaaaaatctctcatctgaagagtttgcccattttatttcggaaaagaatctttatgggcaaagtaagcttacttttattatcggcggctctcttggcctttcccgtgaggtcctggaacgggcggattttaagctttcttttggcaggatgacctatccccaccagctgatgcgcttaatccttttagagcagatctaccgggcctttaaaataatccggggcgagccttatcataagtgataaagacaaaaatctagataaaataaaaaatataacaagatttgggtttcttccaactccccatggtttaacagggataattttgaaaggggagttaacccctcttatccttcataagaaaccgtaacagttactcgggttgctgctcgactttgccctatcatcctgaaatgtaaaagatttaaagaattgccattttattaagttgaaaatcatttacaaaaataaagtttaattccaattcccctgccgttttggcaggggattttttatgccttaatcgttagtatgttttgtaggttgtaaagaagcattttatttttattgggaatctacaggcaatgctgttcttcagcccttagatttaatttaagtttctaaattaatgatttctgcaaattcttttgacttagtgtagttttggacgaaaccaatgaaagcttgagcagcccgtgataggcatcgatctttttgccaggctaaaccgatagttatgttcattggttcttctaattggatactgacaattttatcccatttttttgttattccattcattaaaaaagtaattcccaagccattactaaccaattcttttatcgtttcaatttggcatgaggaaaggagaatatttggagaaaacccgtaatagttgcagagggcgataattttatgacgagtgtaggaatcctcttttaataagataaattgttcatcttctaattggcgcaaacttattcttttttcctgactaaatctatgattttcagatacacaaagaacaatttggtctttggttatgggcaacatacagagattttcactttgctctggaagaatgataagacccaagtcaagttctccattttcaagtaaagataccatagcccaggaaccttcttcgcgtacatgcaattccaagtgggggtaagcgtttttaaaacctttgaaaattttaggaaaaaggtaagctccgatcattggggggattccaagtttaataacaccttttttataattttttaaatcttcaagctcggattgggctttttttacatcctttagtattttttctacatgttgaagaaacagcttgccctcgtcggttagaacaactttccgtttactacgatcgaaaagttggacttttagttcttgttcaagattatttattgcaattgtgatggatggttgagcaacatgaagttgttcagcagcacgagtaaagctgttaagtttgctaacagcataaaaatactctaattgtcggaattccatttgtttcacctcttttaagatgccactaaaaaagaatccagttaataagtgaaaaaaataacaaattatgttaatcaatttcgtcatctaattatttcgaatattagtataccaattatgttaaaaaaaatcaatcaaataagagcaagagctgtttatatactcgaatcagcagaaatagataatataaataaagttatttaaaaaaaatattaattacttaggaaagactaaataataaatagaaaatattagaaattttcccttaagaaaggataaaatatatagtgaaatgtgaatcatttcacacacccgttgggcccaatgggaatggaaaattaaaaatttttaaaaggagagagtgaattgtatgaataaaaaaattcgcgcattgctaacctgtgctgtaggtttagcaatttggttttccccaataccgacaggcttagatcccaaagcttggcacttgttagcgatttttgtggcgacaattataggttttatcttgcagcctctaccaattggcgcaatagcttttattagtgtcacattatcagctcttactgggattttagatgccaaagctgcattggcggggtttgcaaattccacaatttggctgattgtttctgcttttatatttgctataggttttgttaaaaccggtttgggattacgaatagcctattatttaatccgcttattaggcgatagtactttaaagttggggtacacattggtattaagcgatttaattataagtcctgccacaccttctaatacggcccgggcggggggagtattattcccgattgtacggagtcttgccgaggcttttggctctaaacctggggagtcccctcgcaaagtgggtgcataccttatgcaaacagcatatcaaggtaatgctattacttcagccatgtttttaacttcgatggctggtaacccgcttattgcacttcttgctttgaaaactctcaagatagacattacttggaatctgtgggctaaagcagcaattgtacctggaataatttcaatcttagtaattccttacttgctttataaaatttacccaccagaaatcaagaaaacacctgaagctaaagaaattgcggctaaggaactggttaaaatgggacctatgaaatttgaagaaaaagtattagctattgtatttattggggctctaatcttatgggctacctcccaatataccaaaattgatgctactattgtagcaatgttaggcgtttctgccatgctagtagcaaaagttattgattggaaagatgttctggctgaaaaaggagcatgggataccttagtgtggatgggtgtgttagtagcactagctggtaatctttctgagctaggttttattccctggtttgcgaaaaacgtagggaatatgatttctggaatttcatggttctgggcgttcgttattcttctggtagtttacctttatgctcattatggatttgctagcttaactgctcatattactgcaatgtatgctgcttttgcttctgttgcagtggcagccggtgcaccaccttatcttgtagcactatctttagcctttatgtctaatttgtgtatgtctttgacccattatgctgcaggtccatccccgatttattttggtgcaggctatgttgatcagggaacatggtggaaacttggttttattgtttctatagtaaacctgtttatctgggttggtatcggagcagtatggtggaaagcccttggactctggtaaagttgcttatattacaccactggatcagttagttcactggtccggtggtgtaaaaattctcataaatgtgttttttacttctaaatttggaaaaaggaaaggggtaagaggatgcgtatcattgaagcagctcaaattacggaagctgttgctcagcttgcaattaaagctaattattatttaaatcctgacctgtatgaagcgctggttaaaggtcgggaaatggaagaatcgccaataggtaaagagatttttgaaatattgataaaaaatgctgaaattgctagggaagaggaaatggcaatttgtcaagatactggcatggcagttgtgtttatggaaattggccaagatgttcatatagtagggggaaatcttgaggacgccgttaatgcaggtgtggcaaaggggtatttagaagggtatttacgaaaatctgtcgtagaggagccattatttaaccgagttaacactaagaataacactccagctgtaattcatgtgtcaattgttcctggtgacaaagttaaaatagtgcttgctcctaaaggttttggtagtgagaatatgagcgcacttagaatgtttaaaccgtctgatggtattgaagctattaagaagtttgttgttgatactgtagtcaatgctggttcaaatccttgtccacctatagtaattggaataggaattggcggtacaatggaaaaagctgctcttttagcgaaaaaagccttgattcgtccgcttaatatacggaattctcatccacagtatgctgctttagagcaagaattacttgaattagtgaataacactggtattggacctcaggggttaggtggacggataacagcattggcagtaaatattgagtggttcccaacccacattgcaggtttgccagtggcaattaatataaattgtcacgccaccaggcatgctgaaatcgaactttaaagactctataagggggaaaaaagatgaaagagcctatccgtattacacttcctttaactgaagaaaaggtgcgtagtcttaaagcaggtgatagtgtcttaattactggtgtagtttatactggccgggatgctgctcacaagcgcatggtagaagcgttggaccgtggagaagaactacctactgatttaaaggatcaagtgatttattatgtgggaccaactcctgcaaagccaggtaaacctatagggtcagctgggcctaccactagtggtcggatggatgcatatacgcctcgacttttagaaaaaggactaagaggaatgattggtaaaggataccgttcgcctgaagtaattgaggcaattaaaaaatatggagcagtatattttgttgctattgggggagcagctgcattgattgccaaaagtattaagagttatgaagtaattgcttacgaagatttagggcctgaagcacatgccaaaatctatgtagaagattttccggcgattgtagctattgattgtgaaggaaacaatatctacgaaattggaccaaaaaaatataagaggtgattaaatgcttaagtacgacgtactcgtaataggcagtggaggagcgggaatgcaggctgctttagtagcagctaagtcgggagaattaaatgttgctcttatgacaaaagtgtttcctacgcgttctgctacttgttgtgcccaaggtggtactaatgcagctcttcggaatgttgataagtctgattcaattgaaaaacatgcttttgacactataaaaggaagtgactttcttgcagaccaggatgctgtagaattttttgttagtttattacctgaaactattttggagctggattattttggagttcctttttcccgtcttgaagatggtacaatagctcagcggccttttgggggacagtctcatccgagaacatgctattctgcagataaaataggtgctgtagttttacacaccttatacgaacagtgcctaaaaaatcaggtaaatattcttactgagtggttcttattagatcttgtagtagaaaacgagcaaattattggtgttgttgctatgaatatgaaaacaggagatattcatccgatcctggctaaagctgttgttttagcgacaggtggggctggacgcgtttactggaaccgaaccactaacccgtttgcctccacgggcgacgggatggctgcagcttttagagtaggagttgctttaaaagatccagagtttgtacagtttcatccaaccggcttagctggaacagggatcctaatgtctgaggcttgccggggtgaaggaggatatctcctgaataataaaggtgaacggtttatgcaacgttatgctccagaaaaaatggagcttgcaactcgtgacttggtttctcaagctattgaaactgaaattaaagaaggtcgtggatttggagaaggtataaatgcttatgttctgcttgatttacgtcaccttggacgggaaaaaatcttagaacgtttaccacaaatccgtgagcttgctatccagtttgagggtattgatcctatcgagcagccaattcctgtgcgtccaagttgtcattatagcatgggtggaatagatgttatagattacaaaacttgtgctacggttgttaagggattatatgctgctggagaatgttcttgtatttcaatccatggtgcaaaccgtttgggtggcaattcaactgccgaagctgttgcttttggtaaagttgctggcaaagcagcggcagaatatgctcaaaatgtaggattttcttctgagaaaaaagtaagtgagtgtgctaagaaatgggaaaatgaatacaatattgctgtttcgcggacaaatggtccgtcggttgcttctattcgtagtcgtttagcagagacaatgtggcttaatgttggggtttttcgcaaggaaaaagaaatgttgcaggcagcaaaagatgttgatgcattaattgaagagtataaatactgtgttgttggtgataaaaacagaatttataatacggcgtttacgcagtacatcgaattgggtaatatgcttacggttgctaaggctattgttataggagcgttaaaccgcagagaaagtcgtggttcgcataaaagagaagattatccgcaaagagatgataaaaactacttaaaacatacaattattacccttgaaggttcggagtacaagttgtcgtatcgaccggttgttattacaaaatatcaaccggcagagaggaggtactaaatgcaaaaagttacttttaaaataagacgatttgatggggaaaaatcatgggttcaggagtatcaatttccttatcagcctgggaaaacgattctttgggcattatcttatataaaagagtctattgacccaacgttaacctttaccgcatcctgccgccatgctgtttgtggtgcgtgtgcagtgcgggttaatgggcaggcggtgttggcctgcgaaactttgttggataagatgttagaccgttgggaaactgatactttgctaattgagcctctgcagaattttaaagtaattcgcgacttagtggtagattgggaaacaaaagtggaacgactagcaagggtaaaaccatggttgatacctcgcgacgaatttagcaaagaaacaggctgtcggcaaacgcctgaggaattcaaaaaaattaataaaaattccgactgtattttatgtggttgctgtgcatcggagtgtaataaacttagcaataacgacagtgattttcttgaaccttttatcttctctaaagcccaaaaatttatcgctgattctcgcgataaagacccgctttcgcgtataagtactgccattaataatggagcctggaaatgcatgcattgtcaggaatgtgtcaccaagtgtccgaaaggcttatctccggctgatgatatttctttcattcgtcagtttgcaatagctaatgggattagaaataatcctggtacccgtcatgctaaatcatttttggacgatattcaaaaaaccggccggttaaatgaggcgttgatgtttattaaaactgaaggattgttaggatcattaggtagcatcccagtggctttgcgcttggtaagaaaggggaaactacgcttgaagcatgtgttggccaaacctataaaagaaatcgaacaggtccgcacaataattaaggttattacgaaagataaaaaatagttaggaaaaattgaatgaaaatgtccaaagcagatgtttgcaaaatcaattaaagagatataagcaggcttgtaaaatattaaaataacaacgagaaaacctaaaaaaggggagtaagtacaattatgaaatatgcattttttcctggatgcgttttgcaaggggcaagtgaagaagcgtatatagcaacgataaaagtcgcaaatgccttaggaatagaattagtggaaattccggggtggacttgttgcggaggttcccaccttcaggattacgatggaacggttgctttagcagttaatgcgagaaatattgctttggcagagaagatgaacctgccgattcttactgtatgtagcacttgcacgttaatgttgagggaggctaagcataagctggataatggtaaaacggagtctataaaccaagctttgcaacaagttggattagtttataaggggactagccaagttacccattttttatgggtgctgattaatgattatgggttagaaaggttaaagaaaaaagttaaaaaaccgcttaaaggattgaaagttgcgggatattacgggtgtcatattttacgtcctcctcacattatgaattttgaagattatgcaaatcctcattcccttgaagatttgatcagaaccttgggagctgaacccgttgattttgatgctcgtttgaaatgttgcggttttcatgcgcttttaactagtaatgctgatgcaattaaagctacagggaaaatcaatcttagtgcgattaatgctggtgcagactgcactgttactccgtgtcctctctgtcagatgcagcttgatatgtatcaaccagaagggaaacgagcagttggtgctaaaaaagagattccatctttgcattttactcaactaataggattagcccttggctttaatgcagaggagcttgggctaaatcgacatattgtaaatacttcagttgtatatgctgctcgctgaaactaatatagacgcttattgacacattaaaccgcagaatttaaatacgttctgcggtttttatccaattagctcatgattgaaatcttggtgaaaaagagaaaggggcaataataaaatgataattgaattaggatttggtaaagaaaaaaaacagctttcagttaagtcggaaaatttgttaggggttttggtacccaatcaggttgaagttgagctaaccgggaaagaggaagtaatcagagcattaaacaaccctattgattctccaaaattaagagaaattgccaaaccgggagaaaaaattgctataataaccagtgatattaccaggcctgtacccaataaaattttgttgcctctggtgcttgaggaattatggcaagcgggagtaaaagatgaagatattacaatagtatttgcccttgggagtcaccgttttcataccgaagaggaaaagataagtttggttggcgaagaaatataccataggattaagtgtatagatagcgatcaaagagattgtgtgcgtttaggctatacaaagttcggaactcctgtagatgtctttcgaccggttgcagaagccgatcgacggatatgcctgggaaatatagaatatcattattttgccggttatagtggtggagctaaggcaatcatgcccggtgtctcaagtcgggaagcgatccaggctaatcacagccgtatggtggaagtagaagctcatgcaggcaatattgccaccaacccagtgcgccaggatattgacgaagtagctaagtttgtttcctgtgactttattctcaatgtaatccttaacgaacaaaaacaaattattaaagcggtagctggccattatctttctgcccaccgaaaaggatgtgaatttttagatcaattatataaagtaaaaatcaaggaaaaagcagatatcgttattgtttctgccggaggctttcctaaagatatcaatttataccaagcgcaaaaggctctggataatgccaagcatgctgttaaaaaaggtggaataataatattggtagcagcctgttccgagggatttggtgaaaaggtttttgaagattggatgttatcggtatctaggccggaagatttaattaaccgtatcaaggaaagatttcagttagggggtcataaagctgctgcaattgctatggtattacgggaggctgagatctttctagtatcggaattaaatcctgatattgttcgccaaatttttcttaccccttttaccagtttggagcaagccttagccagagcatttgagaaaaaagggccttcagctaaagtgtatgtaattccctatgggggagcgactttgccctattttgatgcagaatgttgattaggtggtataaaacgtatatacttatgttgcgtagccaacgttcctgttttttcactttttgagaagcgaagaggaactcttgttatatcttcggttttttgtagatacgccatttaataccatttccattaatgccagtaaaagcgtctgtttgtatcaggtttaaataatgtaattcaaacagcaaaaaggaaagctcggactataacttaacttttgaggtgaaagaatgtccgaccttttaacaggtattaagaattaccagcagatgttctggcaaaatcccaataaactttcggctgatgaggctttggccaggattaattttagttttgatgatatcttcgaggctcaaaagagacttcaaagatttgcccctcttataaaaaagcttttccccgagacggaaaacgggattatcgaatcgccgttagcagaaattccccggatgaaacaggaaattgaaaagctttacggcgggaaaattcacggccgtcttttcctaaaatgcgacaactacttaaaagtagccggttctatcaaagcccggggcggtatttatgaagtgttaaagcatgccgaaaccctcttattagaaaatggactcattaccctggaggatgattactccaaaatcgctgaggagcggtttaaaaaatttttcagtaactacaaagtagcggtgggttctaccggaaatctcgggttatctattggaatcatggcagcagctttaggttttaaggtagatgtccacatgtcccatgatgctaaggagtggaagaaaaaaatcctaagagaccgcggcgtaaatgtgatcgaataccgggaggattactctaaagcggtagaagaaggccggaaaaaagcggcggcggagaagaacacctattttatcgatgatgaaaactcccgggatttgtttttgggctattctgttgcggctttacggctaaaagaccagttaacggagcttggcattgaagtaaataaagaaaaccccctttttgtctacctgccttgcggtgtaggtggggccccgggaggtatttcctttgggctaaaaaccatctttaaagacgatgtttactgttattttgtggagcccacccattcaccctgcatgcttttgggcttggttacccagaaattttccgctatccacgtaagggattttggtctcgataacattaccgaagcggacggactggcggtggggtctccttccaagctcgtagcggaaatagccaatattttaattgacgggatttataccatcgaagatgaggaactttttaagttgttagctctattaaaagacagcgaaaacattaaagttgagccatcggcagcagcctcgctaaaagggccgcttttagtcaatagcagggcaaatgcgatccatatttcctgggcaaccggaggaatatttattccggaagagatttaccgggaaatgtatatgaggggtaagagttaccttaaagatgtgtattgacaaattataaggttttatgtagaattatgcacggtttgaccgcccaaatattaatgggcgttttcttttttattaaaatttatggcagtaggaggagcagtatggaagggaaaaaacgggaaactttttcttcaagccttgcggtcttttttgcaacattgggttccgccataggccttgggaacatctggagatttccctacattaccggcatgaacggtggcggcggctttcttttaatctactttttatgtattttgtttgtgggtatacccatcatgattagtgaattttacatcggaagaaaaactcgcagtaacgctgtaggagcttttagaaagttaaaccattccaactttaaatttatagggctgatgggagttttagcagcgtttttaattatgtttttttacagctctgtagcaggatgggtttattcttatgtttttaaaagtattattggcgagtttaacaatataaccgttgaaaaatccaaagaactttttaacctaacaatttctcatcctttttatccgatcctttggcagtttgttgttcttttggttgtagccataatcttaatttttggtgtgaaaaaaggaatagaacgggttaccaaaaccttgatgccggtcttatttcttttaattttaatcattgacatccgggcattaaccttagatggtgcccgggaaggggttaactttttaattaacgtggatttttctaaaataacccgagacagtattctcatcgccttaggccttgctttctttaaattgtccataggtatgggcacgatgatcacttacggcagttactttaccagggaaaacaatatgcctgccacagcggcaaaagtggccttttccgataccctggtatcccttttagccggtttggctatctttccggtagtctttacctttaacatggagccggcagccggaccgggacttttgtttatcactattcctttggtctttactaaattacctttgggaactgttcttttaactctattctttatcctaacctcaattgcagccactacggcgatgatctccatggtagaagtgccggtagcttattttgccgaagaaaaaggtatggagagaaagaaagcggtgcttttaactaccgcaataatatttgtctttggggtatttgctactttatccctgggtggaagcccggtaataagcaactttaaattatttggtaaaaacatctttgatttatttgattatgtatcttcaaacatccttttaccccttggtggcttatttattgcaatttttgttggctattttgtaaaaaaagaagatttataccaggaactcggtaactttggcttaataaacaaccagcggattatcgatgtcttctatcttattgtaagatacgtaaccccaatcctggttattgtaatctttttaaattccctggggcttttggggtagggtagtatcgtagctaaagcggtggagagaagtttagacatttacttatatgcgttaggagtaaaagaaaactaaaccaaaaaggagaatgccctttggagggtattctcctttaattttgctttaatttaatgtgttaaagtattcctttttaaagatagcaaaatactctttgtttaagtagttttgttccctaattaaaattgtggaactggagataaggtatcatgagaaataattataattgcttggttttcttatgtaaggtaaaataaggaaaaggatatttttggtggcccgaaactcgggctagggtgtgaaattatgattaagtataaaaaaattgattttgaaaaagtaaataaagttttcccggatattgataaagtctttgccaggtatggctctaaaattgtagtagcttatgtttttggctcgtataggcggggagagattaggcctttaagcgatattgatctggcagtactgctggatagaaatctttctaagactgagcggttggaaatacaaatcgaacttttagatgatttaattgaatttcttgggacggaggagattgatttagttattttgaatgatgttcctctcagtatccagtacggggttttaaaggataaaaagattgtatattattccgataaacaaaaattagttgattttgaagcggatgtggttttaaagtacttagatattaaacctctgcgggatgaatttaaccgggagtttatcaaaagagcgggtgaatatcttggatgaaaaattattaacccagataaggtttctaaaaaagtatttaaatcttttaaaagatatggcccaaaagagtaaaaaggaatatttagaagattttatatataaaggagctgttgaaagatatctgcagctggccattgaatgctgtatcaatattggcaatagaattatttccctcgaacagtttaaatatgatttaactccgccggaaacttatgcggaagtatttgaaaagcttcaaaaaatcgggttaatagaggaaaacttaagcacaaaacttaaaacgatgactcagtttcgtaataaacttgttcatgtttactgggaaattgatgatgctgtggtttatgatattttgcagaataatttaaaggatatcgaagaatttttaaaaattgctataaagtatgttcagagtgaagggaaataaaagtaattaggattccggaactcgaaatgaaagaacgggtaaaagagaggaatattgtatacctatttcaaaccggttgacggaaatgaccgcttagtggcaaaataaaggtagcaacgatgcagtgctgcatcgagagcgatgaagccttttggaaagtgttccaaaaggctttttagcttttataggcaatgaagcctctggtgaagggtccggcgccgccctttatcaggggctaaattttttaggaggtggttttcatgaagaaaattgaagcgttaataaggccccagaaattaggggaagtgaaagaggctcttaataaattgggtatttcgggtatgacggtaacagaagtggtgggctgcgggcggcaaaaagggcagaaggaaatttaccggggtattgagtacgagattaatcttttgcccaaggtgaagattgaaattgttactgttgatgaaaaggtggaggaaattattaagataatttccgagagtgcccgaacgggtgcaattggtgatggcaagatttttattagtgaggttttagatgcggtccgaattagaaccggtgaacgggggacagcagctataacgtcaccaaaggagggagaaagatgaagaagaaatttttatccttgctttttggcctaatccttttacctaatttatctttagccggagagccagggtataacccgggagatgttacctttgtactgctttcagcggcgttggtctttttaatgactccggggcttgccctgttttatggtggaatggtacgccggaaaaatgttttaaatacggtggcgatgagttttattgcgatagtggtagtttcactgcaatggattttaataggctataccctttcttttgggaatgatgtaaaaggaattatcggagatttttcttaccttggattaaaaaacgtaatgggtcttactgtttctaaccttcccggatacgtgtttgttgttttccaattaatgtttgccatcataacagcagctattatttcaggttcggtggtagaaaggatgagctttgctgcctggatcttatttattgctctctggacgacattagtctatgacccccttgcccatatggtctggggtggtgggatgctttttaagctaccgactttagattttgctggaggaacggtggtgcatataagttcgggaatatcgggcttggtggcagcacttatattaggtaaaagaaaagaaggggaaaatgctcccttaatgccgcataatttaccgcttaccattttaggggcggggcttctctggtttggctggtttggatttaatgcgggaagtgcccttgcagccaataatctcgcagcgctggcgtttattaacaccaatacttcggcggtaatggctgctctggcctgggccttagcggagtggctccatcgccggaaggttacggttttaggtattgccaccggggcggtggctgggctggtggcggttactccggcggcaggctttgttaccccaacatcttccgtttttattggcttagtcggtggggtcctggtctatattgcggtaggcatattaaaggctaagtttaattatgacgattctttggatgcttttggctgtcacggggtaggcggtatctggggagcagttgctacgggcatttttgccactaaagcggtaaacccggcgggagctgatggagtactttacggaaattttggtcaactattaaaccagttagctggagtagggttagcgattgcattagcggtagttggaactgttataattttaaagttaatcggtattttcctacctttgcgggttaaagatgaagcggaaagcataggcttggatattacagttcatggggaagatgcttataaagatttaatttttaccgggaagtcggttccgttttcttaaaaaataagataatgggcagctcctgcgggtgaaggtaggaagcaggagctgctttttaatacaaaaataagtttttaaaatgaaacttaacaggggttaaaaatatttggggatagtttgaattagaaaggatgtgaacctcaaaaggtgtctcctaccgaaaaaatcgtacctttttttcaaccggtgttctcggtgaatacattcagcgtattgggttacgaagttttggctagaaagataacgccccagggtattgagagccttggtgcgttttttcatgacccccaggtgccaccagagaataagatcaaagttgaccgttttgttcgccgcagggcattggaactttttaagcaaagtaacaaaaatttgcggctatttttaaacatccagccccagtggctttatcctttcataagtaaagaaacaaattttcctaccctggagtaccttgatgaatacggaattagcgctgaccgggtgataattgaaataagtgaaaccgagtttagtgcggactacgaaaatctttcaaggcttattgataggtaccgtaaagctgggtgtcagatagccgttgatgatgttggtcgtggtttcaacaacctggagagaattattgccatacgtccggattttttgaaagttgatacccagttggttagaaggagtatcaaggaaaatatggctcgcaatttactggaaacactgggaagttttgcagaaaagtcgggactgggcttaatacttgaaggaattgaaagtgctgagttatttcgcttggggttagaaatcggagcctgttactaccagggtttctttattgcctgtccggcacctcatttgacagaagctaaagattccgttaatttcattaaacaagaagtcgaagattatatccgcaacgaaatccataaacggaatagccaataccagaggaacgaagaattaaataaacttatgaaaaattttaacttttctaacattaaacaaagcctcgaagaaaaaattagcaatttaatccaattcctacccgactattgttttcgggtgtatgcatgcgactgttatggctatcaaaggacaccaaactttacacgcaatttaggaggtgggtggacagtttcgggtgaataccttaatcgcaactggagctggcgtccgtacttctttcgtggagttactactgcaagccagcttggtagggggataagttctgagccctacattgaccttgaaactaagctaaaagtatggacattttgttatgacctgggggataatctttacttgtttattgactgtttaacatgacaggtttaataaaaaattaaaagcggggggaataaacccccgcttttttactcaccggctacttgctttttaccaaatttttgcacccataaatcggcgtttttaatgccaagttttatgggatcaaataccgggtcaatacctttagctctttgctctttccagtcttcaaaagcttttaaggcaggcttctggaggagtaaaatagctataagatttaaccaggccatgatgcctactccgaggtcgcccagcccccaggcaaaagtcgcggtgcggatggtgccgtagaaggtggaggctaagagggcaacccttaaaacattaatgaataagcggctgctgcctttccgggtaagataagcgatgttggattcggcgtagtagtagtatgccattaaagtagtaaaggcaaagaagaacagggcgatagctacaaaggctgctccaaaggagggaaagagcgtttctacagcccgctgggtgtagccgggaccgatatccattcccggcaggttttcgacgataaagccgccttttgggttgtaaacattgtatttaccggtaattaaaatcataaaagctgtagcggaacagacaaacaaagtatctacgtaaaccgagaaagcctgtactaaaccttgttttgccgggtgacttacttcagcagctgctgcagcgtgaggagcggtaccttgaccggcttcgttggaatagacgcttcgttttacaccccagaaaatagcataacccaagattccggcaaaagcctgtttaagaccaaaagcgctttcgaagatgagagcaaggactcccggaagtttttcaatattaacggcaattataattatagcaaccaaaatataaccaagagccatgaaaggaacaataaattctgcagctctggcaattcttttgacaccgccaaagataataaggcctaaaagtaaaacaagaccaacgccggtgattgctggagcaacaccaaaagcgttgtttatgctggcggcaatactgttagcctgaactccgggtagcagtaagcctgtggctacgatggtagctaccgagaaaataacagcgtaccatttaagtccaagacctttttcaatatagtaggaagggccaccgcggtactcgccttcgtgttcttctttgtaaatctgggcaagaactgcttcgacaaaggcagaaccagcacccaagaatgctgtgacccacatccagaaaactgcaccgggaccgcccatggcgatagcggtagctactccggcgatattaccggtacctacccgtccggctacggccatggcgaatgcctggaacgatgatacacctttttccgaactttggccgccaaagagaagtttccacatgtctttgatgtaccttacctggaaaaagcgcatccgaattgaaaaataaatacctgctaaaagacagaaatagaccagagctttgctccagaccagactgtttaagaagtccacaagctgcgccatagcttacctcctttgtttgtggtttgtaaatagtatttgtaggcagcacctaaattatcataacacatattttaataattttaaatattcaatcttatattaaaattttaataacaatacccgaatatgtcttacaaggaaaaagatgtcaaaatatttattatcaaaaaattataaaaattttacaaaaaacaagaaatataaaaatccaagaactgtataatgtatacaaccttttaaaattgtaaaaactggattaaggaacaattaaaaaactatttcacattagaatttttttttggttataattataaatagatgcttagatataataagcaaaagcttaggaggagttatgacccggcgggaggaagaaatcttaaaattaattcgggaaaatccttttatcaatcaagaagaaatagcccggatcctcgggattacccggtccagcgtgggagtgcatatcgttaatttgatgaaaaaaggtaaaattaaaggacggggttacattctttctgccgatgagccggaagttaccgttgtcggtggggccaatattgatatttatggctttccttatgaaaagcttcgcctgcaggattcaaatccggggaaagtaaaaatgaacgtgggcggggttgccaggaatatagcggaaaatctggctcggctgggggtagctacaagacttattaccgctataggagatgatttttacgggaaatacattatcgagcgctgccgggacgcaggtgtgaacatggaagaaattttaaccgtaagtggtgaaagctcttcggtttatcttgccgtaatggatgaagccggggatatggcggtggctgtagcggggatggatattttaaaccatttaagtttagattttctaaaaaagaaactttcaataataaattcatctcccgtttgcgtggtagataccaatcttccggtaaaaagtttagagtttctcttagataatgcgcgaaaaacagtatttttcttggatggggtatcggtgaccaaagctcttaaattaaaagaacttcgaggaacattttatgcggtaaaattaaataaattggaagcggaaggggtaaccggagaaaacttaaataccgaggcggggcttttaaaagcggcaaactttttcctggataaaggaatcaaacaggtttattttacccttggggcccaaggggttttttacgctaacaccaagagccggggaaaaataacattaccaccggtacagccggttaatactaccggagctggcgatgcctttacggcagcgattgtttacagttatttaaagggatatgatatagatagggctgcccgctttggggcggctgcggcaattttaactcttctggtggaagaaacggttaatcctgaaatatccgaagaaaaaattaaaaaggaaatggaggtgttgggactatgaatgaatatttggttttaagtaaggaagtaaaagaggctttggctgaaggtgtgccggtagtagccttggaatcaaccattattgctcatggtatgccgcatccgcaaaatgtagagactgctttagcggtagaaaaggttgttcgggaaaatgaggccgttccggccactattgcggttattggcgggaaaataaaggtagggttgacttgcgaggaaatagagtatcttggagaaaaggggccggaggttataaaggtaagccgccgggacctgccgtatgtggtagccaaagggttggatggggcgacaacggtagctgcaaccatgtttattgctgcgatgagcggtataaaagtttttgctaccggtggcataggtggagttcaccggggaggcgaaaaaagctttgatatttccgccgatttacaggagcttgcccggaccaatgtggcggtggtgtcggcaggagtaaagtcaattttagatattggacttaccttagaatatcttgaaacctatggagttccggtgataggttttggtaccgatgaatttcccgctttttatacgcggaaaagcggctataaggtgcatattactgctgatactccagcggagcttgcgcgcattattaaagttaagtgggatttaggtttaaagggaggcgttgtagtggccaatccgatacctgaagaatactctttggattatgaagaaattacgcgggcgatagatagtgcggttttggaagctgcagaaaaaggggtaaggggaaaagaagtaactccatatttgttggcgaaagtaaaagatataaccggcggtaaaagtttggaggctaatattcaattggttcttaataatgcccggcttgccgccaaacttgcacaagaactaagtaaactataaaatgaactccatgtccgtaactctatttcgggcatggagtttttggtttataattaggttaaaagattgggggaattggatgaaaccggagataattttcaaaccgggattttttttagtgggaatgaaatatgaaggacggaatgaaaagggagaaatttcagaattgtggaaaaagtttagcgaaagaatttttgaaattaaaaatcgggtaaatgagaaagagtgctatgggcttagtatttatagcgagaagttttttgctaccggcgagtttctttatttggcggcggtggaagtagtaaagatagaggaagtacctgaagaaatggttgcggtagaagtagatcctgccaagtatgcggtttttactttaccgggagagccggataaacttccaaagttaatccacgaaatttattgtcgctacttaaaagaagagggcttaaagccggttggtaattatgattttgaactttataatgaacggtaccccccgaatcaaaaagattctaaaatatacttttttgtgccggtagaataaggtaaaggttggggggctatgatgaaaagaaaaattattgacggtcatgttcacttactgccggataaactcatgcgggcaatttaccggtggtttgaggaaaatttaagctgggatatgccgtttaagtatgatttagagggctatcttaattatttggagtctctggggatttctgaaatgatggttttggggtatgttcataaaccggagatgagctggggattgaacgaatggttaaataatgttaaagaaaagtacccgcaggtgaagccttacttagcggtacatcaagacgatcgggataaggggaaaatggtgcgggaatttttgggaaagggttttttgggagcaaaaattcactgttttgtgcaaaaagttggagccgatgacctgagattctttgaagtttataggattttagttgaagaaggaaaaggtttggttcttcatggaagcggtatgccggtaaaagcggagtttatatttccggagcaggtagagaaactcctggaaacttttccgggaatgaaaattatggttgctcatcttggattaccggattatttaaatgagtacttgagattggtagataagtatcaaaacctctggctcgatacggcctatgttctgggaaatcctaaatttaataataagtacttacgaagtgttcttttaaattatacggaaaggataatttttggaagcgactttccgataatggattattcacctgaattggctttggaagagcttttttcttttaacctggggcgggagaaggaagatttaatcttgtttagaaatgccgaggagtttatgggcaggggttaaaagtctggatttaagtatcttttcctggcaaattaaggtataataaagaaaaacgaggtgttacgatgataccttttcgggatgaaatagaaaaagcggtgaaaaaaatagttttattgtgttctcctgaagaggtctacctttttggttcctgtgctcgaggagtagcgactttaagaagtgatattgatttatgcgtaatagtgaatacaaatgataaaaggaaactcttgcaagaaatttattttaatatggacgtggagcgagaggtggatattgtaatttacactccggaggaatggttaagatttaaagacaatcctgctacattaccctatataattgcccataagggggttaaaatttatggtagacaccaagaattatcaggaatggttttaaaaaggcagaaagtgattttaaaggagcaaggattttatttgaacatgatgctgattttgggcttgtatgttttcactgtcagcaagctgtagaaaaatacctaaaggggtttttaatttataaaactggaatattgtatgaaggtcataatctcgtaaagctttgccaaaaagcagcgaacttattatgttgaaacacgatatccggcagaagatccattgattattactttagaagaagttgaagaatgtttgaatatcgttgaaagaataaaaggttttattttagaaattcttaaccaagagggtgaaaaaggtgtttaaaaaaattttagttgggattgacggttcagctaaaggggataaggctttggagatggcaattgggcttgccaaagaaagtggggctgaaattcatcttgtccatgtaaccccctggccgattttgcccaatgtttttccgcctggggcgattgcctacgtgccggaatcggtgatccaggagcttaccgatgagcttaaagctaaagcagaaaaaacccttagagaaaggcttttaagagtcgaagaggctggagttagcggaaaaattaaggtgttagagggagaaccggccagcgctattgtaaattatgcccaggaagaaggggtggagttaattgtagtgggcaatcgggggatttctggggtaaaggaattgctcttaggaagtgtcagccacaaagtatcgcagcttgcccgttgcccggtgttaattgtaaagtaagataaggcgttgaataatggagttggattaatggctgaagactgttacaaacttaactgaaatattacttttttaagggcatcgatgtctcgcactaaaatgcttcttttgtacactgtaatgatttgctgggcttcaaattctttcaataaagtagtcagcgtttgtctggtagctccaattagataggcaagttcttccctggtcaaaccggtatgcaccagaatgccatcatgctgatgaatgcctcggctaaacgtccactgatataaaaggtttgccaggcggattttggcttccatgaataccagttgttcgattacgtctaaagaatgctttaacgcatctcccagcacccgaatcaaaccatacattaaattaggataccttgccagcattttccgaaaggcatctaacggcatcagcaacataaccgaatcttcaagagcctgaccaaaggcacgggtatgtccgctaaaaatatctcctggatccagtattgttaggataaactccttaccgtcgggataagtgagaaagaccttgattcggcctttggtaacgagaaaaatatcgttgggatagattcccggggaaaaggctatttctttttttctttaggtaaatctctttaaaactggggataaactccttaagctggtctaaagataactcaccgagcagtttattattggttattaaaccaaaactgcgcattaaaatcgccccctgcagccattataccactgagtttgacttccgaagaattccctgtttggctgggcaaaaaaatccctccttcgcggagggatataacaatgttatggaccaaagccatttttaaaatttctaccatggtaatcccaggccggcccggcgttcgttgattgctgcaaggagcttatcggccgctgtttcgggatcaagttcgacaataaagtagcctccggttatatctttgacgctgctcgtaaggatttgggtcaccggtaaactgcctgtaatgggcggtaaaacaccgatatgagttggtaagccaatggttacggcccaggtgccgatggcaacagccttttcatgcatggcttcggcagcagaagctacaaccggaagtcggtccagatctacccccagccgattggctaaagctgctactaaagctactgcccgggagttgtccacacaggaacccatatggaggaccggtggcagagggccacctaaaccgttagcttccccaatggcagtcagcactgctttaagaccgtcgccacacagctcgtctacattggctgggtccataaagccgtgacgcatcagggcaccggcaccgcagccggtggctactacgagaacattttgctttagtagtttgcgggcaattgtggtgaaattttgatcctggggaactttgacgttgttacaaccggcaaagagacaaactccccggatattaccgttaactacattatcaattaacggtttcaacggatcattggcgtttagtttgctgagagcattgatgatggcttccgtagaaaaccctgcaactaccttagtttttatattggggatttcgaccggtttacctttgcgccgtttgaaagtatcgatggccaggcgaaggatttgcttggcattttcaacggccgcttcttcggcaaaattcacgtgtgtcgccccggtaatttttgacatttccatagtggtgataacggtagttccggtacattcggctatggtagctacggaaggttgaatacattgatagtcaagaatcatggcatccagggcgccggtgatcatggccatttcctggcttaccgagtgagtacaggcggggatgccatgacgcatcaaaacctcgttgcccgtacaacaaatacctaccacgttaataccggtagcgccggctgcgcgcgcttcgttttccatttctttgcttaccgaaacgatgatgtcggacaggaccgggttatgcccatgaacggccacattgaccgcatcggctttgagcactccaagattgctctcggtaactaccggcgcgggggtaccaaagagaatgtcggctaaatcggtacccatataacaaccggctaaatcggccagggaacagcgtagaccacccagtaataaattttgagcatcggcatcacaacccatggaagtacgatgcataatttcagctatttcgtggtcgataccggcgggaatcagaccgtgggccgacaaaaccttgacgcggctgggaggcaataccgtagttacccacaggaccggggtatctttttcgtgaaaatcagccagagcggcttttgctacctctaaagcgatatcttcatccttttgtccctcggtgggaataccaaggcgtttggcaatggagtgcaacttggtccggtctttaatcatataacttgctgctttgccttgaacagcttttttcaaagtatgagccaggtgtttcgcgtgcccggaatgtcctgctgctccggcagcaatggaccgatctaatccccgggctactatcacctcggcggttgccccgcaaataccaactttgggttcatcaccaaagggattgatgcgacaggggccctgcaggcagtggcggcagcataaaccagtttcaccaaagccacactgaggtttcatagcctcataccgatcccataccgtttggataccttcgcgttttgccttatccagcatttgctggacggcacggtcggtagactttaaattttgcttagccattaaatcttcaccccttttttattggacttcctttaccgttagagcaccaactggacaggaggtaacgcagaccggaaagtcggaaacatctttgcataaatcgcattttacacagcggtcaatcaccctgatagcatgaaacgggcaggctttttcacaaagcccacagccggtgcatttttcttccgaacaaacaactctcccttcttcatcataaaaaagcgctccttgaggatatgcttcaatgcatttcgctcttttgcaatgcttgcattgttctatggtaattcctccggttttgtcgccggtggtataaacaatttgtagtcttggtctaataccctctaatattgcggaaattagtgatttttccgaagaatggatgattgaacagctaacttcacagctatgacaggctacacaaaggtttttattaaaaattactttgttcattttcccttcctccctgagtgggctcaccggcctctgtaattcgattaaattgacaatattgcgggataaattttacttttctgaataattcgcgaatgccaatattcccatgccacactcataatacctaccccttgtccttacgattttgattacttttagtatacttgagaaaaattcttaattccgtaaagtactttacattttttatttaatttacactggtccttaaacttttgcggttttcgaaaccgtttttttttgtaaaaaagcatgttaagtttttagttctttggttaatttagaaaattttaagaaatgattaagacgtaatttagaaaaagaagttagaataaaactaaaatatttgaaatggagggtgaattatgaaaaagggtgtaaagattgcgttagtgctggtggttttagcggtggctgttgtaggatatttttcttatcgagcagcgatcggtagaaaaaaccttcagcttgatgttaaaaccgccaaagttacagtgggggatgtggaagcgtatctttcggtttcagcaacaatcgaatcccaaaagaaaaaagattactatgctcctcaagctaaggtaaaaagggtttatgttaaagttggagatagggttaaaaaaggtgatgttttagttacctttgaaacccaggattacagttctcaaatcgaacaggcccaaattcagtatgaaaatgcagtgctacagcgggatgagctttatgctcagaaaaaggatattgaagataaaataaaagaacttgatgctcagataagtagtttagaaaaaagcaataatcaagatgcggcaaaacttgaaagcttaaaacaacagcgggataatatccagccggtatccatcgctcggattaagcaagcggaaaactcggtaaagcttgcaaaacttaccttagataatgccaaaaaagcagcagctcaggcccaggacaagataaccgccgacttctccggggtggttaccgcggtgaacgtggtggaaggagctatggctaactcaatgcagccggcggtgaccgttatggatctttctaatttaaaggcggtagcaaagcttggccggtttgatgcagctaaagtttctttaggccaaaaagtaattttacgtaatggcaaaaagagttacaaaggcgaggttagctttattgagccggtagccagcaccacaatgactgcctcagggcaggaaagcactgttggggtagaaattaaaattttagataaaaaccctgatttaaaggttggttttgatgtggatgctgatatcttaataggaagcaaaaccggggtggtaaaggtgccggtggaagcaatacgccaggaaaaagataaaacatcggtatttgtagtcgaacaggggaaagcaaagcaaaaggaagtacaaacgggtctctggtcggatgatgaagttgaaattacttccgggttaacagcgggggaaacggtgattttaaacccgggattaaaagttactgatggtgctccggtcaggcttccttttgccggcggactagggaggcggatgcagtgattgaactaatagatgtggttaaagagtacgaggtagggaaagagcgctttcgggctttaaaaaatattagtttaaagataaaagccggagagtttacttcgattatgggcccatcggggtccggtaaatcaacattgatgaatattttagggcttcttgatagggcgacaattggtagctactatttagacggtcgtgatgtgtctaagctttccgataaagagcgggcttttatcagaaaccgggagattggctttgtttttcaggcgtttaatttaattccccgcatgacggttttagacaatgttatgctgccgatggtttatgcccgcatccccggaaaaatgcggcgggaaaaagccttggaggctttagccaaagtaggtcttctacatcgtattaaacactatcccaatgaaatttccggtggggaaaagcagcgggtcgcaattgcccgggctatagttaatacccctaaagtaattttagcggacgagccgaccgggaacttagactccaagtcttcagaggaaattatgaaaatttttcagaagttaaatgatgaaggggtaacgatagtggtagttacccatgagccggatatcgcccagcatactaagaggataatacgttttcgtgatggccaaataatatccgacgaaccggtggtaaaccggattgtattataggggggctactatgatttatgaaagcctgaaaatggcgttggaaagtattttagccaataaacttcgcacttttcttactatgcttgggattattattggtataagctcggttattgctattgtttccctggggcagggcgggcaaaatgctattaccggagagttcgaaaaaatcggggtagcaagtgttaacattaaagttgatagttctaaagccagtgccggtgactattttactttggatgacgtggaaaaaatcaaagaaaaagtagaaacggttaaatatgcggctattgaggttcagaaacaaggggtggcaataactgaccagaaaaacaagcgggctgtaatttttggaggaacgctggattcgttttatactgataacgtggaaatcctttacggaaggttttttaacgaacgggaatttaacgaaggaatggcagtagcaataattgacagaaatgccgccaaggctctttttggctatgaagatgcggtaggcaacactttaaaaattggtcccgctactaaccctaaaaaggtcacaattattggagtttccaagggcttcaccgggccttttggcggcggcgacaacatgccggtttttgtaacggtgccggtaaccttttttcaggggctgttttccggcgaggtagtctttgatagtatgactattatggctacttccaaggatgctgtcgaggatgccggaaatgcggctattcgccttttagaggcccggcacaacaatgggggtaacgaaatttatacggcgcaaaatgtgatgcagcagttagaacagataaataatgttttaggcatctttacggcatttatcggagcggtagcggctatttccctcttggttggcggtattggggttatgaatatcatgctggtgtcggttaccgaaaggacgcgagaaatagggataagaaaagccataggtgcgactaccaccgatattttaatccagtttttaatggaatcaatcattatttcgttgattggtggcttaattggcatgtttgtcggcattgtgggggcaaatattgtgggaagtatgataggagtagtaccggctttgtcgctaacggcggttttaggagcaattgttttttcttcggcggtgggaatcttctttgggatatatccggcaagaaaagcagctaagttagatccgattgaatccttaaggtatgagtaaaggaggtgcggccggtgtctttaaagtttcggcttattctgtcttacttggcaatgttagtgatacctattttattatcggcggtagccagctttttagtgggtttaatttatattggagacgccggccaggcttttaatcttccccatgggcctaaagcctttcgggaagtttttcgcgagcgccaggagacaattaatgaagttaaaataaatatcttaaaacagccggaaaaggctttaagtaaaagtttctgggccgctgaggagaaaaaactggtaaatcaccaaacttatcttgtggttaaaaaaggaaaggatttaatttatgcgtcagagcttatgcgggaacaaaagcttttagagaaattacctgcctttgggaatcctgaagaagaaggggcaataaaggcgccggatgggaaacgttatttattaaaacaggttgatttttactttagtgataagactccgggaagtatttattttattaccgatgtcgaaaatgtccgtaaaatcttgactcgctttagcattaccatgctggtagtttttcttttaattctggtagctacaaacggtactttaacttttcttgtttcccgcagtattttaaaacctctttcccagcttaaacaggcttcggagcagataaaaaatggcaatcttgattttacggttaaaaacagtgccaaagatgagattggagagctttttgttgcttttgaggagatgcgaaaaaggcttaaggagtccgaagaattaaaaaaacaatacgaagaaaatcgcaaggaactaatagccaacatttcccacgatttaaaaacaccgattactgcgataaaaggttatgtagaagggatccgggatggggtggcggacagtccggaaaagttatcccggtatgttgataccatttaccgtaaaattttagaagtggatggacttatcgatgagctgtttcttttttccaagctggatttaaaaaagctaccttttaattttgaaaaagttaatttaaaccgttacttaagcgatgtggccgaggagttggagtttgatttaagaaagaaggggattgagcttaaacttcatctgccttgccagcaagtttttgtttgggctgaccgcgaaaaactaaagcgagttatcaacaacattgtggataattccgttaaatttatggataaagaaaattcgcaagtggttattaatgttaaagatgaggaaaagagggttattatagaaatagctgataatggccggggaataccgcttgacgcaataccgaaaatttttgagcgtttttaccgggtagattcagcccgtacaggaacttccggctcggggctgggactctcaattgctgctaagattattgaagagcacggtggggaaatttgggccaatagtgttttaaatgagggaaccacgataagttttaccttgaaaaaactgggggaaggcgcatgaaaaaggtgcttattatcgaagatgaccggagtattgcggaacttgagcgagattatttggaagtggcggggtttttggtggagattgcagttaatggtgatcagggcttaaaaaaagctttagaagaagagtatgatttaatcttactggatttaatgcttccgggaattgatggctttgaggtgctgcgcaaagtgcgggcagaaaaagatacaccggtgcttttagtgtcagcccggcgggaagatatcgataagatccgggggttgggactgggagcggatgattatatcacaaagccttttagtcccagtgaactggtagcccgggtaaaggctcatataggccgttacgagcggttaaccggcgggcgaaaaaatcaagaccttttggaatttccgggtttagtgattgataccgctgcccgccgggtttttgcaggagataaagaagtaaatttaaccgggaaagaatttgatttacttttatttttagctaaaaaccccaacagggtatttaccaaagaagaactttttgagcggatttggggtatggactccctgggcgatttatctacagttactgtgcatattcgaaaacttcgggaaaaaatcgaaaaagatccctctaacccccagtatattgaaaccatctggggtgtaggctaccggtttagtggtctgtggccaattagagattagaggttggaaaatggaggttagagggaaattttcatgttgactggttacttcgattgttgtcttttaaccggccggcctttttggcggcttctcgaagtaaatattctatatgggagtttaccgagcgaaactcgtccgctgcccatttttctaagatttcatataaagctgggtctattcttaagggaaaatttttctttctggccataccgtattagtaaatcgttccggtgttgattacgggctgggcagagcggtccgagacgatcgcaaccattaaattattaatcatttgcgcctttctttcttcgtctaaggagatattggcgtctttttctaaccgttcaattgccatctgcaccatgcttaccgctccttcaacgattttctgccgggcggccaagatagctgaaacttgctggcgttgaagcatcgcctgggcaatttcggtggcataggcaagatgggtaagccttgcttctaatacttcgaccccggcaacttgaagcctttcctgaagttcgctggccagctctttagcgaccacatcggaattcccccgcaacgaagttccttcttctacaaaattgtcataggggtatttagaagccacgtgtcttaatgccgtttcactttggatttccacaaatttttcgtagtcttccacgtcaaaaactgctttggcggtgtcaattactttaaatactacgactgctgcgatttccaccgggtttccatcaacatcatttaccttcagtttggcgctgttaaagtttcgcacccgaagggagacttttttgcggctggaaaaagggagagttaagaagaaaccgctttctcggatagtacctttgtaatcgccaaagaaaacaacaacggctcccatattgggctgaacgatggtaagaccggaggctaaagtgatgcctaaaagtaaggacactgctgctaaataccaaccccagggtaaaaaactaaaattaatactaaagcttaaaaaggggcgaatataggaagcttccataacggtattaacaaaaacaataactgccaggaggaaaaaaactaaggttaataagagccccagatagccgtttgtcttccaaactcttttttcctgcatgctattcctccttcgatataatatttatatcaaaattatatcacttttgggtaaaaatgtaaagaacgaaagcgtcatctttcgcccctgcataggtcttggatgcaaggcaacgggagttgccttaatggtggtaagtggtaagtcgtaggtggtaggtaaaagaattaatacaggccactcaccacctactactgaccactgttttcctagataagggttgactccggtcgacaaaaattatttcgcgcacaggagtgtgccctacatttttttaaggtagcaggagttgccttaatggtggtgagtggtaagtcgtaaatggtagggaaaatatttaatacagaccacctaccacccaccacctaccactatttacagccgccctttttccagagcgatgcagtacatttgctcttttttgttgagaggaacgctgggggtggagtctcgcttgattaaagttaatgcctcttttttgcagaaggtaacgcaaacaccgcagccaatgcagcggtttttgtttacgtgggcttttttgctttttggattgcccggttcggtttctattagcgagagagcgttaatttgacattttttaacgcagttgccgcaaccactgcatttttctgggaaaatttttaaaataaagctggaaggttcaatggagggaacgttgtgttcgttaattgcccgtatgactccgcagcaacaaccacagcaattgcaaatataggccggtttgttctggacgttgtcaaccgaatggacaaggccgaattttttggctttttcaagcacctgcaggagctcttcttcgctggctttacgggcaaacccccttcgaattaaccattcggcagcactgcctaaagaaatgcagacatctgcaacaggagcaccaactttgcattttttaccgagatgctcctgctggtggcggcagtagcagtaggttagagctccaccgccggaagatttgacaatttctactgctcgctcataggggacgatttcggttttaacttccggagagatagcttcctcgtagggaagagctcgaaacatttttgtggggcttccaaaaaattcttccggcacgccgggctcgtggtggtaagcttcaaaaagctcggccaggtcttttaagggaagattggagtctacccgcataaaggtgtattcaaaaaagcctacaaccgtcggggtgagcatgtagtaggtttcaccgttacgcaggacgtcaataacaagacctttactggccatgttttctaaatgagctgctaactcctcgctactcaggccggtggcggctaaaagctggtcaaaagttacaaaaccgccgggaaaacggctgccgacagctgcttcttcttcggtatagaggatttttaaaattttcattaaagtttcggaatacggtgctcctaccggatttttatgaagcctttcggctaaagccttaaacacttcttctttggaaaaaccaagatgtcccacctttctgcctcctttagattacgcaaaattatgaatatttacactattatattcgctttaaaataatgaatacctttttaatttaaaatttttggggaccagcaactaaaagttgtgctaaataaaaaacttccacaaaaaagaaaattgaaaccagtaaagaagggtttaacataataatagaaactgctttggcttttttggcaaaatattacgggggtagaagataatgaaacctcaatacctcttacttttaaagaccggtgaacttagggagagagttgtaaagttagaggatgtattaaaaaaatgcactctttgtcctcataactgtcaagtaaatcgaagccgtggggaaaggggattttgcggtggaggttatttgccggtggtggcaagctatggaccgcattttggggaggaaagggttttagtgggggaacatggttccggcacaatcttttttagccactgtactttaaaatgtgttttttgccagaactgtgagataagtcagtacggcgaaggggaggaagttacgccccaagatttagccaagataatgcttatcttacaaaggagaggatgccacaatatcaatttagtttcccctacccattatgtaccggcaattgtaaaagccgtccttatagcagcagaagaagggttaaaaattcctcttgtttataacaccagtggttatgaaaatgttgagactttacggttgttagaaggtatagttgatatttacatgccggatattaaatttggagatgatgaaatcggaaaaaaatatgccaaggctccgggctattttgcaattaccaaaaaggcggttttagaaatggaccgtcaggtaggaggactcaaatttgatgaaaaaggagtagcctgtagaggagttttaattcgccatctaattttaccggaaaatttagctaaaaccgataaagttctggaatttatttctaaggagttatcttcggacgtggcggtaaaccttatggaccagtactggccggctcataaggcttacagttttagtgaactttcccggagaattaccagggaagaatataatatctggcttaagtatgccaaaaagctaaaaattaacctgatagtttaaaatttaggggcttttagcggggctggtttactggttcgtatatttgtataaacgaagcaaatgtaatataattaactggtagttttcttgaggggagaggggattttgcaggtagcgacatctttaaaaaaaagctttaaagtttatagcggccttcccaagagcatatatgttttgtttgttgcaaatattgttaataatatgggtaattttgtctggccttttttaacgatcctttttaccaggaaactcgggctgggagcggaaaaggcaggattaattgtaaccatagcaattttattccagctccccggggcttttgttgccggaaaggttgccgataaggtggggcgcaaaaaagtcctggtattttatcaaagcgctgcgggttttttatttattccggcggcttttatgctcgatccctacgcgatagctacaattgttgttatttccgggtttttctggggtggggtgcagccggtaagtagagctttaattaccgaccttacccagggagaacagaggattcgggctttctctttgacataccttggagttaacattggttttgctttgggcccccttttggcggggtttctttatgcctacgggataaaggttatctttctgggaaatgccttctcttgcctggcttcttcgatgttatcggcattttttgtgaaggaaccggccactccttctgagggtaaaaatagttttgaagcgccagtagagggtggactaatcgatgtattaaagcttagaccttctctgtttttcttttcactaatctggtttatttattcttttgtttatgttcaatctacttttgggatgtctttaacggtgacggatttatttggagagttaaccggggctaaggtgttaggaagtttaatgacggcaaatgggctgggagtagtgcttttaaccggacctttaacgaaaatctttgagcaccgggagcctttaacggcaatttatatttccggaattctttatgctgtcggttttggcatgcttgcctttgtcaaaagctatcttttcctattaatttcggcttttatctggacggccggggaagtggcgggagcggttacggtaaatgtttatatttccgaccgtactccggttacccatcggggaagggtaaatgcttttttacatatcatgtcccgggcgggtttttcagcggggcctgtagtaatgggagcggtagcttcgttatatggtttaaaacttttatggcttctttccggagtactggctttagcaggggcgatagcggtcttatacttacggcaactggagggggctttgtgaaactaagcttaattgctactgcagcttttggtttggagtcggtggtagcgttagaattaaaaaatcttgggattaacgatgtcatggtggaaaatgggaaggtgcagtttttcggggattattctactattgcccggaccaatctctggcttagaactgctgacagggttttaataaaagtaggggagttttatgctgaaagctttgaggagctttttgaaaaaaccaaagcattaccctgggaggagtttttaccgaaaaacgctaattttccggtaaccggtaaagctgtcaggtctaagcttatgagcgtttccgactgtcaggcaattgtaaaaaaagccattgtggagagattaaagggtaagtaccgtcttaactggtttccggaggatgggccggagtttaagatcgaagtttcgcttttaaaagacctggctaccctgaccattgacaccagcggtgctggtttacataaacggggttaccgaaaattaaccggccgggcacctttgcgggaaactctggcggcagctctggtaattctttcccgctggcgggaagacagagctttttctgaccctttttgcggctccggcaccataccggtggaagcggctttaattgggctaaatattgcaccgggaataaaccgggagtttgcttttatgaaatggccctggtttcctaaaaaagaattagagcgtgcccgggaggaggcaaggagcaaacggcgtaatctaaagcttttaatttacggcagcgatatatccgaagatgaattaagttatgcccgctatcacgctaaagcggcaggggtagaaaaaagtatccggttttttaaaaaagatttccgggaagttaaattcacggaagagtacggctggttaatttctaatttaccctacggggagagaattggggatgtgcgggaagtggagaaactgtaccgggaattaaaaatcttaagggagaaacttcccacctggtctttttattttttaaccagtcatccggcttttgaaaaactttatggcagaaaagcggataaacggcgtaagctttataacgggaagattgaaacccagttttatcagttctttgggcccaaaccaccaaaaattatactttaaattataataatttagggtataattattatgaggtggttttatgaaatttgttaaccgggacgaagagctttcctttttaaaaaaagaatattaccgtcagggttcttccctggtggtgatttacgggcgccgcagagtggggaagacaactcttataaaagaatttataaaagataaacctgctctttattttttagcaaccgaggaatcagaagatgaaaacaggaaagctttaattaaattacttggtcaatttttaaataatgagcttattttaaaaagtgatttgagctgggaagagatatttaaattttttgtaaaagatgatgaaaaaagagttttggtcattgatgagtttcaatatttaggcgtggccaatagggcttttccatcgattttgcaaaagatctgggataattttttaaaagaaaaaaatattatgcttattttatgtggttctttaattagtttaatggaatcccaaaccctttcttatagtagtcctctttatggtagaagaacgggacaaattaaattacaatcaattgactttttacacatgtccgaattttttcccgggaaaaactgggaagaagttttagaaatatatgcagttaccggcggcactcctaaatatattgaagtttttcaggaagaaaaagatatttatcaggctattgctaaaaatattttaagtaaaaatagttttttatatgaagaaccagtattcttactggaaaaggaattaagagatattggtagctacttttctatagcaaaaagcattgctgccggaaatcacaagttaggggcgttagctactgcgttaggaatttcgcagaccggtcttacgaaatacttaaaaactttaattgaattagatattttagaaagaattactcctattaccgaagataatcccgaaaagagtaaaaaagggttatattttttaaaagataattttttggacttttggtttaaatttgtttatccttataaaagttttcttgagattaacgaaaaagaatttgttttaaggaaaatccgggaaagttttattgaaaagcatctaagctttgtatttgaaaaagtttgccaggaactcctcaggtatttagtgaaaaggggagacttaaacacagaatatacaaaaatagggaaatggtgggatagacaaaccgaaattgatgtagttgggcttaataaggattcgggagaaattatctttggtgaatgcaaataccagaaccgtaaagttggttatgaagtttatagcaatttaattgcaaaagcgcaaaaagtacagtggaataaaggaaagcgaaaagagagttttataattttcagtaaagaagggttttcttctgaacttattgaagcggctaaaaaaaataagaatttatatttatttgattttaaaaatttttcgttagtttaaaaagggctaccgaaaaaagtagccttttttctaaagaggttcgctgttttcaatatccttcatatatgttattattgataaaaaatcttgggggagcggggaatgagtcagtactaccggggggttttacttacttttttatcggcggcgggttttggtttacttccgatttttgcggtgtttgcgtataaggagggagcttcgccctatacgctgcttttttggcggtttttcttggcggggcttatttttcaggtttataactattatgttcataagggttttggcattaccaaaaaagagattttatatgttttggcgatggggattttatatacaatacagtcttcctgcttttttctttcggttaaatacatttcagcatcgctgacatcgttaatcttttatacttacccggcgctggtggcgattttatcaagcatagtctataaagaccggctggggtttaaaggatttgttgcggtagccttagcctttgccggtctaattttggttttggggaatataagcggcaaattaaatccaactggggtactttttgctctggctacggcgttagtttattcggtttatataacgctggggaaaaaggttttaacacaaattccctctctaaccgccagcagttttattgcagtttttgcggcgatgtgttttctggtggtcggtttattaagcggcactcttgattttctgcccccggaaaaagtgtggttttctatttccggaattgtggtattttctacccttcttgcaatgtttaccttttttcggggaattgagcttttgggaccggcccgtgcttcgattattagcatgtttgaaccggtggtaacggttatttttgcggccctgttatttgcggaaaaattgacccccgggcaaattgccggaggcgcgctggtgcttctcggagcatacttggtagccaaagtagaaaattagggacagtccccttttttatacttaaagtatagttttagggactgtccctaaaattattacttcccggaggggggaggggtaaagacccgttgagccagttcggcatctaaagtgtaaatggcatgctggtcattttgaatccgggagagtttctttacgagattaccaaatgtttcttcttcctccatttgctcatcgataaaccattttaaaaagcttatcgtggcgtgctctttttcttccagggcgatatcgcttaaagcataaatgcgtttggtgacaagttgctcgtgttcataagctttggtgaacacgtccaagatagaagcgtactcgttttggggttgatcgataccggaaataaatatccttcctccccgttgatttatgtagtcaaaaaatttcatggcgtggaaggtttcttcctggacctggacccgaaagaaattggcaaagccgtctaacccctggtcgtggcagtaagcggccatggcaagataaagatgagctgaataaaactcccatttaagctgttcgtttaaagcggctaaaagcttttggctaagcatagacatacctccctggtggaaattacttaattaagtataacattaattaagggtagatatgaagccgtttattaagggctaagagtaaatttttttttcctaaaaagatataaacaggcggctactgtttcctgatcatataatttgccggcaccggcttcaatttcttttagcgcggctttaatgcctaaagatgggcggtagggacgatgagcgctcatagcttcgacaacatcggcaacagctataattttggcctcaaggtaaatttcatcccctttaaggccgttgggataaccgctaccatcaatacgttcgtgatgttgtagtacaaattcgctaatggggtagtcgaaatcaacatcatttaataggttgtaaccggtaagggggtgagttttaattagttcaaattcgggttttaaaagtttacccggtttatttaaaatttcaattggtattccaatttttccgacatcatggagaaggcttgctatgtagatactttttaataccggtggagggcatccaagctcctgggcaatggctaccgcaattcgtgctacgttttcctgatggccggaagtataaggatctcgtatctcgagaatttttgaaacaagttttacactttgaagatttttagcttcattgattaaattagtaagcttaaatgttttgacttctgactgcaggagtttaaaataaaaaaggcggaaatcaaaactttgattgcaatcaatatctactttgacaattaagtttttcgaagtctgtaaaattactcctttttttggagttagagaatgcttggtggctttaagtgttggaaacatgcgaaaaatattaaaatttgcaaaatctattttttcttgttgaaacaattggtaaaactgctggtttgctgcaattaaatttccttcccagtcggttaataataaggcgcgacttgatgcatgaaaacttttttcaaagatattggcttttcgggccaagcaattctccctcctcaaaaacaaaaaacctcctgcccaaggaggtttttagttcatccttcggcagctggctggcatggcgaaaattcgctttagcccctgtagctttgcgtcaccggctttcgccggttttgcctttatcgacaaaaatatttaattttcaacaaaaatattacaaaaaaatgacaattttgtaaagatagaagttgaaaaaatgttaaatatttgtctactcaaattaaaaagaaatatggtattttttaaaccagtaatttagttgaattaaatacgccataatctgggtatcgcccattaactggccaaaccaggggcgggcgtttgggggagagggattggtgattagttttcggacctcgttttcatctatcaggaagttaatcggggaagagttttcggccaagatttgcgttagtgcttctcttaccagtttggtataaagcggatgatgagttttgggataaggagattttttacgcttgaggatgtagtccggaataagatccgctactgcctgccgtagtaaacctttttcctggcctccagcggttttaaagtgccagggaacattccacaaatattccaccagccggtggtcgcaatacggcacccgtacttccagaccccaggccatggtcatccggtctttgcggtccagtaatataggcatccagcgggtgagggtaaggtaagttatttcccgaagccttttttcttccggggataatcccgaaatttcaggaatttcttctaaagcttcgtgatagcgtttctggacatattcatcgggctttaattcggcaattaaatcttgtctaaaaagggtttttcggcggtccaagcttagagcccaggggaaagtcttggcttcaagggcttcttttctaaaaaaccagggatagccgccgaaaatttcgtcggcacattctcccgataagcccacggtggcttctttttttatttcccggctaaaaagccacagggatgaatcaatatcgaccataccgggaaggtcgcgagcgattaaagccggaaatagcgcttcaaaaagttcttcttgagttaacacgatattacgatgaagggtgttaaactctttggcaaccaaagggataaacatagcatcgcaattgggctgaaaggcgctttcggtaaaatacagttcgttttccgcataatccaccgaaaaggtgtttagagtttcgccccggctatgaaggtggctggcggcaaaagcagtaattaccgtcgagtcaagacccccggataaaagggtgcaaatgggtacatcggaaaccaactggcgaataaccgcgtcttctaaaagttcccgggtttttttcaccgtagtggggaaatcatcgggatggggattagaagtaagtcgccagtagggttttataaataaaccttccgggttaaatacggcataatcgccgggaagtagttcggaaatatgcgcaaaaactcccattcccggggtgcgggcgggacccaaaaacaatacttcttttaagccatcggtggaaagcctggaagggatgtccggatgaagaagaagggttttaatttcagaagcaaaaatcaaggtatcatttaccagagcataaaaaaggggctttactccgagccggtcccgggctaaaaaaagctggttttctttttcatcgaaaatggcaaaggcaaagataccgtttaatttagaaagacattctttgccccattcaatgtaggaaaccagtaaaacttcggtatcacaggtggtgtaaaaatggtgtccccgagcttctaactcatcccgaagctctttggtattatagagctcaccgttgtaaacgataacgtactgccaatccccgaaggtgcgaatcatcggttgccgcccccgctccggatcgatgaccgccagtcgccggtgtccaagaatgatattttccgaatgccaaatacctaaagcgtctggaccgcggtgggtaagggattgggtcattttttctaatagaggaacaaaaggtgataaatccttagaaaaacttatcatacctgcaattccacacatgttaatcctctcctatggccctactttttagcagtctcttttatgatatgccgcagaagaggaaagggttcgctggaaatttaacttaaacaaatttgtaacattttctccgagattttgcaaacattttgggttaaactaaaatcgaaaacaaaaaaaggggtgattttaatgaagagaaaactgataattgggcttgtagtactgctgttggtagcttttacagtaccggccatggccgccttaaccgttgaccagaaaaatgagttgatcgacctctacaaacaacaggcggaaattatgaagaaaataattgacgtacgggtaaaagccgggcttattaccaaagaacagggagattttatgaagcaacgaattgatgcaatgctccagtacagaatacaaaatcctgatgcttttggtcccggttgcggcggttttggcagaggaggtttttggggcagatggaatcagcaagtaccgaacagtaacaatgctgtaccccagggtttttatggaccccggggtgggatgatgggcggatattctaacttataagtaccttcctcaatgcaccttcctccttttatatagattttagccggcgttttgccggctattactcttttttggggaaaatgttttaggtgatttatttttgaccttttttgatgtataattaatactggtggtgtcgatgttaaaggccctgcgctttttactgatatttttggcaataatattagcagcttttgtcgggagcggcgatgtagaagagcttattttaagagatgtgtctttgtttttggggacaaagataataattaaaattaaccataagtcaaaaaggatagagaacaaaaaagaagagaataaaacaaaacttattattgataacctgcaggattttttaaatataaataaactccagcattttactacttcccgttggtatcaaacgtcttattttgatggatttggcgtagcttaaaaggattaacaaatttaagggggaagagaagaatgaccaatacgataaaaacctggcttttaatgggtgtgttaacagttttgctggttttacttggcagagttattggtgggacgaccggagcatttacgtttttcctgatagctctggccatgaactttattagctattacttcagcgataccctggtaataaaaatgaccggttcttatccggtaagtgaggcggaggcgccggagttgtactcaattgtgagaaatctatccttaaaagccggcattcccatgcccaaaatttatattaccccgtcgccccagcccaatgcttttgccaccgggcgtaatcctgaacacgcagcggtagcggtaaccgaaggacttttaaatcttctaaaccggcaggagattgaaggggtgctggcccacgagatagctcatattaaaaaccgggatattctgataggaaccattgcggcggctatggccggagctatttccatgctggcggatgtttttcgctgggggttgttttttggcggtggtcgcgatgatgataataatcccggagggcttatagccgatcttatcctgctgattttagctccgattgcggctttactggtgcagcttgcgatttcccgttcccgggagtatttggccgatgaaacgggggcaaagcttgcggggtcaccggtgggccttgcggaggctttaaagaagctccatgcttacagcttgcggataccgatggaagtgtctccagccgcatcgcatatgtttatcataaaccccttgaacggacgggccttaatggcgcttttctctacccatccacccattgaagaccggattgaaaggctttatgctatgaggtggtagtttaaaattgcaggtacggtttccaaccgtacctgcatttaattttattcctgactgtgaaagaaggagaattttcaaacaacaaggggaaaacaggattaaatccaaaatggcgtggataaaataagtaaaggtgatttaaatgattgaaaggatatcttttcttgtaaaaaaggctccgaagtatgctaaacttgcttggcgcttagcgcgccacccggagcttacccttaaggagaagtcgattttggcgggggggctattatactgggcatcgcctattgattttattccgggggttattccagctttagggcagcttgatgacttaattgttgctttatcttccctaaactatgccttaaaaaagctgccgccggatatccgaagacaggaacttttggctgtgggtttggaagaagaagaaattgaagacgatatccgctatttaaaagcagtggcccgggagattgccgaacaaactctgaatttttccgcaaaaaccctgggctttgccggaaggcaggcaacaaagttaatgattaaaggaacgggttttctgttgcgaaagctaataaaatggagccaaggctgacctttttgggccagccttattctttttccacaaggctaatagctcctgtagaacaaaaaggcagacatttaccacagccggtacataagtcctgattaaccgtaaccggtttgccaaagccggggaaatcgtattctgccggctcctgttcaatagccccaaaggggcagaccacaactaaaatacaagccggggcttgatcgcagagagtcgggtcaactacagcaacttttttcgccatgataacctccttggcttatgcttataatagtatttacgaaagagatttggaaatatcttaaaaaagttttagcttttagtcaagaaaaatttatttgtggtataatggtcaaaaaaccgggggggttattgtggaaaaagctttagtggcttttttagttgaaaacctgaaaaaatttccctaccaaaaggaagagtttttagccctcctgaaaacccgcgggattgaggctgttgatattataagccaaaggcttgagcatccggttcctgccacttattttggctacgggaaggtgcaggaaataggagaactcttaaaaaaacacaatttaaatttgctggcggtggggggagatttaacacctacccaggccaaaaacctggaagaaattctggaagttacggtggtggatcgcacccagattatcctggaaatttttgccgagcatgcccacacccatgaggggaaaattcaggtggagttggcccggcttatgtataaccttccccggattaccgggctcggacgggttttgtcccgccttgggggcggtattggtacccggggtcccggagagaccaaactggaggtcctgcggcggactattcggaaaaggattgccgagttgcgccgggagttaaaagaaattgaacaaaaccggaaagtcaaaaggtcccggcggttggaggcgggagtgccaatcgtagccctggtggggtataccaatgcgggtaaatctactttacttaatgcccttaccggggcgggagtgctggcggaagacaaactctttgccactttagatcctacggttagaaagctaactttgcccggagggcagaagcttcttttaattgatacggtgggttttattgaaaatatgccacccctgattaaagaagcgtttaaatcgactctggaggtagtgcatgaagcagagttaattttgcatgtggtggatggggcaaacccataccgggaagagcaggaagcggtggttgaaaaaattctaacggaaatgaaagtaagagtgccggtaattaccgtttataataaagtggatcttttgccggaaccggttttgtttttgggtaaaagggcggttgcgatttctgcccgtaccggctataacatggagctacttttaaaattaatagaggaaaacttattctggcaggaagttacggtgaaagccgttttgccctttgcccaggcttttaaaattggggatttaaaagaaaacttaaagcttataaatttagagtatttaccggaaggaattgaggttaccgttgccggtccccgggaaagaatagcgaggtacttaggaagggaaaagctggaggagagcaatggcgaaaagccggtatgacgttaacgaaagagtattttggctgatttacggcatggcgcgaaagaatatttatttagacaaggttatggtctttttttcccgcgggggaatttatttttactggctaattatgctgtacttgttttttacgggagatttaaaggttaagttttatctttttaaaaccggtgtggtggggttaattgcggtatatttggcaaaatatttgggcaggcgctactattttcccaggccttttgtcgaaaaagggattaaaccgttatacccccatgccgctgacagttcctttccttccgaccatataaccggagcggtggccctaacgatggggatttgggaagtggcgaaggtggcgggaattatagccttggcatatgtagtgtttttgatgatttcaagggtctacgttggccaccattatcttcgggatgtgctggccggggcctttttgggaggaattgtttattaccttttgcattttgtttttcgtttgcttattgacattttcgtataattttgcataaaatattctccaaatacatggcaaatagggaaaaggcgatgcgaagaaaaaccggtactttttcctgttaaagagagccggggcaggtgaaagccggtacagggaaggccgggggccgtcttcaagccggaaagctgaagtagcagtaagctttcccgggagaccgttatccgaacgaagggggcaggagttttcctgccaagttgggtggtaccgcgaggatagaccctcgtcccaattggggacgggggtcttaatattttagggacaaggaggaagaaaggatggagcgtgaaattttacaattactccacgaaaatgctaaacttactcccaagcaaattgccacgatgctgggggtgacggaaaaggaagtcagggccaaaattaaagagctggaagaaagaaaggccattattaaataccataccctgataaactgggagaaaaccgagtacgagccggtaatggctttaattgaggtgaaggtaactcctcagcgggaagtgggatttgacggaattgccagaaggatatatcagtttgctgaagttaaagatgtttacctgatgtccggggattatgatttggcggtgatggtggaagggagttcgatgaaagaagtggctttatttgttgctttaaagctttctaccattgaaggagtgcaaagctgtgctacccactttatcttaaaaacctacaagcatgaaggagttattttggacgatgaagaggaagatagaaggctggtgataacgccgtgaaccttgaagaaaaaataaacccggttttacggcagatacccccttcggggatcagaaaattttttgacctggtagccaataccaaaggcgttatctccctcggggtaggggaaccggattttgttacaccctggtatatccgggaagaggggatttattccctggaaaagggctacaccatgtacacatccaatcaggggcttttggaacttagggaagaaattagccgctacctcttacggcttacgggggtagcttatgacccggtccaggaagttttggtgaccgttggggtcagcgaaggggtcgatttagccctgagggctcttgtctctcccggggatgaggtgcttattcccgagccctcctatgtttcttacgggccaacgacgatgctggcgggagggaagccggtttacatccggacgcggccggaaaacggctttaaattaacgccggagcttttagaagaagcaataactccgaagtcgaaaatcttgcttctctgttatcccaataacccgaccggagcggtgatgaccgccgatgacctggccaaactcctgccggttattgccgaacacgaccttctcgtaatttccgatgagatttatgcggaacttacttatgaagggaagcacgtttccgttgcttcttttccgggaatgaaagagcgtacggtgattttaaatggcttttccaaagctttcgccatgaccggctggcggcttggttatgcggccggtcctaaagaaatcatagcggcgatgaccaaaatacaccagtacaccatgctttgcgctccgattacggcgcaaaaagcagcgatagaagctttgaaaaatcaaaacgatgcggtaaaaaagatggtggaagagtataattaccggagaagaattttagtggaagcttttagcgaaatggggctctggctttttgaacccaaaggagccttttatgctttcccggatatttcggcaaccggcttatccagtgaagagtttgccgaaaggcttttatttgaagaaaaggtagcggtggtacccgggtcggcttttggaccttctggagagggctttatccggatttcctatgctaccgcccggaaagatttaattgaagctttaaagagaataaaaagatttgtgcggaaaaaatctttaaaaaagcagtaaaaacccctttgacgggttttttctttttttaccctaaaattaccttgcaaattagagcttttggcattaaaatattattcgagatacgtattatacgaaaggtgaataattatggaggagcttttacatcggctggcagcggtttttaaatttaaagaagaatggcaattagaaaaaaccggccttagcagtcaggaactgtttgtgctggaacatttgcaggaaggggaaaaatttcgttttggccagtttgcccggaaatttggtttaaaaccttctactttaaccggaattatcgaccgtttggagcaaaagggtctggtgatgcggaaaagggatgagaaggaccggaaggccgtttatttggtattgaccgataagggccgagaactggtagccgaacatttccaggaagaccgggaattttatcaagcgttgctaaaaaatttaacataccgggaaaaacagcagtttctcgatttgttaaccaaaatcttgcccgctgatttaggtgaactgctgccgggaggtgaggaaaaatgagtattattgtcgtggataacgtaaaactaaacggtagtgatgggcaagtgatcttggatggtattacttttactgtggaggaaggggattttctcggggtattaggaccttccggggcggggaaaagtagcctttttaggttattaaaccgccttttatcgcccacctccggagagatttactaccggggaaagaatatcaaagagtacgatccgatcaaacttcgccgggaaattggatatgttttgcaaagaccttatctttttggtcaaaaagttttggaggatttaacctatccctttcgcataaggcaggaaaagccggacatggaattaatttacaaatatttagctcaagccaatttaaaagaagaaatccttgccaaaaaacccaccgaattatccggaggagaagcccaaaggatttccttaattagaacgcttttagtacagcccagagttttacttttagacgaagttacgtcggctctggaccttgataccacccgggcaattttagacctcattttaaaggaaaaagaggaaaaaaaccttacagtgttagcgattacccataatcttgaggcgtttaactttacaaaggtgctgtaccttgatgctggaaaggtaaaatattttggggagggaaaaatttgagcaactggtcgcttcttttaagctttagtttggttattctggcaatgcttgtttccaaaaaagagaaacttttgttagaaaaagatcttttagtgggaagtatccgggcagtggtgcagttggtagcggtaggatatatcttaaaatttatctttgcccggaataatttctggtttactacggcccttttactggtaatggttttaaatgcggcttatatagccggtaaaaggggtgaagggattaaaaatagccatcttatctcctttggggcaatcgtgatgggactcatcattaccctgggggctctgattgcttttcgggctatttcctataagcccagccaggccattccggtaagcggaatgattgtgggaaatgcgatggtggcggtgggactggtgtttcgaagcttaaaacaaacttttcgcgaccggcgggaagaggtagaggtaaaattaagcctgggtgctcctccccgggaagcggctttttcccttatccgcgaaagtattaaaacggcaatgcttcccaccgtagaccagatgaaaactctgggaatcgttcagctgccgggaatgatgaccggtttaatcttagccggggcgaatccgcttatggcgattaaataccagattatggtggcgtttatgctggcaggggcggtaacggtggcggcttatgtggcaagctattttgcttaccggggattttttaatgaagatttccagatcgtaagttaaagccctaaaatttcgacaaaaaattatcaattttgacagaaaagtttatagaaaataattttaaaatagtttaaaatagtaagaaatttaactaaatcttttaaggacgggaggatggacaggatggttaagttctggtttttgggaatttttgtgtttattatgcttgtttcaggattttttgggttcaagaaaacgaaaacggtggatgatttcatcttaggaggccgcaaggtgggtccgtggctgtcggcgtttgcttatggcacgacctacttttctgcggttctttttattggttacgccggcaaagtgggctttagctttgggcttccggccctctggattgcttttggtaatgcggtaataggaagttttcttgcctggaagatattagcaaaacctacccggtacatgacccagcagttaaatgcccggacaatgccggagtttttagcaaaaaggtatgattttcccctttataagcctctggctgctttaatcattttcatttttctcgtaccctactcggcgtcggtatatatgggccttagttacctgtttgaagcggtgtttggcttgtcctatctttttgcccttctattaatggccggactgaccgcaatctatcttttactgggaggttattttgccgtagctcttaccgactttatccagggaacaattatgctgttaggtgtttttctcatggtggggtacctggtaaatacgccggaagtggggggaatcagcagcattgcttttaagctttcccagattaatccggactttacttccctctggggtgggcagggcttcagctctctcatgtttttaatgcttttaaccagcttcgggagctggggtttaccgcaaatggtacaaaaattttacgcgataagggatgaaaaggcaataacaccggctacctgggtatcgaccctctttgctttagttattgccgggggagcgtattttaccggagctttaacgcctttattttttaaatccctgccggtagatccggcaacaggcaaacctacccccgaccttttagttccccagttaattgcccagcacctgccggaatgggtggcggcgttgatcttactcctggttttatcggcatcgatgtctactttgtcttccctggtgctggtttcaagctcggcggtagcggtagaccttttgggagatacgggcttactcaaagataaaagtggtcgccagattttagtgttacgtatcttaacgatagtgtttattgcgttttcagtggttattgcccttttaaaaccggctattattttatcgttaatggccatatcctggggagccgtggcgggaagctttttagctccgtatttctgtggcttatttttccggcgggtaaatgcggtgggcgccctggcgggaacctttaccggcttattaacggtggtaactttagcggtaaagcacggctttgatgccaaagttctgccggtagccggggtttacggcattttcttaccctttgtggttgtacctctggtaagtttattagtgccgctaaaagaaagcaagacggtgaaacttttatttgaagaatagcgggatggaaggggaggagaactttggggtttatctggaacagagaaagagaatgcatgtccaggaaggacctggaagaactccagcttgcgcgattgaaggcccaggtgaaaagagcttatgaaaaagtccccttttatcgcgagaaattagaaaaggccgggatttaccccgaaaaaataaagacgttaaaggatgtgcggtatctaccggtaacgaccaaggatgatctcagggataattatccctttggtttgtttgccgagcccaagaaaaatttggtgcggcttcacgcttccagcggcaccaccggtcggcccacggtggtgggctatacccggggggatctggaagtctgggctgaggtggtggcccggattgtaaccatggccggtgttaccgacgaagataccgcccagattgcctttggctacggcctttttacgggagcttttgggcttcactatgggttagaaaaagtgggggcgctggtggtgcccatttcggtggggaattcccgccggcagattcagctaatgcgtgatttcggtaccaccgctttaatttgcactccctcttattctttgcatctggcggaaacagcccgggaactggggatagagcccaggagcttggggctcaagtggggactttttggttcggagccctggacggaagaaatgcgggcggaaattgaaaagcagtggggaattgtggcaacggacaattatggcttgtcggaaattatcggacccggagtttcgggggagtgtttggagcgggaaggacttcacattaacgaagatcattttttagtagaagtggtggaccccgaaaccctggagcccaaagaaccgggagaagaaggggagttaatcattacccctttaaccaaagaagctctgccccttttgcgctaccgtacccgggacatcagtaaaattaatcccgagccctgccgctgtggccggactaccacccggatgcagcgggtaaaagggagaaccgatgatatgttaattatccggggggtcaatgtttttccctcgcaaattgaaagcgtcctaatggaaattgaaggcacagctccccattatcagctcatagtttccaaacggggatatctggacgagttagaagttcaggtggaaatcgaagaaaagttctttaccggaaagtttaaagacttggaacaactaacccgcactatagaagaacgtcttgcttcaactctgcagatttccgccaaggtaaagcttttggaaccaaggtccctggagcgctccgaaggtaaagccaaacgagtaatagatttaagaaatagcggagaaaggggatagagaatggccaggttaatgaccggaaacgaagcgattgcccggggtgcttttgaagcgggggtaaaaattggggtgggctatcccggtactcccagtacggagattttggagaattttgccaggtacccgggggtctatgcccagtggtcgcccaatgagaaagtagctttagaggtggggattggagcttcccttgccggagctcgaaccctggtgaccatgaaacatgttggggtgaacgtggcagcggattcgcttttaaccttgagctataccggtgtaaatgcggggctggtgctggtatccgccgatgatcccggactgcacagttcccagaacgaacaggataaccgttattacggtaaactggctaaaataccggtattggaaccctcggacagtgaagaggcccgcaagtttgtgaaacttgcctatgaattaagtgaagagtttgatacaccggttattttaaggacaaccaccaggattgcccatacccatacgttagtgattgaggaggaaccccgggaggtaagcttaaagccgtacgttaaaaacccgcaaaagtacgtgatggttccgggaaatgcccggttgcgccatcaggtggtggaggagcgacggcagaagcttttggaatatgccgaaattactccgttaaaccggatagaagagggaacgggggatgtgggctttattacgtcgggaataagctaccagtatgttaaagaagcttttcccggctctccggttttaaagctcggacttacctggccgcttccggaaaaacttattttaaaatttgccgaaaaggttaaaaccatcatagtggtggaagaattggagccgtacatagaagaacacgtgcgtgccctggggttaaaagtcgtgggcaaggaaattatcccccgtaccggtgagttaaaccactatattgtgcaaaaggcggttttaaaatacctgggagaggatatagccgatttccttgagaatttggatttaccccagaggccgccggtaatgtgtccgggctgtccgcaccggccggtgttttatattttaagtgaacttaaacttacggtaaccggtgatatcggctgctacaccttaggggtaatgccacctttaggggcaattgatactaccgtttgcatgggagcgggcatcggaatggctttaggaatggaaaaagccaatccggatttttccgggaaaacggtagcggttattggcgattcaacttttttacattcggggattacacctttaatcgatatggtatataatggaggcaaagggactatattaatactggataaccgcaccacggcaatgaccggccaccagccccacccggcaacgggtaaaaccttaatgggagaaccggcacctcaagtggattttgaggcgttggccagggcgttaggggtaaagcgggttacgaccgttgatccctttgatctgcagcaactgagagcggttataaccgaggaagtagcggccggagaggtatcggtagtggtggtgcggcgggaatgtgcgctgttgcccaatcaaacccgggagcccctaacggtaatttcggaaaaatgtaccggttgccagcgctgcttgaagttaggctgcccggcaatagccattaaagataagaaagcttctattgacccgcttttatgtaacggttgcggggtatgtgcccaggtttgtaaattttcggccataataaagggtggtgattcccttggataaaaatattttactggccggagttggcgggcaggggactattctggcaagtaaaattattgccggggtagcggaaaaggctggacttgatgttaaagtagccgaagtccacgggatggcccagcggggaggagcggtggtcacgtatcttcgctttggcaagaaggtaaattccccgttaattgctcatagagaagcggactttcttttggcgtttgaaaagttagaggcactaagatggctttcttacttaaagccggaaggcctggcgttggtcaacgacatggaaatttatcctctgccggtactgaccggtaaagcttcttatccggattttcgggaaagggctcaaggagtaaattttaacttgattcctgcccgggaaattgcgaagtcacgtaacaatccccggggaattaacatggttcttttaggatttttagcaaagaggcttacttttcctaaagaagcctggcttcaggaaatccaaaagcgctctggaaagttttcggaagctaatattgcctgttttcaagcaggatttacttatggagcataggaaagagggtttttctaccttctttccttatttatttttaaaactattttattccaaggaggaatgccaaagtgaaaaaggaagttttaattaccattaggggaagccagagaaatgagtggggggaagaagacaccattgagcttacgaccttggggtatctttacaaaaaacccgactgctactatttggtgtaccatgagtcggaggtttccgggatggaaggcactaccaccaccattaaaatagaaccatcccgggttaccttaaaccgaatggggaaaaatgaacagaagtcggtgtttgagcagggtgttttccacgagtgcatgtatattactccctttggcatgatgagtttggcggtccatccttcggaagtatttatagacttgacagaaatgggtgggacgattaagcttttatatgaattaaatttagagcggcaaaaggtttccgacaactttttgtccatcgaggtcaaggaggcttgaaagtggagtatcttttacagagaattacgggggagattgccggcagcttaagaagagcagcagtaaaggcgggatatttggatgccgaggacgagttagcctttgaactggaaaaacccaaggaaaaagcccacggtgatttagccactaacttagcaatgcttcttaccaaaaaggcgcggaaaaatccgcgggaaatcgcagcgaccttgctagaatacttagagattcctgcggtagtggaacgggtggagattgccggtccgggatttataaacttttactttaaaaaagattgggtcgttgccgtaattccggaaattttaagctttggggagaaatacggacgcttggctataggagcggggaagagagttcaggtagagtttgtttcggctaatcccacaggccttcttcatatgggtaacggccggggagctgctctgggggatatccttgccaatattttaacggaagcgggttatgaagtatcgagggagtattacattaacgatgcgggcaatcaaattgaaaactttaacaaatcggtggaggcccggtatttagagctattagggtataaggtggaatttcccgaagaaggataccacggagaagatattattgatacagcgcgcaatatcgttgcccggtttggggaccgttttattcatcttcccgaaaaagaaaggcaggaagctttggggaagattgctctggaagaaaagttacagtccataaagaaatctttggaaaatttcggggtaaagtatgatgtctggttttccgaaagatcgctccatgaatccggcgaagtagaaaaaactgtaaaacttttactggagcggggttatttgtacgaaaaggatggagctctctggtttgctgcttcgaaattaggcgaagaaaaagatgaagtgctggtcagaaaaaatggtgtgccgacgtattatgcggcggatattgcttaccacaaaaataagtttgaccggggctttgatctggtaattaacatctggggggctgaccatcacggccatgtaagccggatgaaaactgcccttaaagcgttaggctatgatccggaacggcttattgttatcttaatgcagttagtccgactcttccagggcggggaactggtgcggatgtccaaaagaaccgggcaatacattacgttagatgagctggtggaagaagtgggggttgatgctgcgcgctacttctttgtcatgcgcagccacgatgcccacctggattttgacctggatttggccaaagagaaatccaacgaaaacccggtttactatattcaatatgcccatgcccggataatgagtctttaccggcagtgtaacgagcagggagttactttacctccggtggaggatgtggatttagcaattctaagtagtgaggcggaattaaaccttttacgccatctggccgagtttccggtggaaatagaaaaatgtgctactgccttagctcctcatcacctggcaagatacctccatgaattagcggggtatttccacaccttttacaatagctgccgggttttaggggtagaggaaaacttaagtaaagcccggttgctgttagttgaagcaacccggatcgtgcttagaaaaggattaaaaatgctgggcgtttcagctccggagaaaatgtaacttttagcttgactttggctcttttggccgtatagaatggaaaaagtgattatttggtagtattgggaggattaagatgacgaagtttatttttgtgaccggaggagtagtttcgtcactgggcaaaggaatcaccgcagcatctttaggacggcttttaaaaagtcgcggacttaaagtagcaattcaaaaatttgacccgtacattaacgttgaccctggtaccatgagtccgtatcagcatggagaagtgtttgttaccgacgatggagcggaaaccgaccttgaccttggccattacgaacggtttatcgatattaatttaaccaagaactccaacgtcactaccggtaaagtttactgggcggtaattagcaaggaacggcgcggggattatctcggtggtaccgttcaggttatcccgcacattaccaatgaaattaaagaaaggatattgagggtagctaaagaaagcaatcccgatgtggtgataaccgaaattggcggtacggttggggatattgaatccctgccttttttagaggcaataagacagctaaaaaacgatgtgggaaaagacaatgtcctgtacattcacgttactctggttcctactttaagggtaaccggcgaacttaagaccaaaccaacccagcacagcgtcaaggaattgcggagcatcggtattcaaccggatataattgtagcccgctcggagcagcctttatccagggaaatcaccgaaaaaattgctctcttctgtgatattgataaaaatgccgtaattcaggcggtggatgcatctaacatttacgaggttcctttaaagctaaaagaagaaggtttggatgatattgttattaaaaagttagggcttacctgcggagagccggatttgtcggaatgggaacaaatcgtcgagcggtataaaaaccccaaatttgaagtaactattggtatagttgggaagtacgtatcccttcccgatgcttatttaagtgtggccgaagctttacgccacgccgggatttatcatgaaacccgggttaacatccgctggattgattcggaaatgctggaaaaagagccggtggaaaaatatttaagtaaccttgatggaatattggttcccggaggctttggcgaccggggagttgaagggaaaatcaaggccattcagtatgcccgggaaaacaaagtgccttatttgggcctgtgtcttggcatgcagactgccgtaattgagtttgcccgaaatgtggcaggccttaaggatgccaatagctctgaattcaaaccggatggtccccattcggtaattgaccttttgccggaacaaaaagaagtggaacagttaggaggcaccatgcgtttgggattatatccgtgtaagcttgttccggggacaaaagctcatgctgcttacggagaagaaattatttacgaacgccaccggcaccggtatgagtttaacaatgagtaccgggaattattaaccggtttaggtctggtaataagtggtacttctcccgacggccggctggtggaaataatagaactttcggaccatccgtggtttgtggcgacccagtttcaccccgaatttaaatcaagacccaatagaccccatccgcttttccgggagtttatcggggcgagtttaaaaaccaataaattgttttaggagataaccggctaacagttagccggtaatttttttaaaaaaagttaagacaaaattcgacatacaatgaaggaaaataaaagtttatggcgaaattacaaccttcaggaggcggaaaaattgacaaaaccctctattttaatcgtagatgatcagccgggtatcataaaacttttaaaagatgcgttagagttaagaggttatgtggtttatacggcagggaacaccggtactgctaaagctttggttttggagaaaaaacccctgcttttaattttagatgtaaatcttggtggagagaatagctttgtcctggcaagacagataaaagatatcctgccggaagggaaaattatctttattacggcttaccaggaagaggagattttaaggcaaattcgggaattaggaggagaagtcttagttaaacctttttctttagaagagttataccgaaaggtgcaggcggtagttagtagtgatggacgatgggagatattgtctaattgtgacacaaggaatttttaaatttaaggcgaactcttcccttaaacgggaggggtttttctatggttgtttttccggaaaaagaagttactttgcgctgtcctgcttgccaaaaaaatcggcagttaaaaatatcggtatttagcctgaaaaaaagggaaaaagaagattacttttgtgcctgcggtttaaagctcttaacgatcaggcttttaaacctggaggaaacggttataaggttgtacttttatgatgatagtgagataaaaagctttcgcttaaaagagtttgtagctttagatttttcttcggtaaccccgaaaaataatgggcttagtttaaaacccaggagtagttacgaccctctcaaggatgaaaactttttaaaagagtattttgtagctcctgcggttatgtatgaattgttaagtcacttagaaggccttgactatcagggtaaaattcagtgtgaatgtaataattttaaaggagagttagaactttttcccgagtatttaattttaagatgccagaattgtcaaagggcgaaaattttttgggcaactcaggaagaagatgtgctaaaattaggacagaaggctatactattaacaacggttccaaaaaaagaaaaataattaaagggggagatatcttggctttagttacggttgcggaacttttaaccaaagcttaccgggaagggtatgcggttggtgcttttaactgcaacaatatggaaattgtgcaagcgatcgtagctgctgcggaagcggaaaacagccctgttattattcaggccagtcagggagctataaaatatgcgggtattgattatattgccgctttaagccatcaggcggccaaaaatgccaaagtaccggtggcccttcatttagaccatggaaccagtttagaacaggttatggcctgcatccggcacgggtttacttcggtgatgattgacggctccaagtatccttttgcggaaaacgtggccattaccaagaaagtagtggagctggcccatgcggtaggagtttcggtagaggcggagcttggtaaaattggcgggaccgaggacgatatttcggtggacgagcgggacgctttctttaccgacccggaggaagcccgggagtttgttgcgcagactggagtggattctttggcggtagctattggtaccgcccatggccgctataagggagtgccaaaacttgattttgaaagattggcaaaaatccgggaacttgtacatattcctttggtgcttcacggttcgtccggtgtccccgatgaggatatcaaaaaagccatttccctgggtgtggccaaagtaaatatcgataccaacatccgggaggcgtttgtgggaaagatgcgggaagttttagagaaaaatcccgatgagattgacccgcggaaaatcttaggtccggcaagagaagcagctattgaaattatccgggagaaaatcagggtatttggttcttccaataaagcctaagaggtgttgttatggaaattttcttagacaccgccaatattgaggagataaaaaagggagcaagtctgggaattatctccggagttactaccaacccttccttaattgccagggaaggcagggacttaaaagaagtagtaatggaaatcgtaagccttattgatggaccgatttccgccgaggttattagccttgattatgaagggatggtcagggaggcggaggagttatcaaaacttcatcccaatattaccataaaaattcccatgacctgggatggtatccgggcggtaaaaaccctttcctcaatggggataaaaactaatgtaactttggttttttcggcaaaccaggccctgcttgcggccttagccggagctacttttgtcagcccctttgtgggaaggcttgatgataccgggcatgacggcgtttatttaattgaagagattaaaactatttatgaaaattataactttaagaccaaaatcatagcggcaagtatccggcatccgttgcacgtgacccaggtggctaaagccggggcggatattgcaacggtaccctttaaagttttaacccaaatgtttgcccaccctcaaaccaaggaaggtattgaaaaatttttagccgactggcaagctatgaaaagataacaaaacgggcggaatattttccgcccgctcttccctcgttttttctcgccttttttgtttcccggaagagtttatttgaaattatttattaacagtaacaaaaaatataagggttagtattgtctacctataaaaggaggaagggttcttttgcttaccaaggaacagctggaacaaaagaccataaaggagctttatgcccttgcccgggaactggaattgcccggttattaccgtttgaagaagcaggagttagtgtttgaattagcaaaagtttttgcccaaaaagccaaagagcaggaacaaaaggaaagtttattgacggcttccggggtactggaagttttacccgatggctacgggtttttgcgccccttcaagtttttgcccagccaggacgatatttacgtttcaccatcgcaaataagaaaatttgacttaagaaccggcgaccaggtgtttggggtaataagacctcccaaggaaaacgaacggtattttgccctgctgcgggtggagaaggtaaacggtaaggagcccgaaacttcccccgaaaggctccactttgatgcgttaactcccctgtatccccaggatcggctgtatttggagacagcgcccgatgaggtatcggcccggctgattgatttgattgcgccgataggcaaaggacagagggggttaatcgttgctccacccaaagccggaaaaacagttttgttaaagcagattgccaacagtttaattaaaaattatcccgatctttaccttattgtccttctaattgatgaacggccggaagaggttaccgatattgaacggtcggtcaaaggggaagtggtaagttcaacttttgatgagcatccggaaaaccacgttaaggtagcggaaatggttctggagcgggccaagaggcttgtggaacataaatacgatgtggttatcttattggacagtatcacgcggttagcccgggcctataacctggttattccgcccagcggccggacgctatccggaggggtggacccggcggccctttataaacccaagtggttttttggggctgcccggaatattgaagaagggggaagcctgaccatactggcgacggccctggtggaaacgggtagccggatggatgatgttatttttgaagagtttaaaggtaccggtaatatggaactaattttagatagaaaattagcagaaaggcgaattttcccggcggtggacgttcagcgctccggcaccagaaaagaagagcttttgtttactccggaagagttggagtttgcctggaagcttcgaaatgaactttcaaaccttacttcccaggatgcagcggaatacttaattaatcttattaaaaagaccaagagcaatgaagaactaatcgaacgctatttaaggaagagtaggtcatgagaatagtagttgcccgggaaaatggcgagttttttgattatcccctgcagcctgccgggcgcacggggaatttctttacccccattgaaaagtcggaattaattaagcttccccggggggcaacgttagttttaataccgggaagtaaagccctgggatttgacaaaaagggggaactccgaaaaaccgaatacttagcggtggctgctctcctgccccaggggtatacccggctatttcttccggcctatattaaagaaaacgctgaacggttgcccctttttggttataccgcggtggtggcgtatcgtggagagctttatgcggcagcggcaaaaaccgatgacgaattccgctgggcaccggaaaattatgatttacctgagttaaacgctaaaataaaagaggcaaaagccctttttcccgaaaaccggttagtacgtcatctggaaaactgtgctgtaaattaccgctgctttaccgcccagaaccttttttaccgccgctgggaaggcgggattccggtatcgcccgcctgtaatgcccgctgcctggggtgtattagcctgcagccagccgattgctgcccctctcctcaggagcgaattaaatttgtaccttcaatagatgaagtagcttccctgatgacctatcacctcacgggagccggaagggaaggcattgtaagttttgggcagggatgtgaaggggaaccgtcgttgcaggctggcctgatagccagagcaattatggagacaaggcgagaagttaaaagcggaaccattaatatcaatactaacggcgggaattttccgggtttaaaggaaattatcgatgccggcgttgatagcctgcgggtaagtatcattagtgcccgggaagaaatttatgaaagctattaccagccggtaaactataacctggagcaggtgaaaagaaccatcaaatatgctaaagaaaaagacaagtttgtagcgttgaactacctggtgtttccgggactttctgatactgaagaagagtatgatgctctgaaatatctactccgggagtgccgaccggatatggtacagtttagaaatttaaacatcgacccggattatttgggaactggtatagtttttccttctaaaccttttggactgcaaaacctgattttgcggcttaaagctgattttcccgggcttatcctggggaattactcccgtcccgtaaatagggaagaaaacactacctaaaaaagttttgccccattgccaaaaattttacggaatggggctttttaattttacaacaaatgtcttaatattaccagcgaggtgataccaaggacaatacttaaaattgcatttttacctatcaataaggaagcaacggtaattaagctggcaccgatataaggattggtgaaacttacatccaattttccctgaggggcaaagatacccggaaaaattaaagttgccagaatggctaccgggatatattttaaagcccgctggataatcgtggggaggtttttattggtaaaaagtacgagaaaacttactcttgttaaataggttaccactgccattagtaaaatcaaaagtatgttctctattttcatggggcggtactccttttttctgttaataattccaggatagttcccaataccgtggcagttcctgttgctaaaataatgtaccatttgccggggattaaaaggtatccggctattgccaagattccggcaattaagaaaactattaaaatttgccacgacttaatttgtccgataacaatacttaaaaaagtagcgggcatagcaaaatccaggccccaggacaaagggtctttaattaaagttcccagtaaggcgccggcaagagaactaattagccaggaaaaataaatacccgcttcggaacctaacataaaataggggttacctttataactaccttcctgttggtagtgaccgatggtagttccgtaaacttcgtcggttaaaccgaaggcaagcaggtaaagccatttggcattcaatttatttaaaaagggcgctaaagacaggcccatgagcagatgtcttaaattaatcagtaaagttgaaaggacgataaaaccaattccaaccccctctttaatcataccaacggccataaattgagcggaaccggcaaaaaccaaaagagacatcaggagggtttcccccagggatagttttgcttgcgtagccattatcccgtaggctaaaccaaagggtatgagacctaacataaaaggggtggtttttttaagaccgagcaagaaggcttttaagtccaccggggatttcattactcctttctaattcaacttaaaaaaattttgccataattttcgtaaattgacaaggagaaagtaacaaattgtcgaaatagtaaggaatagcttgacagtaaaataaacaattcagtaaagtaattagcaagataatttattagtattaataataaattgcagtaggaaggtaaagatttcggtacgggatgcaagtaaccttttacttctgaaatttggcaaatagggggatgacctatggaagacagcgttcttttgagccgttaccaggaaaccttaagttttttgaatttaacggcggaagacctgcaattaatggccgaatttaaagagttatttatccaaaaagctcaggagtttgtcaataaattttatcaacatttaactaaatttccatatttacaggaattaattaaaaaacacagtaccgttgagaagttatccaaaacccaggcggagtattttatttcattaacctcggagaagattgatgctgattatattaaaaaccgcctggcagtcgggaaaaaacatatggaaattgccctttaccccaactggtatataggggcataccgtttatattacgaagttgtcggggaattggtagcccggaaatattctcccggcacggagttgtattttaaggcggtaaatgctttttacaaacgaattaattttgatatccaactggcgatcgaaaattatattgccgagcaattaaaatacttggcagcgattcaagagcaggtagcggatgctgccggctttatttcctcgattgccacaaaaacaaatattttagccttgaatgcgtcaattgaagcgggaagagcgggggaacacggccgggctttcggcgtagtggcccaggaagtgcgcaaactggctcaggagtcttccaaagttgctaaagaaataacggaaatgattaaacataatatggaggaaatagaaaaaattcgccggcagaatagcgggatgatgtaagatggttactttcaatcgttttaattttataaaaaatatgtccaaagcgttagatttaagtatggaggggttgcaggaccatcatcggcgggtggcttacattgcttaccgtttgggagaaaggtacaatttaacgccaacacaaaagcgggatttggtgtatttgggcttaattcatgatataggaattttaagatgggatgccaatgatgaaagaatccggcaaatagcggaaaatgagtttgaacattgccggcggggggcacttattttaaaaaattcttatttcgaccattatgccaggtatattttcagtcaccacgaccattatgtcggaaaaaacccgtcgggtcttacgggagaagaaatacccttactttgcagggtgttgtttttggccgatagaatagcggtgaattttaatcctgaaagctgtatcctggaaaaggtgaaatattggcgggaatactttactaagcgaaaaatttttgatccccgtcttttagaggtgttttttgaactagcggaagcggaagaattttggctaaccctgggcgatagcgatattttaaatcaacgcttggaggaaattggttatgcagaagaactaataaatttaccggatatgattggtttagcggaattatttgctaagcttgtagaccataagtcccggtttacttttttccattcgcagttagtaggggaaattgcggaatatttaggaaaagttttaaattttggccaagaggatgttagctttcttaaaatagccggacttttacatgatataggtaaaatgtccgttcccgaaagtattttggaaaaacccggggaccttaccgaagaagagtttttgtgtatgaagaaacatagtttttacacttactatcttttaaacggggtgtttccggaaaaaatagtaaaagtggccgcctatcatcacgaaaaacttgatggctcgggatatccctttaagaaaaaaggcgaggaattgggctttgaggagcgtttgctggcggttatcgatatttttgttgctcttttggaagagcggccgtaccgcaaagggcttgactaccgggagattaaaggtattatggaagagatgggacaaaaaaataaaattgatagggaattagtgcgggttgtcctggataattacccggagttacaggcgataaagaaaaaacttagtgaagcctgaaaaaagtttttttggcagcaatctccttttttccggggaaagctaaacacaaaagacttgacgaaaggggttatccgtttaaaattaaaggggaaggtctgacataattgccaaagagtggggcggtaaacgaaaattaaaagaaagggggaagcggttttaaaaaccgctttgggaaatgaacgccagccgtactgctgaattaaatataaggttgaccgaatttgaagtaccgcctgttcaggattttctggtcataggaaaacgggctccaattggtattgaagcttttggcaaaatggttgaatttatttcccccaaccagtataaggctattcggctgaatcacgaaaaatttgaagggataattattagaaaaaatttcctcaatgtaatggaggaagagttattgatatcggcaatcttagtagaagtggatgccatttccgatgaaagttccattttcaagggaagtttaaacataatgcttaatatcaaaaaggagattgaaatatgattaaacaagtacgggaagtaatgaccagaaatccggtaaccattgagccgtacaggagcttatgggatgccaaggaacttatgcgttcgcaaaggattggcgggctaccggtggtagaaaatgaaaagctaataggcataatcacttcaaaggatttaatattttatccggaaaatcggctggttattgacgccatgaccgaagagccggtggtcattgaagaaaaagcatatttatttgacgcatatcaaaaaatgctggaaaataacatcgaaaggcttccggtaatagatgagtccggtgcgcttacgggtattataacgaggaaggtaattgaacggtatattgggtcttatatagattcgatgaccgggttacccaaaaaagagtatgctatctataaatgtcttaaattattggagcggggaaattcttgtacggtggcttttatcgatttaaataattttggggaattaaataagcgttacgggcatgtagtaggtgaccaaattttattaaaagtttctggaatattaaaacagttaggggaagatgttaccgctgcccgctacggtggagatgaatttattttaatcctgccctatgacgaagtaaaaacaattaaccttgtggataaactgttatttcttctggaaaatgataaatggccctatgatttaaaggtccagtgtgcggtgggagtaaaggagattagacttaaagaaaaagtcgatattatcgaagaagtttttgccagtatcaacgaagcaagcttaaaatgtatagataggaaaaaggagattaaaacatgatatttgttgacatgattaacatcctttgctaaagtaagataaagaaattttaaaaaagcacctcttccagaacaggggaggttttctttttgagaaaataagaatcaggaggagattttatgacaagacgcctttttacctcagagtcggttaccgaaggacaccccgataaaattgccgaccagatttccgatgcggtgttagatgctatccttgcccaggaccctcaggcccgggtggcgtgtgaaacggcagtgaccaccggcttggtcttggttattggcgagattactaccagctgttatgtggatattcccaaagttgtgcgggagacaatccgggagattggttatacccgggcaaaatacggatttgacggtgatacctgtgccgttatcacttccatagatgagcagtctccggatattgctttaggggttaaccgggccttagaagccaagaccggagaaatgactgacgatgaaattgaagccattggtgccggcgatcagggtatgatgtttggttatgcaaccaacgaaaccccggaacttatgccgatgcccatttccttagctcaccggcttgcccggagactggcggaagtcaggaaatccaggcttttaccgtatcttcgtcccgatgggaaaacccaggtaacggtagagtatgatggtgataagcctgtacgggttgataccattgtcgtttcaacccagcatcatcccgatgtatcccaggaggaaattcgtaaggatattatcgaacatgtggtaaaaccggttattccggagcatcttttagatgaaaacacccggtattttgtgaatcccaccggccgttttgtaattggtggacctcaaggcgatgccggacttaccgggcggaaaatcattgtggatacttacggtggtatggcccgccacggtggtggagccttttccggtaaagaccccaccaaagtggaccgttctgccgcttatgctgcccggtatgtggcgaaaaacattgtggccgcaggtatcgccgataagatagaaatccagctggcttacgccattggggtggccaagcccgtctctatcatggtggatacctttggcaccggcaaaattgccgatgaaaagattgtagagctcattaaaaagcactttgatttacgtccggcaggaataatccggatgttggatttacggcggccgatttacaagcaaactgctgcctacggccattttggtcgtaccgatatcgatctcccctgggaaagaattgataaagcagaaattttaagaatggaagctggactttaaacagaaccctgggccagattaactggccagggttttaacttttttaacccctttagcatacggtataaggggggtggcagaggtgatggaggcaatcctggctggattttttgtctacggggtgatttcagcccttctggtaatttgggaagctttaaactttcgcaagaaacaaaacttatggctggtggtaaacgatttaaaggggctttcggaggcggaaaaacttttggattttttaaaagagcgaattcccgggacaatagagaccaaagttgtagatttaaccggtacgctaatttcttcgcgttttcaggtaattaacgggcttccggaggaaattcagagggaaaactatattatctttttttaaaatatatggcaggaaaaaccaaaaaattgtcgaaaaattacagcatgcacaaggttaattattggcagatttggcgggtaatagtttcattagcgggatttattctaacggtattttaccttttaaaaggcagcattcagccgccgggggctttttttgcccttcttacggttagttttattttagaacttaccgccatagagatttgtggttccaaaattaaggggtcttatgttttttacctggttaccctgctactaaagggaaaaggttttgctgtagtattaagttttcttgcaggattattagcttcctttttaactaaagaggaaaaaacttttccgggatatttttttgaaggagcaaaaaacagcctgggcattttactgggaagtcatttggccgggtacctacccggaggagagttttttcttgcgctaatctataccgcaggttttattctggttgatgcagtttttatgattttaagagctttctttggagaaaatgcggggtccactaaagaagaaattttttattacggtttaaactgttttctcacctttaccgctggagtattgcttaccgaggcaattaagaaaaatttctatcaagcactttttcttggacttttacttaccgaagctttttatctggtgataaaaataaaccaaaagcttttaaaccaaagcctcgactacgtaactttgtggaatatttcccgaacctttcaccgcctggaaactcccgatgatatgttaaaagcaatgttacaggaattaaaaaatactttttcctaccataccggggtcatttatacttattccgaatccctgagaaaatatattccccgctatttaaacaccgattttcccgaacttccgggaccggagtttcataataccctgctttccgagatgggaaatagaaaaactgctgctttaataaaacacccgcaattagggagtattgcggtggtaccgttgcaaaaccgcagggatgtctttggttacctggtaatagtggccccaaaagggcagaactattcccatagtcagctcaggcgtcttgaaaatatttcgggacaggtggccctggcggtttataacggctacttgtatttacgtttaaaggagcttgcccagaaagatgagttaaccggcttatataaccggcgttacttcttggaaaggcttaatgaggagcatttacgttcccgcaggcataaattaaattacaccattgttcttttagatatagattattttaaaaagataaacgatacttacggtcacgactgtggagatttggttttaaacgattttgggcggtttttaaaagataccctccggcggaccgatttaagtgcccgctacggtggggaggagtttgttgttttgctaccccagaccgggaaaaaggaagcctatctcttagcggaacgcttgcgggagaaagttaaagagcgggttttaatttttcaagggcaaaaggtcaaatataccgttagcatgggactggctgcttatccggaggatgctgaagagtatcgggaactgttaagcttagccgataaagctttgtatcaagcgaaaaaccggggcagggataaagtggtaatggtaaataatttttagggattaagtataattatttaaaaatttggcaatattactaccgtaaaataaaaaaatggaggtagtaatatgctgagtttactggaaaaaacaagactcttaaaccgctttatccagcggagcccccaacgtccggaaccctttatggaactggcggaaatgcttggggatatttcaaacgccagtgtttacattatcggccggagaaagatactggggtattatgaacgtctggatctggtagggctggtaatttacggacgggatttagaagcgcgccaggtagagcaggattttcaggattggctgttttctttcaatcaaacggatcataacattaaaggggaagatgggcttacttataccgttgtaccggtttttggcggtggtgaacggcagggaacgattttactggtcaaaaagggacaggaagagtttaacgctcaggacttaattttgtacgagtacgctgcaaccgtggtgggtttggaaattctaaggctaaacagcgaaaaaatggaagaagaagccaggaaaaaagctgcggttcgcttagcgttagatgccctttcttattcggagctggaagcggtgaaaaagatttttagcgaacttgatggagtggaaggctttgtggtggcaagtaagcttgcggaacaatatcaccttacccgttcggtaattgtgaatgctttaagaaaattagaaagcgcgggtgtgattgattccaggtctttgggaatgaaaggaacttacattcggattttaaacgattatttcctggataagttggaaattgcccagcaaaactaagaagggtggtaagtggtaggtggtgggtggtcggtcgtcggtaaaaaaattatatcttatcacctacgacaaaccacataccactatttttggaggttggaaattagaagttggagattagaaaacaaaaaataataattttaacgcaaaaatcagtagttgtcaaaggccgccttggcaaaaggcggtttttttctttttagaggctttttgctattcttttcccggcgctaaaaacgaaaagcccgggctttaaccaaagggggctttttatggatcggtttttagaaaagtggcagaaagcaagaaaaagccgggaagggatggaagaacttcttaattacctgcgtccactcattaaaaaggcagctcaacgttatcgcaatccctatctaaccgaggaagaccttatgcaggaagggatgattgcggtaatcgaaagtgtttaccgctttgaccccgagcggggggtttattttttaaagtacgtccgggagatggtgtatggtaggatttattccctgttgcgggcggaaaaggccagaaggggtaaggaagtgccgttagaggaataccatattgaggtgcagcattttgccgaggaactgccgacgattaactttcctccgggggttttaacgccccgccaggaaagcttgataactttaaaatacgaacggggaatttccctgagtgaagtggcgaagattttaaaaattaccccggccggtgcctatgatttggaaaaacgggctcttaataaattaaaaaaatactacctctccttaaaaaccaaataaatggactgcactttttttgatgtcagccggctgaacgctaatagaagggaggaatttttatggcggtgattgccaacaaggtggacacggtattgcggcttaagttaattacgggggatgacggaagcgggaatccggtttatgcttttcggagttacaataacataaagcctgcggccaacaatgaagacctgtacgcggtggcggtggccttagccgaacttaccggtttaccgcttaacggggttttccgaaacgataccgaacttctgtataacgttcaaacggggggttaaagcatgaaagtccttgagatgatttttaccaatcagcaggggaaaaacgtgacgattcgggtgcgagaaccaaaggaaggacttaccaaggcggaagttgatgcggtgatgaacttaattgttacgaaaaacatttttacttccaatggtggagacctggtggcagttaaaggctcgcggattgtggaccgaattgtaaccgaattttaaagaaaaagccgtggcttaagccacggcttttttaaaaagggggttttaaaatggatttttttagccaacttgccaactatagctttcccatggcagtagcggcttttttactggtaaggattgagggaaagttagatgaacttaataaatcgttaaccgaattaacccgggtgattgccggtaaggagctgtcttaaggctaaagtcatgcggggaacatcaattttcatcgggcagcgctcctgacagcggccgcatctaaggcaaacgtaggccaggggtgctgctttttctatacctcccgctacaaaggctgtccaaattgagccgataccgcctaaatacttgtagccgtaatagccggcggttaaagaaaagaccgggcattcataaagacaaccgccacagcgcagacacaacaatgcttctttaaaagtttcgttttgggatagagaaaggcggccgttatcgagaaagattacgtgaagttctttcgggccatgggctccgtaagtggtaaccttttcgatgtcaccggttttactgggaccgctaatgatattaacgtaggacggtaccgtatactgggcataacgccaggtaacttctgccgtcttaaaagcgtcgtctaacgtcgggacaagtttttccaagccaacgatgacgatgtgcaccggaggggcaccggtggccaggcggccgttaccttcgttttcaatgataaaaattgaaccggtatcggcagcgacaatgtttgcaccgcttatcccgatatcagctttaaaatacttctcgcgcatgaactccctgacggctgctacttctgcggcaatctcgggagggatttctttttcaaaaaaagcggaaaaaagctttgccacttcttcccggggaatatgaatggccggggagaggatgtgcattggccggtcatttctgagctgctggataaactctcccaggtccgtttcccaaagggtatttcctctctcttctaaatgttctcttaaaccgatttcttcacctaccatcgattttaccttgacgattaatttcccggtgccaacaatttcggaaacaatttttaacgcctcactgccatctttggctaaataagcttttccgtgattttcttcgatgcttttagcggctttttcgtaaagatcttgtaagttggataatgcttgaagtttaatttctcttacttcataagcccgttctaccgtgtggggaaagcggcttaaagctttatttacgttttcccggtaggattttactgcccggcttaaagctaagttaatattggggttgttagctgccttaactaaggtttctgctaaggcggctaaatctttttccaggtctaccattgagctcaccttctttaaataagaatttcggttaaatcttttaccggaagattagcgtattgcgaaaggttaaaataacaataaggacaggcggtaactatttcttcaccaccgcttttttcaagttcatgaactcgttgtttggccaatgcttccgccagttccggaaataaaagcttggtagcaccgccacagcaagtagtaaatttaccgctttggggaagatctattacttcgccgttaccgctcttctttataacttccctgatttcggtaaatacatcgagctcccgggctaaccggcagggatcgtggatgacgatttttttcctgggccctttgggggaaagtttagcaaaattggctgctaaaaattccggcatagtataaacttcaaagggaaagtcaacgaactcaggatagacttcccgcaacatttcggcggcatggggagatgcaactattatcttttttactccccggcttttaaaaattccggtgagtttccgggcaatttcccgaacgtcattaaggtaaccgtactcatataaaagagccccagcgtacagctcttcttctcctaaatactggggagtaatgcccatggagtttaaaagctggacgtgtttacggagtatattagcggttttatcgcggtccttggctaagattccggcgtaaactttttcggggttaaagccaaacttatccactaaatttcttagaccaaaaaggatttttttacccgaacctaactggttcatggttttaagagcttttaccagactatcaatgtaagggagcatctggtattcggtgccggtataaaaaagatattcactgtcagtggaaaagttaagtccttcggcccacgaagtaagttctcgcccttttaaccccagaggatttttgtatttgaggatgttctggcgaaccagttcaatggtggccgggggggttattgaaatttctaacataaaaatcccttcctttattcttgtgctcaactctattaaaggagttaactccaaaaaatgtcaataaaattggaaattgtgttatgtatactttttaacggtggtcggtggttggtggtcagtggtcagcaaaataataaaaaaaatcatacctttttacggcggaaggaggaaatgggaagaaaagaaagaaaaaagtaaggggtgaggaaaatgaactacctggatgttttaaggcttacggttttagccggagaaataatgattaaaagcggagcggaaatttaccgcacggaagatgtaatggaccggattgctaaaaattacggggtaaaacgcgtggaaagctttgtgactccaaccggcattttatgcgccatcgaaaccgacgatggacaggtttttactaccgttaggcggatagaaagccggggttttaatttaacgaaaattgataaagttaatgatttttcccgccgacttgccagacggcatattcctgtggaggaaggcatagccgaactcactaaagtagcccacgaaaagagtgaatattcctggtgggtaaaagtcttggcagcaggtttaggggctttctttgcgacgggtttaattggtggcacggtggtagaaatgattatttctttgattattgcgttactggtaaggggttttgtcatggtaattccggaccttggcttatttccctttttccttgatttagtgggaggctttctttctactttgctggtagtagcaatttctaagttttatcccatttccttaggggttaccgtggtaggaagtatcatgccctttattccggggatgagcattactaattccatccgggatgctattgccggggacttcttggccagtcaggcccgggggcttgaagcgtttttaagggttattgcgttagcggtaagtgctgcggtggttttagcttttctaacatagaaatggggtagggaagatgaacgttttgtatgctttttttctttcttttacctttggaattttatttaatgcgccgatggaaagcctcttttacggaggagtaacgggagccggaggttatcttgtttatacgattgcgggcaaaaccccttttgccggagtatttcttggttcccttaccgtgggtgtcctttcggaaattttggcccgtctcaagaaaaagccaaccataatctttaccactaccggccttataccgctggtaccggggaagcttgcttacgatactatcactgcttttatccgggaggattttagcttaggggtgagtttggggttacaaacgttttttagtgccggggctattgctttggggatagccattacttcttcggtaatgcggctttataaaaaagtaacgcaaaggaaacagcgatgtttttagattttttttaccccaagcctaaggtttgtcccctctgtcaaaagccaatgccccaaagggagttttgtaaaagctgccgggaatttatgcaaaaaacccgctttatgtgtcaaatctgcggtcgaattttaccggtagaagtaccgctttgttctgattgccggaaaaatttgtttagttttaccaaagcctccggtcttcttccctataccggtccggtaaaaaaaagtatggctttgtttaagtataaaaataaaaggtacatctgggatgagctttatgaccttttagcagaacactgccgtaaaaacctgggggaggaatttgatttaattattccggttcccctttatcagagaaaattaaaggagaggggttacaaccaggcggagattttagctaaaaacctggcccgccggctaaaattacccttgggccgcgacatccttatcaagattaaagacaccccgccccaggctaaacttggatattttgatcggaaaaaaaaccttaaaggaaactttgcggtaaaggaaaggtttaccggcagggaaaagattcttttggttgatgatgtttttactaccggggctaccgctcaggaatgtacccggactttgcttctggcaggagctgacaaagtttatgttattaccatggcaactgctgtaaaaaaatagcattgtagcaaagattatgccaaaaaaaattttgaaaattcatttgccaataacttatccacaacaaaacccccgattttggtagttatcaacagagttatccacaatatcaacaattttgcttttccacaaaaaatttttttccaacttttttcgacagataaatttatcattgacaaaacatcgttaaaatgctattctcaatacaaagaacgtgagtcgcttggggcttgcgtttagtaaaaagttttaaggaggaattggtttcatgcaaggcaaagttaaatggtttgatcccaaaaaagggtacggtttcattgagagagaggatggcggcgacgtatttgtccacttctcggccatccaggaaaagggatttaagaccctcgaagaaggtcaaagggtggagtttgaaattgtggagggtgcccgcgggccacaagcggcaaatgtcgtaaaattataagggcattaaaccccagggatattctctggggttttttagtaattataatgtgtggagctggttttaaaggttgcaggttaaaataataaaaaaagggggtatttccatgaatgttcaagtgcggggtaaaaatatcgaggtcactcctgcattaaaggagtacgcggaaaagagactcgccaagctggaaaagtatttgccgaaaattgatgtggtgcatgtaacgcttttggtggaaggggatttacataaaaccgaagtaacgataccggtagccggataccttcttagaggtgaagaggaaagccccgatatgtattcatccatagatttggtggtagataagttagaaaggcaggccaaaaaatataaagaaaagctttacgcccgctttaaaaataataaaaatattgcaacaggggagaaaagcgccgaaactacccctgaaccggataatgaaattaaaattgttaaatccaagcgttttgcgataaaacccatgtcaccggaagaagcggccatgcagatggagcttttagggcattcgttctttgtctttaccaatgcggataccgatgaaataaatgttgtatataaacggcgggatgggaagtacggcttaatagaaccggaagtttaaaaaaagtttgacaaaggccgggaaacgtgttagagttagagcatggctttatgccgaataaaattttcaggaggcattagatcgatgcaaggaaaagttaaatggtttgacccggccaaaggctacgggttcattgaaagggaagatggcggcgacgtgtttgtccatttttccgccattaagggcaacgggtttaaaactttagaagaaggccagagggtagagttcaacattgttgaaggcacccggggcccgcaagcggctgacgtcgtaaaactataaattgcccgcaaaacccctccgtttaccggaggggttttttaacgcctaattcggggacggttctgatatttgcgtctaaacgccaaaaaaaccgtcccttatctttttgcggtatgaacgccaaaaagggggatggagttttgaagataatttggattttttagatattatgaggcaacatgcaggaaaattgcggattatagagaattatatctaatagttatgagaggagggtatgcgtggctgttttaagcaaggagcagttagcggagctggaagttttgctgggacgcattaaaggggttaatgcggcccgggtggtattggatgaagagggaaaggttgatgaaatccatatattagccggcagcagtcgaagtcccaagcagatagtacgggatgtagaatcggcccttttagcttcctttaatattgctattgaccataaaaaaatcagtattgcccaggtggagggcggtgatactgaagacgattcccgggaggaaatcagaccccaggtagccaaagtcgatatggctttggagcaaagtatagtgcgggtcaatgtggaattaaccatcggggagtctaagatttccgggacggcggaaggtcccgctacctcccaaaatagaaaaaggcttttggctatagctaccgtttgtgcggtggaaaatttcttaaataaaaacgggatatttgtggtggaggatgttcaggaactttacatatcagggaaaaaagcgatggtggtggcagtggctgccattttaggccgggaggaggaaaattatttaggtgcggcctatgccaacggggatgagagagaagcggtagttaaagcaaccttagccgctatcaatagaagacttcgcttttttgtagaaaaataaaagtttaaataaattttagagagagataaaattttttctttaatgcaggtgttttgctggtggaaggaccgacatatccaaagaccgaagcaagcgcttcgaagccgagcccgagcggaatactgcctgtctgccgtttagccgagggcggatagagcttattcgtaagggagggcgttttcaccatgactgcaagagtggttaaaattctgctggcgattgtcagcttaatcatcgccggtggtgcgagattttcaatgtaattagatttttattatgtcggtcctttaagaaattattgaggtgaaaatatggtagcaataaagagattgcttgataaaaacactataaagttaaaattatattatattattatcggaattataggattgattttatttttaacatattttagatctgtatttaatttaagtggaaatattttgatagcgtttattttctttattttatttgaagcgctttcagaaaaactagcaattaaaatgcctaaagtaggttttgtttcagttgcatttggtttagatgtagctgcatttttaatatttgggtataaaattgcagcaattattgcaggattttcttttttattggattttggacgaattgaaaaaaataatattttattttccttgttgacaaaaatttttaacttgagtcaaataattattacaattactttggctggaattacttataatattttaactaaattttttgttttaaattcctatattacatttttttctatctttatttttgctttcacatacttatttataaatgtgcttttagtttgcttagctgcaagcctttcgttaaatttaccttttatgtatatatttattgataacttcagaggatttattcccaattatgctttacttgcaattttaggttatttaatggctttagtgtataattccattggtattccagggattatacttttcttcataccattaattattacccgctatgtatttaaactttactccgatttaagagaatcctacctttccaccattcgggctcttgttgctgcccttgaagctaaagatccgtacaccaaaggccattcagagcgggtttcagaactggcggtggaaattgctaaggaaatggggttaaatgcagaccaaattgacattattcgccatatggcgcttttacatgatgtgggcaaaatcggtatccttgataccgttttaaataaaaagggaacgctggatcccgaggaaaaagagttaatccaggagcacccggtactgggtgcgaaaatcgtggaggaaataccgtttttaaaacaatacgccgggatggtccggcaccaccacgagcggtttgacggtaccggctatcccgataaagtttccggggaaaaaattcccctcggagccaggattattgctgtggcggatacgtatgatgccatgacttcggaccgtccctatcggtcggcgttgaccaaagaacaggcgatgagcgaactggaactgaatgccggacagcaacatgacccaagagtggttaaagctttattgaaagtgctggagcggtttgatccccgggaaaaagaacgggaagccatggccaaagcagcggcggcggaagggacctgaagggaggaatagttatttatttagaagcactgattttggcgcttattctcggttatctttttaaaggccggctgaaaaacttagccgaattggaatttacggcgcttttttcctttatcttagcttttttaatccagtttcttattgattaccagatggcccatccttttatccgggcctacggcaggtatctccatcttttttcctacctcctgcttttttacgggatttataaaaacatcagacttccggggatggggttaatcggtctgggggtttttttaaattttatagtaattgccgccaatggcggttacatgccggcggatccgcggaccatttcgcctcaatggatagagatgatgaaacaggggattttggggacccatacgttaattaatgagcatacccgtcttgtctttctctccgataatatttatctctggttttatcccataaccttttcttacgggaagcccattattagctttggggatatttttattaccgtaggagttttttggctggtgtttaaaggcatgcgctaccaaaaaaataaaaactacaagcttaccgtatttcgctaaagaaaagatttgcggtagatagttgaaagtggtaaaatgaaaagaagagctatcagggaaccgtaacggttcctttatttgtgcaaagaggtgaaaatatgctgaagtttttaaagaatttactggacgataatgcccgggagattaagaggcttacggcccgggtggaagagataaatagtttagagccccaaatgcaaaagctttccgacgaagagctgagggctaaaaccggggagtttaaagaacgtatagcccgcggtgaaagtttggacgaacttttaccggaagcttttgcggtggtcagggaagcttcccgccgggttctggggatgcggcattttgatgtgcaattgatggggggcattgtacttcacgaaggtaaaattgccgagatgaaaaccggggaaggtaaaactttagtcgctaccctgccggcatatctcaatgcccttaccggtcgcggtgtgcatatcgtaacggtaaacgactacctggcccggcgtgatgcggaatggatgggaaaaatttacaagtttttgggtctttcggtgggtctggtggtccacggcatggattatgccgaaaaaaaagcggcctatctggcggatattacttacggtaccaacaacgagtttggatttgattatctcagggataacatggctatccatccggaccaggtggtgcagcgggagctttattatgctattattgacgaagtggacagcattttaatcgatgaggccagaaccccgctgattatttccggggaagcggaaaagtccaccgacctctactatacctttgccaaaattgtaaagcaattagtgcccggggaagattacaccgtggacgagaaagcgcatgcggttatgcctaccgaagcggggattcataaagttgaaaaaatgcttggtattcaaaacctgtatgctgatgaacacatggagttaacccaccatttaaatgcggctttaaaagcgcaagctttaatgaagcgggaccgggattatgtagtcaaagacggtcaggtaattatcgtggacgaatttaccggacgccttatgttcggccgccggtattccgatggattgcaccaggccatagaagccaaggaaggggtcaagattgagcaggagacccagaccttagcaaccattactttccagaattatttccggatgtacgaaaaattagccgggatgaccggtacggcggaaacggaagaaaacgagtttcgcaagatttataacctgtcggtagtggtaattccaacccataagccgatgattcgtaaggatttgcccgatgtaatttttaaaaccgaaaaggccaagtttaaggcaattgtggaggaagtggcgcggcggcaccagaccggccagccgatcttgattggtaccatttccattgaaaaatccgaaatgttaagcgaaatgctgaaaaaacggggaattccccatcaagtcttaaacgccaaataccacgaaaaagaagcggaaattgtagcccaggcgggaaggcttggggccgtgaccattgctaccaacatggccggtcggggtaccgatattttactgggaggtaacccggaatttttggcccttcaggaattaagaaaaatgggaaaaactccggaagatgacccggaactgtaccgggaacttttggccaaatacaaaaaaataaccgatgaagagcacaaaaaagtggtggagttagggggtctccacattattggtaccgaacggcacgagtcccgccggattgataaccagctccggggacgggccgggcggcagggagacccgggttcgtcgcaatttttcatttcccttgaagatgacctgatgcgcctttttggctccgataacattgccgggcttatggatcgcctgggtttggatgaagataccccaattgaacatccgcttattaccaggtccattgagacggcgcaaaaacgggtggaaaaccggaactttgaaattagaaaacacgttttagaatacgataacgttatgaaccagcagcgggagcttatttacagccagcgccggcgggtgctttttggggaagatgtcctgacctttgtccaccagatgatagaagcggtggtggagcgggcagtcgatacttactgccccgatggcgttcacccggaagaatgggatttaaagggattattggagtacgctcataatgtctttttgcccaaccaccagttaactcccgaagatttagccgataccggcaagaaagctttggtggagtttttggtggaaaaagccaaagaatactacaaaaagcgggaagaagagcttggcggtgagcagctccgggagttagaacggtacgttatcctgcgggtagtggatgagaagtggatggaccacctggatgccatggaccagctgcgggaaggtatagggcttagagcttacgggcaaaaagacccgctggtggaatacaaaatcgaaagcgttgaaatgttcaacaacatgattgctgccattcaggaagatgtggtgcgttatttaatgcggctttccgtggtccggcagccggaaaccaggagggtccggcgggtggtggaaaaccgctatcaggaagaaggaccgaaaaaaccctaccgccgggagcaaaaaattggccgcaatgatccctgtccctgcggtagcggtaagaaatacaagaagtgctgtggcagaaacgggtaaaggaagtggttagctatgttaattgagctgaaaagaagtttggcggagatttcccccaagattgaggaaatgagggtttctctttgacattcccgggaaaaaggaactggtggaaaaacttacggccaaaacctacgagcctgacttctgggataattacacagaagcccagaaaactctaaaagaattaaaccgcctcaaagatgacattgaaaagtatgaagaacttttaaaagcgcaggaagagcttaccgttttattgcaacttttggaagaggaagaaaatgaggagttagccgttgaggctcaggacaaagccaaaaaattaatggaaaaactccaccggatggaaatagagcttttgctatcggggccatatgataaaaattcggcaatagtttccctccatgcgggagcgggaggtacggaggcccaggactgggtggaaatgctttaccggatgtatacccgctgggccgaagataaagggtataaagtggaactaatcgaccggcttttaggggaagaggcgggcttaaaaagcgttacttttagcgtggaggggtttggcgcttacggttatttgaaagccgagcggggagtgcaccgcttaattcggatttctccctttgatttttccggccggcgacatacttcctttgcttcggtggatgtcctgccggaggtagcggaagatattccggaaattgaattaaaggaagaagagttaaaaatagaaacgtttcggtcgggaggagccgggggacagcatgtcaataaaaccgaatcggcggtgcggattacccacctgcctacgggcataacggtggtttgccagaacgagcgctcccagttaatgaaccgggcgttagcggaaaaactattaaaagccaagcttttggatctggaaatgaagaaaaaggaagaagaaatggccaaacttcggggggagcagaaggagattgcctggggcagtcagataagaacttacgtttttcatccctatagcctggttaaagaccaccgcaccggcgttgaagtaggggatgtccagggggtcatggatggcgaaattgacatttttatcgaagcttatcttaaaatgctggtgacacagggaggaaaccaatgaagcttagcgacagagtgcgagcggtaatcgattatttctggatttttgtgggttcggcactgattgctttagccctggactggtttttaattcccaataaaatagctgccggaggcgtaagcggaattgctaccattatacactacctttttgggctgccggtaggtgcggtaatgattgctttaaacgttcccctttttttaatgggttttaaagagctggggttaaaatttggggtccgctccctttacggtatgctggtgctgtccctgctggtggactttttggctccgtatttaaaagctttaaccaaagatccttttttggcctgcctttacggtggtgttttatcgggaatagggctgggtattgtctttaaatttaaaggaagtaccggtggtaccgatttagcggcggcgattttacgccggtttaccaaaacaaacgtcggcatggccctgttgtttattgacggactggtggttttcgtttcggggatagttttcaacccggaacaggctttgtatgctttaattaccatcgtggtgacgagcttgttaattgaccttgtgcaggaaggaatgggctatgcccgggcgtttttcatcattagcgacaaaaacgatttaatttccgaaaaaattattaccgagcttgaccggggtggtacctgcttaaaaggcgaaggaatttattcccggaaggaaaaagatgtgttgctggcagtggttaaccgttcggaagtttcccgtttgaaggaaatagtttaccagattgatcccaaagcttttgtgatagtcactaacgtccatgaggttttgggggaaggctttaaaccgatggttaaggagggaaattagtgcaggacgaaattttaaacttaaagttaatagccaatcaactccgccagcatgtggtaaagatggtgggagaggccaattcgggccatcccggcggctccctttcggctgcggatattttagcggtgctgttttttaaggagatgcggattgatccggctaatcccaaatggcaggaccgggaccgcttcgttttgagcaagggacatgcttccccggttttatacgcagctctggcggaacggggcttttttcctaaagaatggctgtcccaatttcgcaagattaattctcccctgcaggggcatccggatatgaaaaaagtccccggcgtggaaatgtccaccggttccctgggccaggggttttccaccgcggtggggatggctttagggttaaagcttgaccgcagcccggcccgggtttacgtgctgctgggagatggggaaattcaggaagggatagtctgggaagcggccatggccgcagcccattataaattaaataatcttacggcgattttggattacaacggtctgcagatagacgggccggtgcaggaagtgatgaatcctgaaccggttgcggataaatggcgaagctttggttttaaagttattaccgttgacggccataacattccggaaataataaatgccatcgatgctgcccgcctgcacttggaaggtccaaccatcattatcgccaagaccgttaaaggtaaaggagtttccttcatggaaaaccgggtcgagtggcatggatctgctcccaaaccggagcaggtagcagaggctctttctgaacttcaagtggggagggaaaagctgtgggaggaatagccacaagggaagcatacggaaaggccctggttgaattggggcaggaaaacccgaaaatcgttgttttagatgcggacttatctaagtccacgaaaacctccgattttgccaaagcttttcccgagagattttttaacatgggcattgctgagcaaaatttaatgggggttgctgccggtctttctacggtggggaaaataccctttgccagtacctttgcggtgtttgcggcgggcagagcgtttgaaataattcgaaacagtatctgttacccgaagctcaatgtgaaaattgctgctacccatgcgggtttaacggtgggggaagacggagcttcccaccaggcaatagaagatctggctttgatgcgggttttacccaatatgcaggtatttgtacccgccgatgccgcccagacccgtgctattgtaaaaaaagctgcggaaatagagggtccggtttacatccgtcttggccgttccggggtgccggaggtgttttcgccagatattcggtttgaaccggggcggggtacggtgcttaaagaaggtaaagatgtaactatagttgctctcgggattatgacggccaaagcgttagaggcagctaagatgttagaggcagaaggcatcgcggcaagggttgtggacatggcaagccttaagcccatagaccgggagcttttggtggaaagcgctcgacttacgggagctgtggtaacggcggaggaacattcggttattggcggacttggcagtgcggtggcggaggttttaagcgaggagtatccgataccggtggtaaaagtaggagttaatgatgtgtttggggagtcgggaactccgcaagcgcttttggaaaaatacggcttaaccgccagggacgttgtagcggcggtgcaaaaagcgttaaccttaaaaaggtaactccggggacggttctgagaacatccattttccgctcacgaaccgtcctttaatttttttgcttaaaaacaaggaaaaagccataactttgtcgaataaaaaaaggatgaaagcgggggatatgatgctgcagctttttaatgtaacaaaaatctatcccggaagcattaaagcgttaagcgatgttagttttaaagtaaacaaaggtgaatttgtttttttagtgggaaacagtggtgccggtaaatccaccttgttaaaacttatcacccgggaagagcttccgacccacggacaaattttagtcaacgggaaaaacatcgtgcgtttacggggccgggaaatacccttataccggcggaagattggtatggttttccaggactttcgccttttacccaataaaactgcttttgaaaacgtagcgtttgctttagaaatttgcggactttcgggaaagcaaattaaggagcgttcgctgtatgccctggaacgggtggggatggccaaaaaagcggaccgttttccggcagagctttccggaggagaagcgcaaagggtggcgattgcccgggccattgttaataaccccgtcctgcttttagccgatgagcccacgggcaatttggacccggaaaattctttagcaattatcaatctgctaaaagagataaattatacaggaactacggtgattattgctacccatgatgcttttatcgttgattcgttaaagcaacgggttatagcattaaaggacggcaaaatagtacgggacgaagaaagcggggcttatgctggatgagtttaaacctattgtcgtactactttaaagaagcatttaaatcgatttttcgcaacagttttttaagccttgcttcggtgatggtggtttttattaccatttttattttaggggtagcggttttgttaatcattaacgccggctatctggccgatactctccagaatcagttagaaatctacgcttatttaaaaacgggagatgtttcgatagatacccgcgcgttagaagataagataaaagccattgaaggagttgcctcggtaaagtttattcccaaagaagagggactacgaaaaataaaagaaaaattgggcgatagggctgatattttagcagggattgaggagcgaaatcccctgccggatgcgtatttgattaaaaccaaacggcccgaagatgtgccgatcgtgggtaaaaaacttgccacctttccggagtttgagacagtaaaatacggccaggggattgtggaaaagcttttaaaggtaaccacgatgttaaaaatttttggactggggattatttccctttttggattcggggcagtattgttaatcatgaccaccattcgcctggctattttttcccggcgcaaagagatcgaaattgcccgtatccttggggctaccaactggtttgtgcggatgccgtttatcattgaaggtacttttttggggcttaccggaagtttatttgctgcagttttggtggctataggttactactcattattattaaaggtaagtaaagcattaccttttttggtactgtttcgggaccagcagtggttaaccttaacctttgcagctcttgtgggaagtggcggcatccttggacttttaggtagcattctttccctcaataaatacctcaaattttaggagggatagggtgaagaaaaaaattctggcggtagttttaacctttttactattatctacaacttcccttacttacgctgaaagcttaactaccaagttaaaaaagacccggcaaaaaattgccgtgacaaaaaagaaaattgaagaacgaaaacttgatattaaaaattatgccgatgaaattgcacggttggatgcggaagtggaaaagcacgaacagcagcttttggctgtttcccgggatttgagtgaaataaaacgaaagattacggcaaccgaggaagagctggctaaaaccgaagaattgttaaaaaccaataacgaactatttgaaaaaaggttaaaagatttttaccaaaacggaacggttacctacctggaaatcctgtttcaagcggaaaatatttttgactttttaaaccgcctggaatttatgagccggataattgagcaggatattcaacttttaaacgatattaccaagcaaaagaagctactggaagagttaagagaacagcttttacaccaaaaaaatgagctttccctcttaaaacaaaaagaagaagaagcccagaaaagtttattagctgctcaggaggaaaaggtgcagttaatcgagcttgctaaaaatgatgtagcccgttaccagcaggaagtggaaaggttggaagaggaagaacaaaagttaatccaggaaatcgtccggcagcggcagaagtcccggccttccatgggtagcggtatctttaagtggccggtggatgggtattacaatatttcctcgggctttgggatgcggtttcatcccatcttaaaagttaaccggatgcaccaggggattgacatccccgcacctacgggtaccgatgttttagcggcccagacgggggaagtgatttatgccggaaccatgaagggttacggtaaggttataattgtagaccatggtggcggtgtttccacgttgtatgcccatctttccgctatcagggtttccgttggccagcgggtggaaaaaggcgaacatataggtgatgtgggcagtaccggtttatcttccggcccgcaccttcacttcggagttcttgtaaacggtgaatatgtaaatccaatgcagtacctgtaaaaggcacggattatcccgtgtcttttctttgtatgtagcatatcttggagaaaagtgatagtataatattattaatgcatttacaaactaaagcagcggctgtgaggtgcatgtaattgtccaggaaaaaaattattgctttagtagtggttgtcttcttactctgggggatattttcgttagccggtttattctggaaaaagagcggggataagatagagactttacttacggtaattgctttaattaaaagccagtattatcagccggtttctaccgaaaaacttataaacggtgcaataaaaggtatggtcgaaggcctggacgacccgtattcgacttatcttgatcccgaacaatttaaacacttaaacgagcaaattaccggaacttttggcggtgtagggttgattgtgacgatggaagaaaatcatattgtggtggtaaagcccattcccgatactcccgccgccaaggccggtatcaaggcgggggatatcattgtaaacatttccggcagggataccaaagggatggacctggacacggcggttagtttaatgcgaggtccggtgggaacccgggtggaagtaggaatattgcgacccggtgaaaaagaaacccggatgtttacgttggttcgagaaaatattaccattcccaccgtggaaagcaaaatgttagatgacaagataggctatattatgttatcccagtttaccgaaaactcaccccaagcggtgcgaaaagcaatcggagatttaaagaaaaaagggatgaaaggcttaatttttgatttacgggacaatcccgggggagagcttaaggctgcggttgagattgctgatatttttgttccccggggaaaaactattgtgtatgtggattaccggaatcagccggatgaagaggaaaaggcagaggtgccggagttaggaattccggtggtggttcttgtaaacgggggcagcgccagtgcttcggaaattgtggccggtgctctgaaagattggggagtggcggttttggttggggaaaaaactttcgggaagggtgtggtgcaatcaatcttcaggttaccgggaaatgccggtttaaagctaaccgtagcccgttacttaactcccaagaagcatgacatcaacaaaaaaggcatcatgccggatgtagtagtaaaacagccggcgggaagcaaggaagaccggcagctcttaaaagccaaagaaatattggcggaaaagattaaataagcgaggggctttcatgatttgggtgaaattagctggtaataccctttataccgtgtttttagctttaatggaaaatccggtattctggctgttagttttaattattgctttgcagtattcccgcatctcgggaaaatttatcctgtcaatggatgtgatttacgatactttaaaagctactgcccacggcataattggcggaatggctggaagtttggttttggtgtttctcgggattgctttaaatgaggcaggccttagctatctttggcctctggctattttgtttatgcttataaatccccgctttttgtgtttttcctatgccggtggagttgtttccttggcctacttaatttttggctttcccaaagtaaatgtagcgcaaattgcagctttagtgggagtactgcatttagtggaaagcgtcttaattttaataggagggcatttgggggcaaagccggagtattttaaaataaaaacaggacaaattgtcgggggctttgttttgcagcggttttggccaatacccctggctgctttagtggtggtgaaccaagtcccgggggtgtccggcggaattcagatgccggactggtggccgcttataaaaagcagtgaagttgcaccgaatcttatgtattccttgattcctgtggtggcgggattgggttacggtgatatggtgcttacccgctaccccgaagaaaaaagtagactatcttccctgtatcttgggatatatagtgtaagtttaattattctggcggtgctggctatgaaacttagctttttaacctggcttgctgcagtttttatgcctttagggcatgaagcggtaatttacctgggaagaaaacttgaagaaggtaaacctatttttgtaaatcccgaaaatggtatcggggtaatggttttaggggtcagggccgggtcgatagccgatgcagcgggactcagaacgggggatgtgattttaacggtaaatggaatttatattcactcgccggaagaacttttccgggaacttacctatgcctacggaatggtacctttggaagtatcccgcaggggcagccaccgcattgaaaccttatatttaaaaaagtcttttttcccggtggatgtgggaatcatgactgctccttcgccttatgatccttatatcgatttaactcaaaaaagtacaggggtttttaccaaaatatggaacagattcaagggcagttaaaaagttataaattttgtagataataacccttctctttgatataataagtttaaacaaaagttgggagcgtgggattttcatgacggaatttaatacccccttaggtacggtaattattgaaaaacacgaaaagggtgatacgttagccaatcttgacatagacccgggcttatccaatttccgtccctaccggcggcaaaaagaagcattaatcgatattgccaaccagccccaggggtgggtggtgattgccaggcttgataataaaattgtcggatatgttacctttcatccccccgatgaatttacccggtggggtaaagcccgtctacccttcttgctggaaatgggagccatagagataacaccggacctaaggggaacgggactggcgcgtaagcttttaaccgaagctttttccgatccggttttggaaaaatatatcgtgatgtctaccgaatattactggcattgggacttaaaaaataaagggatggatatctggacgtaccaaaaaatgttggaaaacctgttttccagtgccgcagggatggagagggtttataccgatgacccggaaattacttcccatcctgctaacatgttgatggtgcgctttggcaaggagttgactccggagcaaatagagcagtttgaaatattaaggtatgcggggaagaaaatgttttagggaaagggtttactttccctaaaaatttttaggaaaaatttacagaaaatttataacattaagaggtggcgggaatgttagttaaagacattatgacccgggagctaattacagttaaaagtaccgataccatccgggaggccatggctaaaggccatgaaaaacgcatccggcacttgccggtggtagatgatggaaagttggtggggatagtttcggaccgggatttgagatatgcctgcccttcgccttttacaggagaaaaaaatggggaatgctggcaaattaaagtgggggatattatgcaaaaaagggttgttactgctcatcccctggatcctgtggaagaagcagcaaaaatgatgctggaaaaccgggtaggatgtcttccggtacttttagatgatgagctggtaggaataataacccagggcgatattgtcatggcttttgccgagctaatgggggtttataaaagaagttcgcggattgaagtccaggttccggaccggccgggaatgttggccgaggttgcccaaattatgaaggaactaaatattaatgtggtgagcgtgtttttggctccaaaaaccgaaaatggtcttaaaacccttgtgatgcgggttgaaacgatgaacaccaaaccaatcattgaccgcattcgggctaaaggatttacactgatcaacccctttggcgaggtataagtaaatgagcggaaaggcgtatttaatatacagcgacgactatttaagttaccgcttagcggaagaccaccccttgaatccccagcggtatgctttagctgtggaattgatgaaaatagctgaagttttaaaggaggaagaaataatcccaccccgttcggctacgttaaaagaactgtatttggtacacgacccggcttatgtggaagcggtaatgaatttaagtaaaaatccggaaaacgtgaacggcagccgctttggtctgggttcggaagacaatccggttttttccgggatgcacgaagcagcggcgctggtggcggggggttcagccctgggtgcggaactgatttatgaaggagaagcggaccacgttttcaatatagcgggagggctacaccatgcccttcgggatgctgcgtcgggtttttgcatttataatgatttagcggtagccatagccaagttcagggaaaaaggactcaaagtggcgtacgtagacctggatgcccaccatggagatggggtccagtggcttttttatagtgacccgggggttttaaccatatctattcatgaaacgggaagatatctcttccccggtaccggttcgataaccgagttaggggaaggagcggcttacggcaccaaaattaatattcctttagagccttataccgaagatgattcgtggctatgggctttggaggaaattgttccggagcttatcagaaagtttaaaccggacatcctggttacccagcacgggtgtgattcccaccgctttgaccctttaacccatttagccaatactactttggcttttcaggaatcggccaagctcttacatgaattagcccatgaagtctgcgggggacgctggcttgccggcgggggcgggggatacgactactggcgggtggtgccccgggcctggacaatagtttgggctgagatgaccgagcgctctctaccctatgatgttcccgccactttctggcgtaaatatgagagtaaagccggggtgtttttaccgagaacttttttagatgaaggaagttccgggattccgttagggcgccggcgggaaattacttcaaaaaaccaaaggacggtggaaaggttaaaaaacgctttaactctcttttggagttaaagcatttttttataaaaaggaggttagcaacagttggaattaatattgcaaaaataaaatttaaaaaatattttgaagaccgccaggactttcggtaaccgcttcaattggatttacccaactcttagaggttgggtttttcttttgcctctggtacaattaaaatctggaggtaatttgtatgttaaagaaactaaatgattacctttatcggttgcccaaaaccggcaagatgcaggtggaaggattaataattgccagcgaaaagcttttaccggctttataccgggatgaatcgttaaagcaattgcaaaatgcggcatcgctaccgggggtttaccgggcggtttacggcatgccggatttacatgagggttttggtttgcctattggtggagtaatggctacggtcctgcccgagggtttaatttctgccggggcggtggggatggatataaactgcggggtgcgcttactgactactccttttttagccgaagagatttcccgggaaagacttgccgaattaataaaagccattgaaaaatacgtgccggcaggagtgggcaaaaaaaattgggaaaaagaagtaaggagtcttttgcccaaagttttattaaaaggagctcgggctttgttagaagagggatacggttttgcggaagaccttaataaaattgaagaaggcggagttttggctggagcggagatcaaagctttatccgagacagctttatcccggggtgcggagggacttggaactttaggtggaggaaatcattttattgaggtgcaggtagtggcggaagtaaggcggtgggaggttgctcagagttttgggttatatccggggatgttatgcttgatggttcacaccggtagccgcgggcttgggcatcaggtttgtaccgactataccgaaattttatataaagctggaccgaaatacaatgtcagtgtaccggtaaaaggtttggcggcggtaccgttttcttctcctgaaggacagaggtattatcaggcgatgttggcttccgcaaattttgcttatgccaaccggcagcttattacccattacttaagacaggtgtttaagtcatacctcggagacggaaagcttgatttagtttatgatttagcccataatattgctaaagaggagtaccacgatgggatcaaggttttagtccaccgcaagggtgctaccagagccttaccggccgggcaccgggaaaacttacctcaatttcgggaaataggccagccggtattaattcccggaagcatgggtaccaaatcgtacgtcctgcgggccacttcaaatatttctttaacttttaactctttaaaccacggagcgggtcgcagtatgtcccggaaagcttctttaaagaacttgacggtgagcgaagtaaaaaaggcgttaggagatgttattttaaatgaaaaagtggaatacgtgcgggatgaagcgccgcaggcgtacaaggacatagatttggtaatcgaggcggtggtgggggccggtttggccgaagtggtagcggttttaaaaccgcttgcggtgattaaaggtaaggattaaaaaaagggggatttttatgtgtgaagccagtgcttttatcgtaaatggggataaggaagagctttttttggaacgggtggataagcttattccgacagaagagggactattactggaaaatatttttggccagagaaaagttattaaagcaaaaataaagcgtttggagctggtagaccatcgtatattactggagcgggaggattaatggaggaacttaaagcattaaaagaagaggcgttggcctgtcagcgttgcaatcttagagcccatgcccaaagggttgtgtttggggagggaaatgaaaaagccctattaatgttagtgggggaaggacccggagctgaagaagaccggcaaggcagaccttttgtgggggctgccggggaacttttaaataaaatcttagaagccgcagggatttcccgggaagaagtttacattggcaatgtggtaaaatgtcgtccccccaataaccgggttcctaccagagaagaagtggctgcttgccgaacttttttagaccggcaaattgagttaattaaacctaaaattattgtttgccttggggcaactgctgcccagacgttgattgggccggatgttagaattaccaaaattcgcgggctctggcatgaaaaaggtgagataaagataatgccgacatttcacccggcagcgcttttacgggatccgacgaaaaaacgcccggcgtgggaagattttcaaaaagtccgggatttatactttgctttgaaaaaagagcaggaagtggaggagtttgaacaattaaaattgttttaaaaaagtaacattaagcccctgacctcgtttcaggtaaggtcaagggcttatttattttatattagtttcctatagttcttttaacttttttagctcttccacaagcatgtttaattcgtcatcgtctttggcgtaataaagagctccgggaccacagtgattgacgcaggtaccgcagttctggcatttctcccgatcgtattttaaccttttttcgctgtggtcaaagtatagagctccgtacaaacagtaagtagcggcgggacagtcttcgttctggtcgcaaagatctaagtcaatgtgaataggcatacggtacacccccaaaaaattcataaaatttaaaattattaataaaagtataacatatctaaagtataattgaaagatggttgggccaaaataaaagcaaccttagaggttctaaggtcgctcttttaatcccagtagcgaaataaatttggaagcaaaggtttcccgggcttttgtgatttttgttaaaaaggcggttagttcatcggcggtttcaaacaacgcaagggcgttataggcgcatttctggacgcattggccgcagccgttacagaggtcaacattgaaaaacagcttattttccctgctatcgtaaacaagggctttggtgctgcagacctcggcggcagggcagcagggttccctaaggcaaacttcgtggtcgatgtacagtgtcacgcgaagccctcctcaaagctattgataatgttatataacacaataaaactaatgttttctatatgataacagaagaatggagagttgtaaaggattttatggataatcccccttgatttatctcaaaataaaaacgaaaagggggttttttgatgaaaaagctctggattttttgtttaatcgttacgttattggttaacctgaccggttgccccgataagaaaagaagaccggtcctaccgaaggtttttttggtagttgccaaaacccagcaggaaagaaaaaacttcattcaaaccgcatataatttagccagggaaaaaaagattgctcttacggtaagagggttaaatgacgatgaaaagcgggaagaaaaggtcttaaaaaagatcattgcccaaaagcctaaaggggtgatttgggaaacggcaggtagtccccgggccgggtatttagcgcaaaaaatttacccaaaagcaaaattaatttttataaacgatgtgccgtacgatggtcttggggattgtgcggtgttgcccgatttccaaaaagctgcggtgatggtggctcaaaatattgctcttaaagataagaccgggaaagtgctgcttctggggagccaccggcaaaccctttcggtatttaccttggagaaggctttaaaaaatgagttaagaaccctgggtaaggaagtaaccgtcggtaaacttccggttgtggccggggaaagggcattggacgaaataaggaatttggcaaggagtcaaagtattattgcccttgacggaaaagtaggggaacttttagcagaggagggaatgaaggaacagcagggaacggttatggcttctatggtgttaaccaggaaggttgcaaaagccatcaaagaggggaaaattctttcgtctgtggatttcatgccggaaattgtagcaaataaagccctggaagcaatggaccgggtattacaaaagcgggggatagatgcggatagcaaaattgcggttaaaaatggccaaataccggttatttatacacccgtgcagctcattacccgggaaaatgttcaacaactccaaaaggcttacggaaaatttacttcttccacgccaaaagaaaaggaagaaagcaaaagcaaggagattaaaacaacaaaggtaaaaataaccacaaatcggggtaaaaccgttgagcttacggtagaaggagaaataaccaaaatagaaacaagccctgaagagggaaaaaaagatgaacaggctggccaggaaaagaccggagaagaaagcggtgttggtcataaccggtaaatttattaaagaaaaaatttcttttgctgaaaatattaataaattttggtataattaccttagtaaggtaaaaaagggggaaggggccgtgcgattgttttggcaaacttttttagcttttatttttaccgtttgcgtgctggtgttaccggcgatggatattgaaaccgcaataatcagtcaaaaaccggaaagttccgcaatcaccgcttttaaatccagcggttccatctttgccaggatgggggatgttggtttaaaacgggccctgacttctggttacgttcagaaaatcggccgggaagtagctatctttccccatatcttcgtagtggatgaacttattgccgatgcaaccagggtagcggtaagcttttatttttactccgaaaaacagccggtagataatgaaatggggcgtttggaggtggagcttgatttaccgggagcttttaaacattcaacttttaccggtatgcagggggagaacgggggtttaaacggttatgtattttccgaatataccggaaaccccaggggaatagtggtaaaagggaaatataaggatttttccggcagtgaacaggagtttaacataaaaattccgtttaaactaacggcaactaactttaaggaaataggattaaataagaagcttgggggaagcccggaagtagaactgggaaaaattatcttggccccgacccagtgggtagtagtggtgaatttaagaggaagccgggaggagcttgaggcttttcgcaatttaaacttaccggtgaaactttacagcgatggcaatcccttagaattgttgggagttgggtcaagtttgggaggaatcccgcctaagttggatgaatacttttacttccaaccgggtggacaggagaaaggagctttagtgggagtttcctggcccgatggtaattaccgtgaaatgtatgtagattttaccgttaactcccggcaaaagccgaaggtagagattacaccgtttaacgagaacatacccggggaaaccttgcccaagactcctccggaaagaaaggaacagagctcggtaccggtaagtaagcctcttacgggtatcgaatgggtaaaggaaaactgtaaaaagcttttagcgtggataacggagaaaaactacggaaaaattcgggaaattgccgaggaacaggtagtactggcgataaaggatgttttttccaatttccagaactataaattggagcttgtgaattttaactaccaggaaaaccaaaagggctatattgtttctctttatgttgaaataagaaatgctcaagataacagctatcttggaagtagcgaactgatgttacagtttacccgtaagggagaaggttataagcttattaaattcagtaaaaattaattgacaaattgatgttttttggttattataaaagcgaagggaaatgtcccgcttcctttttccccaataatgtgaaagtaccaacaagcaccccctctttttgggttatttcaccttttagaaaaaccgctttttaagcggttattttttttgtataattttagcgtggggggcgggagaatgcgggatgcctggtcatttttcaacaaaattaaaaacttttcccaggaagagtggcaaaggtaccaaagagaagtgcctttaaaactcgaagaagctgcagttaaagttgaaacttcggaactaaagttattaattttgtatttaaagtacttctgggagatgttttttgatgaaagctatcgcatcgaagccaaaacaaaacttatcattttagcaggcatcctgtattttgcccttccggtagatattataagtgactttttaccttttttaggttttttggatgatgcttttgtttttcgcctcatttgggaatttatcggagaggaagtgcgaagatacgcaagttacaaagggtatgagttaccggaggtccaattagatattaaaactttactggagaaaaaatttggagtaataagggatttatttaaaatttctccctttttactggccttaaaactcgaaaataaagtggaagatttggagaatttgttttacataagtcgggaattttttaagcataaccgcctggccaatgtccttagaggaaaattatatttttccgaaagctttttaaatggcgtgataaaagagctgccccgggacttgccggtggaaaatttgcgggtggaggttcggggcgatgaattatggtttatggggaagattgaccaatataatttagattttcggcaaaaaataaatatggtaaatttaacggcagaaaaagaccggattttaattgaatttgacttaaaaggaatgccccaaatagagtttaaaggggcctgggggtttttataccggttttttgcgccggtggctggtttttgggggatacgtaagtttataaagcttaatcaacaccgttttcccggaataactttagaaggcagtaagcttaaagttgatttaagtttttatttaaaaccggataatttaaaggttatggcgttactaaaatttgcggagaagcttccgcctttaaccgccgtacctcagaacgggcttcttgtggtaaaaataaacgaataggaggcgatattatggctaaaggacttaattatttagcaaattcggtagcgttactgggttaccgggaccgggagcaggggaactttactaccgttgcctggataacccaggtatcggtgaagccgccgatggttttggtgaatgttgctccgggaagatatgcctaccaaaaaataaaagagtccggggaattcaccttagcaattttaagcgaagagcaaaaggaaattgccgatttttgcgggaaaaactccggagcaaaagttgataagatcaaagagctaaatcttccggtagtacccggggaaaaagtttctgctccgaaacttactaccgccattgctaaccttgaatgccgcctggtacaggaaattcctgtgggtgaccacattgttttagttggggaagtagtggcggatgatgttcccaatcccgctaaaagaccgcttatttttcaccagtggaagtaccttgactaatctttagtgataattactctgctccagaggggtacctgggggaataactcttcaatatctttgtttaacatgcggatgcaacctctggaaacctcacggccaatggaggctggattattggtaccgtgaattccgtaattacctccgggaatagttaatcccatccagcggcttccgagaactccgtaaggactacccccgggattgctgattttgtttttaatccggtagatgccggtaggggtgggggtgctgggggctcctaccgctaccggccaggatttaattttttggttgtttttatagagggttagaagcttcttttttagactgacggttaaatggactatcattactttcgcctcctttccggggtgatggggaggaaaaaagttgttaatttttgcgccggctaaaataaatctcactttagatatattaggaaaacgtcccgatggttaccacgaactctggtcggtaatgcaggcaattactctgggagatttagtggaaattgaaccggcagagggaataaacttaagggttgtaggggcagatttacctgtggattctaccaatattgcgtttaaagctgttcaggctttaagggccgccactgggaaagccataggagccagcattactatccgtaaaaaaatccccttagaagcgggactggccggtggctcggcggatggagccgcagttctttatggtttaaataaactttataatttaaatttaagtcaggaagagcttttagaaattggggcaaaaataagcgccgatattcccttttgccttaccggtggcaccgccctggtgcaggggataggggaaaaagtaaaaaaacttccgcccttaaaaaaaggttattttgttatctataaacccccttttgggatctcgacaaaagaagcttatttaaggcttgcgggtaaggatttaacaaaggagcatcctgatcgcgaaaaaatcctgaaagctttaggcaaagaaaatttagaggatttgggaaagtttttaaagaatcttttagaaataagtgctttggaaataaatccggaaatatataaatataaaaacgaacttttaaatttaaaacctttaggggtgctaatgtcgggtagcggttctgctctttttgctttaacggaaaatttaaaaaaagcgaaggaaatttattatcaattgacattgcctggacaaaaatttattgtccgcccgtatgcggccggtcctacttgcttaaagctttaactccatagtaaaatataataatacaaattatcgtagaaatgaggggttaaaatggggagattaaaacctattatccttgataattacaagcctttaagggagctggtttttgagaccttaagggaagcaattatcaatggagtgttaaaacccggggagaggttgatggaagttcagctggcggaagagctgggcgtaagccggactccggtgcgggaggctattagaaaattagagctggaaggttttgtggtgatgattccccggaaaggggcttatgtggcggggatttcgttaaaagatgtggcggatgtttttgaagtacgggcggctctggaaagccttgccgcaggccttgcggcggaaaggattaccgacgaggaaatcgaggagttggagcgggtattggtgcagcaacaaagcctcgcggaaagtgaccgtctggaagatattattagagctgacaccgattttcacgaggtgctttacagggcaagccggaatgaacggctcatccaaattgtaagccatcttagggagcaaattcagagatttcggactgcgtctctttcccagccgggacggctgcggttagctttagaggaacataaagagatagtggaagcgatagccgaacggaatgtggagaaagcccaggcactggccagggaacacatcgagaatgccgagcagagcatgattaacgggttaaaagaaagaggcgaattaattggtgattaatgcgctggtattggcgggtagtcaaaacaacggaaaactggcccaaatttgtcccgagccgtatgaagcgttaatacccctgaaaggccgcccaatggtggattatgtggtcgatgcgctgttaaaaacttccaaagtcaataaaatagttgtagcggggcctaaagagcttgccggaaggtatccggaaggcagggttcgggttgttaacgggggcggctcggtggtagaatcggtccagcatggttttgcggtcttacccaaggactcaatgactttggtgtcaaccagtgatattcctttactaacgccggaggaaattgaagattttcttaagaactgtccggatggatacgatgtttactatccggtggtgtttaaagaggctattgagcaacgggataaaacggttaagcggacttacgtaacgttaaaggaaggtacggttaccggaggaaacctttttttggttaatccgcggattgtcgaccaggccatagtaaaggctcaggatttaattaaacttagaaaaagtccttttaaacttagcctgcttttaggaataggttttgtagtgaaatttttaaccaaaaggctttcagtaaaagagttggaagaaaaggtcggaggtttactgggaatccggggcaaagcggtattttccaggagttttggcattggggttgatgttgataaaccggaagatctggaggtagccttaagacatttgccctaaggggggcttttttctttttgaggaggggattaagtggtagaaattaaagatgttcaggaagcaaggattaggctattgggggttgctcaccgcactttaaccgcttattcggcaacctttagccggctggcgggagcggaagtgtattttaaatatgaaaacctgcaaaaaaccggttcctttaagctgaggggagcttataataaagttgccagtctgcccgtaaaggagcgggaacggggcgttgtagcggcctcggcgggtaaccatgcccagggggtagcttttgcttcgtttagtgccggaattcccgcaactatcgtgatgccggaaggcgctccgctggctaagattcaggcgacccagagctacggagcaaaggtaattttacacggggttagctatgatgatgcttttttaaaagcgaaagaaatcatggaaaaggaaggagcaacttttgtccatgcctttgacgaccccaaagtgattgccgggcaggggaccatagccttagaaatgctcgaagatgttcctgaactggatatgctggtggctccggttggtggtggcggactgatagccggtcttgcagtggcagcgaaagcgataaaaccgcatctgaaagtcataggggttcaggccaagggggcaccatcggcgtatgcttctttaaaagaacgcaggaaagtaacgttggcttcggtgtcgacaattgctgacggaattgccgtcaaaactccgggggagttgacctcgaaaattatttttgatttggtagacgacattgtcctggtggatgatgaggaaattgcccaggcaatattaatgatgttagaacggggtaaagtaatgttagaaggagcaggagcggtgggggtggcagcgcttttagcccagaaaattccggtacgggggcataaagtcggcgttgttttgtccggtggaaatatcgatgttcataccatctcgatcataatcgaacggggtctggtaaaatccggtagatatgtacggataaaaactattttagatgataaaccgggagccttacaaaagcttttggagttaattgccagggaaaaggccaatataatttttatcaaccatgaccgcattgctccccacgtgccgataaagcaggcggaggttgagctggctctggaaacaagggatttatctcacattgaaaaaattctggcggttttaagagaagcgggttatcagattctacaaaattaaggagggctttttagtggaaggaattatcttagcggccggtaaaggcacgcgaatgaaatcggatttacccaaagtagtacacgaagttgccgaaaaaccaatggtattgagggtgtatgaagctttagttggtgccggggttaagcgggtggtcgcggtggtgggctaccgcaaagaaaaggtggaggaaattctccgcggccgggcggtaattgcagttcaggaagaacagttaggaaccgggcatgcagctttggtggctatgccttacgttgaagacgagaatgttattattgtccccggagatacaccccttttaaaagcttctacccttcaagctttaatcaaaaaacatcttgagaccggggcttatgccacggtattaacctgttttttaagtaatccctatggttacggccgtattgtccgggacggatacgggaaaataataaaaatagtcgaggaaaaggatgcaaccctggaagaaaagcaaatagcggaggttaacacgggaatttactgttttaatacaaaaattttaaaagaaatcttgccgttattaaaagcggaaaatgcccaaaaggagtattacctgaccgatgttattccccttcttttagaacggggtaaggtagttgaaacgattactatacaggatgaaacggaagtttatggggtaaatgaccgggtgcagcttgctcgcttgaccaagggagtttaccggagaaaagctgaggcgttaatgcaggaaggggttacaataattgacccggagaccgtgtatattggtgaagaagtagtggtgggcagtgatacggttatttatcccaatacttaccttgaagggaaaacggttattgggagtgggtgccgccttggacccaatacccgcattaccgatagcgtgattggcaacaataccgaaattactttttccgtaattatccaggcccgggttggcgatgaggtgaacgtgggaccgtttgcttatcttcgacctgggaccgaaattgctaacggggtaaaaattggagattttgtggaaattaaaaaatcgttcattggcgaaggctccaaggttccccacctgtcttacattggggatgcggtagtgggtaaaggagttaatattggggccggaacaattacatgtaattacgacgggaaaaataagtgggaaacggttattgaagatggagcgtttatcggaagcaataccaatttggtggcaccgataaagattgggaaaaatgctgtagttggggcaggctccacattaaccgaagatgttccggaaaaagctttggctatagcccgttcccgccaggtgaataaagaagattatgttaaataatatttattttttcgttaaagcggcaggaagttttcctattgtaggagaataaaaaaactgtcgaattttgctcggaacatggattaaagtaaatggaggtttaaagatgagccgctatgatttaaaaattttttccggcaatgccaatccagatttagctcgagaaattgcttcttttttgggagtggaagttggtgatgcccgggtttcccgcttttccgacggggaaattcaggtaaaaataaatgaaagcgtccggggggcggatgtatttataatccagccaacctgtacaccggttaatgaaaatttaatggaactgttgatcttaatagatgcgattagaagggcttcggcacgcaggattactgcggtgctgccgtattttggttacgcccggcaggaccggaaaacgagagcccgggatccgattacggcaaaattggtatccaatttaataaccgtaagcggggcgcgccgggtgattgccatggacctgcatgccggacaaattcagggcttttttgatataccggttgatcacctggtgggcgtaccgattttagccaagtattttaatgaaaagggtttggaaaataaggtggtggtttctcccgatttaggcggggtaacccgggcccgggatttggccgagcggattggggcgccaattgctattatcgataaacgccgcccggaacccaatgtagcggaaataatgaacatcattggagaaattgaagggaaaacggtgattatgatcgatgatattatcgacaccgccggtaccattacccagggagcgcaggctcttatggaacggggggctaaagaagtatacgtatgctgtacccatcctattttatccggtccggcggtggaccggctggccaacgctcccattaaggaagtagttgtaaccaatacaataccccttccaccggaaaagaaactgcccaaaattaaagtgttatcggtagcacccctaatgggtgaagcgatccggcggattcatgaagatttatcggtaagtgagctatttgtttaatcgtcctgctttttgattattgccttgccacaccgggcaaggttttcttttattttggaaaaagtgtggctaatttttcccggaatgtaggtaagggcttctcttccttccctcttgacaacaacggcatctttgccgatagttaatatataggagctttctaaatggtaactgcgaccaagacgcattaaacccggggcgatgattatttcggtaatatctccggtagaaagttcaaaggtaaagtttaccatttggcccaggtaacttccgtcttccgcaatgactttttggccaaagagccggggaccttttttccatagttccacaagcccggaagactggtcgggtttttttaaagcatctttacttttaatgaggactaccttttcacttaatgcttttatttcgttaaaaggcaggagttttatccccggtaaaaaattgcgactgaccactaatagacctgcaacttttcgctcataaggctccactaatagctcttttactgttccggtgataataccgtcgtaagcggtaattaccggaagcccttggataagccgtgcattcccaaaataccacctcccggtccctctttaagttacatttattcccagttcatgttttttagaactaaaattcgggaatactttgtaagtaaggagggatgtaaaaggtggaaaaaattactgcgagtgtacggttgaagaaaacccggggagaacggaaccggcttttaaaagaaggcaaagtgcccggagtaatgtacgggaaaaacattgagccggtggcggtggctgttaatgcccgggaacttgagagtttggtagagcggggcttaaaattatttgagctttccgtggaaggaaaaacccagagggtactggttaaagagctacaacaccatccggtgaccgggaagctaatccatgtggattttcaggtggtagaaagcggccggaagatccggcaactggtgccggtggagctttatggggaaccggcaggggttaaagccggtggtatcttggagcatggtctttcggaagttacggtggagtgcctgccagaggatctaccggagtttattgaagcggatgtttcaaaacttgaggttggcgattgtctgagggtaaaagatttggagctacctccgggtgtacgcgtcattgaggacccggaaagcatcattgcgttaatatctgctcccagggattatgttgaagaggaagaggaaacaactacctccgccccggaagctacagcttaaaattttcgtagggagaggaaaaatgtttatcatagcaggattggggaaccccggacaggaatatgaaaatacccggcataatgccgggtttatggttgtagatgagttagctaaaaaacatggaatattaataaccaaaagaaaatttaaaagccttgtcggtgaaggggaaattttaggggtaaaagttttattgcttaaacctcaaacctatatgaatttaagcgggacagcagtccaggaggcggtttctttttacaaactccctctgtcccgcttagttgttgtttatgatgatttagacttgcctttagggaaaattcgtcttcgtttaaaagggagtgccggcggtcatcggggaatggggtctattattagttgtctgggaagtgaggaaataccccgattaaaaattgggattggtcgaccggcggtgggagatgttaaggattatgttttacagccctttaccggtgccgagagggagattttagagcctacccttaaactggcggcggaagccataaccgtagctctaacggaaggatttaataaagcaatgactgactttaaccggggaggttaataatttacaaggtggcttcttttttttatggttttttggcagcggtgctggcttatggggtaaataaacttttagtgcgcttgctaacaaaggagaaggtagcgttagtagctccttctatcgaagaatgtctaaaaacttttttggggctctttggtcagggaaacatcgtttttacccatttcgcttttggttttgccgaaggcttgtacgacttaataaccgcccgccagaagtatctggcgttttttctgagtatcgttacccataccgtttttggtattattactttaagtataactgaaaaatttaccctttttttaggtataagtaccgccgctctgggccatactttgtataacctgatagttttaaaaatggcccggaggtaagcgatgattatccatgtttgtgacttttgccaaaaaacctacttcttcaaaggaagttccacaaaaatttcttacatacgggggatctgtcccgattgccaggaggagcttttttttgaagaaaaatcgtattttggccgaccagttattcattaaaacggaggatgtagtgtgagtaaaaatattttttctttaatgcaggaaaattcagaatttaagcgccttttggaagggataaataaaaaacggattcagttaatttacggttcttacggcactgcccggacctttttaatggcaactgttgccaaagccttaaaccgtccccttttggtgattaccgagaatgaacaggtggcccgggaaattgccgaagatttggagtttttcctgggcgataaaacttcccgctttttttaccgggagggttttttatttgacctgaccgtgcgggaagggggcgagttaaaggcttcgagaattgagctattaaaaaggctatcccggggggaaaagccgcatacggtcgtaaactacgaagctttaacccggaaatacccgccgctgcagagctttgcccgctggaaaagggagctcagggttggagatgtggttgagcttgaggaattgatccggtatttaagccagatcggttatgaacgggtggaccaggtagaagcgccgggacagttcagccagcggggtggaattgtagatgtttatgttcccggtgaggtgcctttcagggcggagttttttggtgatgaaattgattccctgcgggctttggatgttgaaagccagcgttcccaggccaatttaaacgaagtggttatttatcctgccgaggtagctgttgccgaagaagacctgcttttagaggtaaaacaaaaaattagtgcagatattgaacaacaagttaaaaaattaattcagcaaaataaacgggaagctgcaggtagattaaaagaaaaaggagccgaggttttaaatattctgggaaaaagcgaggtaattgaaaagctattgccgtacttttggagcggtgtctcgcttctggattattttggcgacgaatatcttgtttttttagatgagccggggagatttggcgagcaaattaatagtttggagaaactgcgccgggaaagttttaccgaagcgcttagtggcggctatactttaccaaagcaagccgaggttttttacgaagaagagcagctaatggctcttctacgaggaagaattgcggtgataacttctcttttacccaaaactccgcgttttatcggagattacgacccccataattttgcgggaagaaagccaccaaactatttaggaaaggaaaagctattttttgaagatataaaaaactttcttgccaataattatcgcatttttatcttaagaggacgggaagaagcggcggtagcgttaaaaaatgagcttttaaaaagaaattttccggcaagcttcgttgaaaaatttgaggtagagatagccccccgggaaataaaaattggccttggcgttcttaattctggctttgaatttccccagcaaaagcttttggtttacaccgatgtagaactggcgggaagggcggtaaaagcaagggttacaaaagcggttttaggggaaagggctgaggagccgttttcccccggtgattatgtagtgcatccggtccacggaattggcaagtacctgggaataaagccggtagaagttggcggaaacgtcaaggactacctggttattgcttaccagggggaagataggctttacgtaccaccggaacaggtagggaatctccaaaaatacgtgggcgttgacggcgagccgccaaaactttcccgccttggtggcagcgactggcagagggttaaaaatcgggtgaaagccgcggtcagggaaatggccgaaggattgttggagctttatgccaagagaatggccaagccgggttttgctttttcgcccgataccgtctggcaaaaggaatttgaagagcgctttccctatgaagaaacccccgaccagctcaaagccattgaagaggtaaaaagagacatggaaaaaccgaaggtgatggaccggcttttatgcggtgatgtcgggtacggtaagaccgaagtagctttaagggcagctttcaaggccgtaatggatgggaagcaggtggcggtcttaactcctactactttactggcgcagcagcattacaatacttttaaggagcgtttttccggttatcctgtcgaaattcgccttttaagccgttttcagacagcccgggagcaaaaggaaataattaaagaactgaaaagagggaaagtggacattgttattggaacccaccgcttgctccaggacgacgttcagttttacgatttgggcctgatgattgtggatgaggagcagcgctttggagtggcccaaaaagaacggttaaaaattttaacggaaacggtagatgttttaaccctgacggcaactccgataccgcggacactccacatggctttaatgggcataagggatttaagtgttttaaataccccaccggagaaccgttttccggtacaaacctatgtcctggaagaagacccttttatcatcagggatgccattcgccgggaactggggcgcgggggccaggtgttttttgtccataatagggtttccgatattgatgaagtagctgcctgggttcagtctttggtgcccgaagcaaaggtggcagtggcccacgggcaaatgaaagaagaacaattggaaagggtaatgttggagtttatttccggtaagtacgatgtcctggtttccacgacgataatcgaaacgggaattgaccttcctaatgttaatactttgattattaaaaatgccgaccgttttggactggcccagctttaccagctccggggccgggtagggcggagtaaccgaattgcttatgcttacttgatgtacgaaaaggataaggtgttaagagaagcggccgaaaagcgtttagccgcgattaaagagtttacggagtttggttcgggcttaaaacttgccatgcgggacctggaaattcgcggtgcgggaaacctgttagggccggagcagcacgggcatattgcggcggtaggctttgatatgtatatgaagcttttacaggaaacggtggcggagttaaaggggcaggtaacttccgaggaagtagagccgcagctcgaattaaacttaactgcctatattcccgaaagctatattcccgatgaaaaacaaaaaattgaaatgtatagaagactttcgcggacgcgcaacttagaggatttagaagatgtggtggatgaattaattgaccgttttggcgaaattcctccggaagtggaaaacctgattcggctaattaaaataaaaattgtggcttctaaactaaaagttaaaggaattttccagaccgacgaagagctgaaaattcagttctttcccaatcccgaaattactgccgaaaagctttcacgaatttccggtcagtttaagggcagggtcatatttggtatgaaccccgatctggaaattcgtgtccggaccaagggaaaaatgggccaagaaattttttcaattttagaaaggatattcgggcagttaagttgaatatataaacggtaaaattttttacaaattagttattgtgtagagaggagagacagtaatgaaaaaaattacaagagttgttgccgtacttttaacctttgtcctggccttaatcgttgcgggttgtggggattacgtggccaaagtgaatggaaaaactatttccaaaaaagatttcgaccggcggtttgcccaggtacaggctgacatgaagctaagaggagtggatttaacctccaccgaggggcagaagatgcttcagagcttaaagcagcagactctggaccagatgatcaatgaaattctaatttccgagtatggaaaggaaaagaaaattgaaccgacaaaagacgaaattaccaataaaattaatgaaattcgggcccagttcccatcaccccaggattttgaaaaagctttaaaagaccgcaatataaccgacaaagatttgcaagaaatggttcgggtgcaactaataaatgacaaaatttacaacgaagtaaccaaagggattaccgtatccgaacaggaagttaaggagtattatgaaaaacataaaaacgagccggattttcaaacaccggagcagcggcaggtaaggcatattttaattgcggttaacgatggaaatgctcaaaacaatccccattttaacatcaatgtcaaaagaaccgatgcggaagccaaaaagcttgccgaggagttaataaaacaaataaaagccggaaaggattttgctaccctggctaaagaaaaatccgatgatccgggagtaaaagaaaatggggggcagtataccttcagccggggggagatggtaaaggagtttgaagatgctgcctttgccttgaaaaaacccggtgatattaccgaaactcccgtaaaaactgctttcggttatcacatcattaaactggaaaaaattatcccggcaagacaaaaaacttacgaagaggttaaagaacagctgaaaaactaccttttagagaaaaagaaacgcgaagcttataataaattcctcgaagacttaaagaaaaaagccaagattgaaactaagctttctttcaagtaaaaacttaacaaaaaagtataaacccctccttaaggtaaaatactaacattaccaaaccacttaaggagggaatttttatgaaagcaacgggtattgtgcggcgaattgatgatctggggcgggtagtaattcccaaggagataagaagaacgttacggataagagagggggaccctctggaaatttttgttgaccggaacggagaggtgattttaaaaaaatactcgccaattggtgagctgggggattttgctaaagaatacgccgaatcccttcatgaatctttaggtcatattgcctttattgccgaccgggatacgataatagcggtggctggagccccgaaaaaagagtttctcaataagcccattggtccggcggtagagcgggccatgaatgaaagaaaaaccgtgctgataaccgccaccggggaacacgagtactgtaaggaatgtattaccgccgaagagggcaagtgcctgtttacttcggaaattatcgcgccgattattgctgaaggagaccccatcggggctgtaatcattgccagccgggagccgggagtgaagttcggaactttggagcaaaaaatggcggaaaccgctgctcattttctcgccaaacaaatggaacagtaacctccagggacggttctgacagcgtacatattgaacgccgttcagaaccgtttatttattttttcctgtttttccgaattgttcgaagaaaactattataacttttacccaaaaattcggcggtttgttttagttcaatgttatattgttctttagctcgaagggctaattcaacctgtgcatttactaccgggcgcttatattcatcggttaacaattcggtataagaaagatttaactcactgcaaatttttttggctaaatactgtaaatgaaagtaccttatacttccatccaaatcttccggccagaattcctctttaactaaactttcgactaaaaaattggtaattggttgcaagtcttctaagccgttggggcaaatttgcgtaaaaagggaaaaatccataaaaggcaaagctttttgaggatttaagaaataatagaaactactccatgggtatgaagataaacttaagaccaggcctgcccgtaaaggatttaacagaacataacgaaaagcttcccagagataatcatccgattctatcagataagatttaaaccgatcctcaaaaacgtgaccggttttttggtattttcggttaaaataaatggcgtaggtggtaaggaccggttgaaagtacttagataatggttcgtcagtggcctgggctaaaatgtgaaagtggttggacattaaagtaaaggcaaatattttaagcggctttttttcccagtttttttgcaaaagaaaaagaaagaagttgtagtctttttcttccaagaaaattttttcttttttgtttccccgggcaatgatatgataaatactgccgggaagaaaaaagcgtttttgtcgaggcattattctccccctcagaattgtttgtctaaaatatacataatttccacaaataacgtcaataggaaaaggaagagttggggaagaatagcactttttttgaaccgtttctggaggaggtggtgggaaaaatggtggttgacagaaccgtccctggagtgatctatgtggtggggttggggccggggagtatggattacctacccttaaaggcgtaccggctcttgaaagcggggatgaaggtgtttttccggacggaaaaagcagcacctccggaactgttaagggaaatcacctggcagagctttgatcatttatatgaagagttttctacctttgaggaagtttaccgggaaattgttaacgtacttcttagagaaaggcaaaagggcgatcttgtttatgcggtgccgggaaacccgctggtggcggaaaaaaccgtagagcttttacttgagcagcacgaggtaccggtggaagtggtaacggcgccgggggcgttagagcttgccctaacttccctgaaaatagaccctgctaaagacccttataaagtcctggatgctttaaccgtaacggcttgggatttttccaaaagtgctactaacattatttttcaggtgtacgaccgtttaattgccggaaacctcaaaattttgttgatggagaggtatcccgatgattatccggtcctggtattacgagatctggggctgccgggagaaaaggttgaaaaagttcctttatttgagttggaccgccgggagtttgatcacaaagtgctggtggtggttcccaaaatgcgggaggaaatattttcggttgaaaagcttggagaaatcatggaagttttaaggggggagcaggggtgcccctgggacagggagcagacgcaccgttcgcttttgccttatgttttagaagaagcgtatgaagtggccgaagcaatcgaggaggaggacccggaaaagctaaaagaagagctgggcgatttacttttgcaggtggtgtttcatgcccagattgcccgggaagaaggggagtttacttttaaagaggtagttgaagggatttgtgagaaacttattcgccggcaccctcacgtttttgcctcggtggaagttgatgatagcgaggaagtaaaaattaactgggaaatgattaaacagcaggaaaaagggaaaaaatcggtaatagagggagtggccaaaactcttccggccctaaaaaaagcgcaaaaagtaggagaaaaggcggccaaggttggttttgactgggaaaaggcggaggaggtttttgccaagattgaagaagagttagaggaactaagagcaagtttaaaggaggggaccagccggcaggaagaggaactgggagatttgttattttcggtggtaaatcttgcccgaaaattggggttggaggcagaagaggcgctaaataaaaccacttctaaattcgtaaaaagatttatgaaaatggaagaaatggttaaagaaaggggccaaaacctccaggatttaactctaagtgagttggatgagctatggaataaagcaaaaaatcattaaaaaaataagattttttttgatagtttgcaggaaaatgaaggattgtagcgaattaagtaaaacgataatttaagtacataaaaaattttttcaaggagggaatataagtgaacaaagctgaattagtaagtgtaattgctgaaaaggccgaaatgactaaaaaggatgcggaaaaagccttaaatgcggttttagcagcaattgaagaagctttgaaaaaaggtgaaaaagtacagttggtcggttttggtacttttgaagtaagagaaagagccgcacggaagggtagaaacccgcaaaccggtcaggaaatcgaaattcccgcttccaaagttccggtatttaagcccggcaagcttttaaaagaaaaaatttaataaaaaagccaggtgcctaaagcatctggcttttttctgtgtttgcataacccttcctctttttggacaaaataaccaaaaattgaggaggggttttatgcgccttgggaaaagtcttttagccttgacggtaatgtttgttctcataatttacggttgcactcccgcaagaaagcctttagccctcaaaaaatatagaaccgaacccaccgttacagtttacttcaatgagaccggggaaaaaaagaagatgaaattggaagaatacgtcctgggagttgtagcggcggaaatggaaccggattggccggttaatgctttagcggcgcaggcaattttagctcgaacttttgccctggagaatattgaaagtggaaaggtgagaaagcttcacggtaccgatgtttccaccgatatcgaagagagccaggcgtatgacccgaaaaaaattacggaaaatgtaaagaaagcggtgcaaatgacccggggtcaagtggtactttacaaggggcattttatcaaagcctggtttaatgcctgcgacggtgggatttcggcttcggccagggaaggattaagttataccaaaactcctactccctacgtcaaagagttagtgaaagatggctgtcttaaagttaccattccggaaaaccgccactggcgggtagagataccctgggaggagattcgaaaggtgttaaaaacaaattataaaaccgatccaggtcctaaccctgcggtaaaggtattagcccggggtaaaagcgggcgagtgttaactctgcgggttggaacggccaccgttggagcgccggctttgagattagcccttggaccggaaaaaatgcgttccacattgttaacgaaaatttttgtggaaaacggtaagctaatcatggagggaaaaggctttggccatggtgtcggcctttgccagtggggggccaataaaatggcccgggaaggtaagtcaccggaagaaatcatcaggttttattttaaagatattgaaattaaaaaactctggcggtaggaagttatgcgggcataattccctttatgcccgcataattattttgtaaggtcgaaagggggggaagtatggacgaggctactttgcataaagtagaaatttatgaccgcaaaaccgttaagctttcaggaataaagcaggttttaagctttaatgaccaggagatcctggttgaaagtgtccagggatttgtggttcttaagggagaaagcctttttattaccggactgaacctggaggcaggaactttgatagttgaagggtttttaaaggaatttacctatccggaagagggtgtaaaggctaaagaaaggggtaagaaggtttgggagcgcctatttcggtagcaggacaaattagagaagttattttgtttttggtggccgtggccttgggtttgacattttgcggcctttattttttggaaaaccttattttaaagcgaaagtttagacgcaggaagaaattttttccctattttgtagcggatattctttattttaccgcagtaggaggcttaattttggggtattttctctttttcagtcagggagaggtgaggagttacggctttttgggaataattaccggaatagttttatattattttattttaaataaaaacaccagttcgaaaggaaaaacgtaaattagcacgaataaatttagtaagattttgtccacattttgtccataacttgtccaaagtttgtccacaattgttaataaactgtggataagttgtaaataaggtgaagataaatgcagattgaaattcgaggggcagaaaaattaagctttcgcgaacggcaagtggtagtgctaaaagaaatgggttacaccaacgaacaggttgccaaaaaattaaaaattaatgtgagttccgttgccaccctttataatcgtgccaaaagcaaaggctaccaggtagtgatagtaattccaggggatcatctgggactttttgatcccggggatgaaggggaggaagaataatgccgcggtattatgccggttacaataaaaaaaataagaaaaaaaacttttggtcggcggtatttttggcgtttcttttatacataatggtgagctttggttttgaggtttacaaactttacattatgcaccgggaagttaaagctctatcggcagaggtttatgagctaaaagcggataatgagaagctgttagaagatattaagaggctaaaaaataactcgcactttgaaactcgcgccagggagatggggtttgtaaaacctggagaaaaagtaattgtaattgaaaagaagggaaataaagatgccagcagtgattgatatcggaacaaattcggtacgggttttagttggttcttttaacaatggtaaattttacgaagagtaccgggacttgaggaccacccgtattggccaagggataaactcggggtatttaaaagaagaggcgatggagcgaaccttgaaggtggttgtagaatttgttgaaaaagcccgggaatttaccgatgagatagtgatttttgccaccagtgcggtgcgcgatgctaaaaatcaaagggagtttgtggataaaataaaaagcgcaaccggtataacccttgaggttttaacgggcgaggaggaagcttattattcttatcagggagtaaagctatcattaccttatttaaacgaacctgcggttatcgatttgggtggcgggagtattgagtttatctggcaggaacgggggaaaaccttatttcaaagcgtcccagttggggcagtaagattaatggaggctgtagacaaggagggtttgctgaaacttttacgggattttgtcgggaaaataactccctattttcatgaaccggtggtggcggttggtggtaccgctacaactttagcggcaattgacctgaagttagaaaaatacgatccccgcaaagtggaggggcatgctattgaattaccgcggcttagagaaatccataattatttagaaagtttacccttacccgaacgccaaaaggtaccgggacttttacccgagcgagcagatattatcgtttatggctgtaaaatattaattgaagttctaaccaccgcccggctttccgggctaattgtgggagaaggggacctgcttttaggaaaacttaaagaaatgacggtgtcgaaagaaaataaagggccaaaactttaaaatgacaaaaatttcctccttgcaaggctataataaccattagaagccttggaaaaaggaggattttttttggaaaccaagatctatccctttgcccgtagaaagagtaatgtaaaagccccggaggttaaaaggccgcgtaaaaaattgaaacttagtgacataatttttccggttttagccttttctttgggaagagcttcgctggcgggagacctttatccctttgggccggcgtttttaggagcggcggtcgcttatctgggactgggggaagctttttttctatttgttttccttttattaggacaaatctttattatacccgagcgttatataatttataagttttcgcagcttttggtactgtttattttagcgggaatacttcttaaaaacttaaatttcaagaaaaagaccgttgttttaccgctggtggttttttgcgttgttgctttttttggcgtatattttgataaagccttttccggcacccctttggattttatcaaaattggccttgatgcttctttttcagcaattttaagtgtggtatttttcctggcttttccggctttaaaaggcggcccgggtaaaattgtaaccggcgaagaactgttgcctttaatgtttgtaattggctcggctttgataggctttcccgggtttttccttggtcccttagaagttaaacaaaccattattcatcttacagtgcttcttaccgccttttccggtggcccgggccttggagcggccggtggggcggttttaggggtaatattatgttttggtaacggccttcctttagaaaatataggaatctacacctttgccggtttactttccggcatctttcgccagttcggtaaaattggcgctttaattggttttttgttagcagatgtggtgttggctttttacttgcaaagcctttcagcggccaaagggcttgcctaccaaatgctggctgcttccggaatatttttactcatacctaaccggtaccttgacggattaaaggaaatgctggacagcgttaccaagaaatttcagttgtttatgaaccagccccgggaaattgcccgggaaaggatgaatgaatgccgggaactgtttttggacctgggaaattcttttttagaactgtcagcaacgttagggccggaagtaattccggagtttcggatagaagaggtagtggagcgctttcccaaagatacctgccagaattgcacttttacccggctttgctgggagcgagagttttttggaacttaccatgcgctactggaaatgctcacaatcctggaaaataaggggcaattatttaaatcggatgttccggggtttttttacaagcgctgtcttagaatcaaggaatttttaaacgagcttctttttaccttcctcatggaaaaagaaaaaagtcgctggcagaaaaaactttatgaagaagagcagctgaccaaaagccagctcaagggtgtgggagaaatctttttggaattaaataaggctttggatctggattttgtttatgatcaaaaaaatacggtaaaaatttttaaaagactttgggaagaaaacctaccggtggaaacggttctggccaaacccaccggtggaagggggatggtcgtagaagttaaatctgcaaggtgttcaggaactaagccttgcctgaacaaaattccggtaatcttacgggaagaaaccggaggagagtttgttcttcaacaaaaacggtgtggtcagaccgatggaggagaatgtcacttaaattacttgcctatggaagatttagagggtagaattggtataggaatggcgggaaaaaccggagaaaaggtgtcgggcgatagttaccgggtggtgcggtactccccgggaaaactggcggtaatgctgtccgatggtatgggcagcggggagctggcccgcagggagagcagtgcctgcctgttaatggtcgaaagacttttatcctttggtttaagtccgtcgaaagcgttagaagcggtagatgccctgatccgtttaaaaaaccggcaggaacggtacttaactttagatcttgctttgattgatttaataagccgtcaggtaactttttataaacggggagcggttacctcctttttaaaaagaggggcggtagttgaaaaaattaccggggaaaatttacccctggggagtggaattgagcttaagcccagggaaaaacggcaaatattatttcccggagatattttagtgctgatgagcgatgggcttttagaagctttagggggagaagagcgggtggtgaaaattcttttggaagacaatgatttatcccccgagattttagccgagtatttccttgcccatgccaaattacgccaccagaatgtcattaccgatgaccagacggtaattgtggttcgtttctttgaaaagacaaggagtgaacgggttgtacgctaagtttgttaaaaccgtacaaaaatatcagatgattaatcccggagagaaagtagtggtaggggtatcgggtggccccgactccatggctctccttttttgtttgctcaaataccgggaagaagtggatttttcccttgaggttgttcatgtaaatcacggtttaaggggaagggaaagcgatttagatgaggagttggtcctggattttacccgaaaatacggcataaattttcatgtaaaaaagcttgatgatttaaaagatttgcgggaaaatttacaggcggtagcccggcaaaaacggtatgaatttttttatgaagttttggaaaaaacaggagcggataaaatagcgttagctcataccgcttcggatgtagcggagacggtgatgatgaatattttgcggggagcgggaacggagggtctctgtggaatttggccggtgcgggataggattattagaccattatatacggtttttcgacgggaagtgatgagttttgttgaacggaagaatataccctaccgggttgattcttccaaccttgtgcccaagtatttgcgtaataaagtacgtttaaagctttttccgtttataaatgaagagtttgcaaccgatatcgaagagcggctttttaatcttgccctgattaaacaggaagaaaaccaggtgcttgataattacttaaataaactgtggcaagaagcttttgttaaagaaggccagtacttaaaggtaccggtactgcaaaacctttccagggcggaagctggacttttgttgcgcaagttttgggaacaggcaacaggcagtaaaagggatttataccaggagcacattgaaaatttactggccttttgtaacgatataaaagggacccgctatttcctcttgccccgggggatgcgggccaagctatcctacggaaaactttttcttgaaaaaaatctttggcaaccaaaggttagctttggatatgaattgattcctccgggaagtttagaaattcccgaagcggggaaaaagattaccttaactccggcttttaatggtaaatttgatttatttcttgccaaaagtagcggtgtaatcgtcagaaatcgccgtcctggagatcgatttaccttcagggggcataccaaaaaattaaaagaatggttgatagaacaaaaaatacccagggatataagggatcgtttactaattattgaagtaaacggtcaaattgcctgggtagaaggattggggaccggggatttatttaaaaacagtaaggattctgaccttattccctttgcggtaaaccttgaattattgaaaagttgttgaaattatgataaaattttgtagcataatgatggaaagctgtgagaggagtgctcaactttgaataaagtattaaaaaatttagcaatttatttgttgattgttttggttgcagtaatgctcataaactattcccggccgtcggcaacttctattcgcgatttgaaatatgatgagttttatagccttttggaaaaagggcaggtagcgtcggtagcgattcagacggaccggacaattaatgaaatttcaggggttttaagggatggaaccaggtttaaaacccgggggcccctggaagatgctgaactatataaagatctaaaaaagatgaatgttacggtagaaattatgccgccgaaagaaccggccttttgggccaaccttttaagttccctgttaccggtccttttaatggtgggtttgttctttttctttatgcaacaggcccagggcgggggtaaccgggtgatgtccttcggcaaaagccgggccaagctgcataccgatgagaaaaagcgggttacctttgccgatgtggctgggattgatgaagtaaaggaagaattggcggaaatcgtcgagtttttgaaaaacccccggaagtataacgaattaggagccagaattcccaagggcgttctcctttttggccaaccgggtaccgggaaaactttgctggcccgggcaatagccggtgaagcgggggtgccgttttttagcattagcggctccgattttgtggagatgtttgtaggggttggtgcttcccgggtaagggatctttttgagcaggccaagaaaaatgctccctgcattgtttttattgatgagattgatgctgttggtcggcagcggggagcggggttaggtggcggtcacgacgaacgggagcaaaccttaaaccagctgttggtggaaatggacggctttaattccaacgaaggaattatcattattgccgctaccaaccgaccggacattttagatccagcccttttgcggccgggacgtttcgaccgacacatagtggtggatactccggatattaacggtcgcaaggaaatcttaaaagttcacgttaaagggaaaccgctgggagatgatgtggatttggatgttctggcccggcgtaccccaggttttaccggtgctgatttagcaaatatggttaatgaagcggccctgcttgctgctcgccgcaataagaaagttattaacatggaagagatggaagaagcaattgaaagggttattgccggtccggaaaagaaaagcaaggtcatttccgaacgggagaagcggcttgtagcttaccatgaggcgggccatgccatggtcggttacctccttccccataccgacccggtccacaagatttccattattccccggggacgggccgggggctatactttactgttacccgaagaagaccgttcgtacatgacaaaatcccagcttctcgatgaaattaccatgcttttgggaggtcgggtagcggaggctctggttttagaagacattagcaccggtgcccgtaacgatctggagcgggctaccgaaacggccaggcgcatggttatggaatacggaatgagcgaagaattgggccctctgacctttggtaaaggtaccgaagcggtgtttttaggccgggatttggcccgggatagaaattattccgaagaaatagcctataccattgataaagaagtaagaaaaattattgatagctgttatagccgggcggaggagattttaaagaaaaatattaatgtgcttcaccttgtagcgacaaaacttatggaagtggaaacgatggaaggggaagagtttgaaaagttaatgaaagaaaatggcttaaccaagcccagggtaaatggaaataacgattcacctgcggatgttctccagtagttagaaagcctcccgttttccgggaggcttttccaaatacagaaaaagggggagaatattttcttatggaacgaacctttatcatggtaaaacccgatggagtgcaaaggggattggtcggggaaattattagccgttttgaaaaacgcgggtttaaattagtgggattaaaacttatgcaaatcagccgggagctggcggaaacccactacggcgaacataagggtaagccgttttttgagggactgttgaactttattacctcgggaccggtggtggccatggtttgggaaggaaaagaggtaatagccactgcccgggaaatgatgggggctaccaatcccctaaaagcccagccggggactatccggggtacctacggtatcgatgtggggagaaatgtaattcacggctccgattcaccggagtcggctgcccgggaaattgccctttttttcaaggaagaagaacttcttagttacgaaaaaactctcgatacctggatttacgaataataccataaaccccgtcaaaattcggcggggttttttcatgcttaaaaccttgtaaaaagctttttctaatttacagtaattttcgaaaataataaaataaaagttaagcggaaaaatatattatcattggggtgaaaaaatgaactacaacaactggttttactggctaaatcttgtcttaggcggaataagtgggatagttttcggaataatttatagcaattttatttttcttttaattggcggtattttggtctttaccaacctttggggctattactttatttaccttaaagaaaaaaaagagtttgccaaaatattagaatttggtgtagcggctaaaaataaaaacttaagagaattattaaactatcaaccgccgcaaaagggcattcttaatgaattaggagaaacctttaagttcctgggggagcagatctataattcggtaaaatatgccggagaggatgcccagacgcagtcggagattattgagagtttaacttcggcctttgaacaggtggcaaccggtactcagcaccaggtagggcaaattcaaaacttaacgctatctttagaaaaactagcgaaggagattaatgaggtggctaagttagccgctaataccgaacagcttgcccaaagagcccgcgagcttacccaaaaaggagtcaaacaaagcgaagtagctgggcaggaaatggagagcataagtcaaagtattaatgatttagaaaaaaattctgctaacatagctgctatcttagaagtgatcaatgaaattgccgatcaaacatcgcttttggctttaaatgcagcaattgaagcggctcgagctggagaggcaggaagaggttttgcggtcgttgctgatgaggtaagaaaacttgccgataaatccagggaatcggttatgaagattgaggaaattattaaagatgtacagggcaagactaaagtggcagtaaacaatactaaaaacggtgttgctgctattaccagtttaagccaggcgtttaatgaaataaatactcatgtccaagaaatgactgaatatatggctcaagtttccgaaaaaaccgaaatccaagctgctgccagcgaggaagtatcgggggcagcccagaccatagctgcggtcattgaagaaatttccgccagcacccaggaaatagctgcaacttctaaaaaacttaccgagattaatgcggctttaaaggaacatgtggccagccatattttataaaggttaaaacccagcacctttagggatggtatccaaaccctaaaggtgtttttttaatctacaatttacaacgattaagaagagttggtaaaataaaagaaacaaaaatgaggtggaaagatgaagatgaaaataaataactggtaccagtggttaaacgtactattaggtcttaccgggattggggcgggagttattaccgaaaatattttggcactggcccttggcatcgggttaggcctaactaccatagccaattatttcttatatttaaaggaaaatgaggaaaggaaaaggcttttacaattgggagaagcggtaaaaaaccggaaccttaaagaacttgtggagtatacaccgccaccaaaaggcagctttaaagaactgggagaaacctttaagtttctcggaaaggtggtttataactccataaaatttgcgggaaaagatgccaaaactcaaggggaaatcattgaaagcctgaccgctgctctggaacaggtagccacaggaacccagcatcaggtagggcaaattcaaaatttaaccctttctttagaaaagctcgcccaggaaattaacgaagtagccaggtttgctcttgcgacggaaaacctggcgcgaaaaacgcgcgagcttacccaaaatggagtagtacaaagtgaaactgcccaacgggaaatggagagcatcaagcagagcattaacgagttagagaaaaattcagccaacattgccgcaatcttagaggtgataaacgaaatagccgaccaaacttcacttttggcgttaaatgcggcgattgaagctgcccgggccggagaagccgggcgcggttttgcggtagttgccgaggaggtgcgcaaacttgccgataaatcccgggagtctgtgaaaaaaattgaggaaattgtgaaagatgtccagttcaaaaccagtactgcggttaccatgacgcaaaacggagtaatggcccttgcaagactgagtcaagcttttagtgagattaatgctaatgttgaagaggtagtgagccatatggcaacggtttccgaaaaaaccgggattcaagctgcggccagcgaggaagtgtcaggggcggctcaagctattgctgcagttattgaagagatttccgcaagtactcaggaactagcggctacctcgcaaaaacttaaggaaataaccgacggtttaaagaaacgggttgccagttaccagctttaaaaagccatggccttaggccatggcttttaaggttgatatcccccaaaggtgtgggagcttagatagatactatcaataagtgatgcggttttgggcatatccaccgctggcattcgggttccatcgtggcaggaggagcaaagctgcccctgggtagttttaagagattcccccagtaaattggtgccgtgactgttgtggcagtcgttgcaggctaaactgccgtttttataatggaggctttgcctgtaagccggatactcgttttgagcccgggcatcccggtaaataccatctacggcaggatagaataaattctgaagtgacaatattggtgttggcattgaactttctaccagatacggacctaaattatctgtaccgtaaattgggtcatttaaccccgggataatcccgtaggtataccactcttcactccagggataaactctttgtcctaccggtggtaggaaatcttcccggtaagttagtcccattactgtttgctgccggtataaaaggcttatgcctttactatggcactggccgcataaactggttctaagcgctggcgtctggtatttgggattataaatattgtagtgattggggttttcagtgtggtttttaccgggaccatgacaggcttcacagccaacacccatttcgaccagttcgtaaccggtgacttcagaggtttcgctatttacggtagtaactttaaaaccggtgccatggcagcccaaacaggagtttaagtcataaactccggaaaatacggtgaacttttttgcgggaacattaaagcttctcgaaagaagattataagttgtgtcataaaccgcatagctctgcagccacttaaaaccaacgcttaaggtgacctgctcgggataaacatccgcccgggttgaatcaatcagccggtacagaaggttgcctggactggcgataaaatcatttagtccgctgtaggtaaagcggtagctaaaaccgttaaccgacggttccaaaggataaaccgcatcagctactatgctattaaaaccaaaaccaatggtcctcgcatgggctgtcttttgccatcccttataataattctggtgacagctcttgcaggctaaacttcccacgtactgactgctgccctgatagtagttggttggagtaggagattccataaaatagccggttttatccggatggcacagtacgcaacttttcatattgggaagccgttttaaagccgaggacccggtattttcataggcttcctccggtactgtaccggttttcagccagtaatcctgatcaactccgtgagccgtatggcaggtaagacagtttattttggaaaaagttccggtaaccgggtcgtattcaaacttgatgttataaaccgtgcttaaagttgaagctagctccggataaacggtgatatctaccgggtggcggtaattttccgtaaaactgtaagtattgcctaccaccgtggtatagtacgaagggtgacaggaggcgcaaaattccgagataccgcttatatacgttactttttccggtttgtctgaagcaattgaaaggtaattttcaatacccattactaccctgatagccggtacaaaataagcataaagcggtaccgttggtgcataagtgaatttaatcactgtataaccccgggagttatcaatggtatagtaagaggggtcaatatatccttcgttggagctaattttggtaagacgttcgtattcataaccggtaagccagcggtaaggagtatacgtcacctcgcctaccgagttagcggtagctccgggatacaccgtatactcggtactggaaatcttcgccattaaaaccccttcttttttatttaaataagcctgtccgttggggttaggggataaaagccgggcatttcctccggcaccgtgagggtcatgacagctggtacaggtaaaaggaatactccagcggtcgtttatgccatcgccatttaaatcggcttgggcagtgctgatatagacttcccctggcaccgaagaaacttcgataatacccgaaacgttatgagccgataaaaattcttctttgccacggccgaaaaccccgctattggttaaaacattactgttttggattttgccgtctaacacgttgtaggtagtggtaacggtaccatcgtggcaggccatacaggtagcgtaatcggaataccactgcaagaggcccggacctactgatgtatgagtagagtggcaggaggcgcagctatcggtatttttggtaaaattgctgtggaccctgtacaaggcagggttattttcattgggcagatagacttcataagggaaatttgtaagatcgtccgggttaaaggcagagaccattccatagacattgttataaacttttgtttgaactggaaggtaactacctttttgttcgttattgccataaactggcaataagttggcttgtacgttatttggtattaaaattattgatatgaaaattaatgataaaatgtataaaaaagcttttttcatgggtgccacctataagtaaaattgttaatttcttaataatttcgctaaaaagatacaaaaatccttctaattaaaagtattattttttaaaggtgctatcttttggcagcaggatttttcctatgttaaacgaatagaaaataagggaggtaatggctgtggacggtgagagaacatttaaatttaaaattccttatctagatgaagcaaagcttatacactccaaagaaagcattggaacacttaaatttaaaattccttatctagatgaagtaaagccttataaaacaatgtggtttatcttacttttaggattcagccttttatttttattaccgcctttttaccggggcctattttttgaatatgagcaggaagtagcaactctctgggcaattattttagtttggctagtttatactttagagcttggggagaaaaagccaaagtttttacaattaactttagattatgccgtgttggcactaccaataatttatttaatttcaataattaatgcggccaatataggctttgctgtcgatgaatttgtccaaaacattttatactttttggtattctggctggctacccgctttggagctgaccagaatgcgcgaagggttttacttcatgcggtttatctggcagcaattggtgtatcccttgcaggccttatgacggcaacgggagtaattaatattcgggatgggtatttaagtggtcgaatttactcttcttttcaatatcccaatgctttggcaagttatttagcagcggcttttttaattggtatttacctgtgggtaagttccaataaagctttacgttatttttacgggattggaaactatattattttaacggtacttctcgggaccaaatccaacggtggcttaatggtatttttagccataatggttttatactttatttttcagccgccagggaaaagatttgccattttctttcatttatttttaaatttagcattagcttttgtggtgataaaaagctttatatatcatgtggatgttacgggtcagaccgggaactcgtggctctggtttttagttggcttaattatagcaataatgatcgaggttattatccagttcatagttttaaataaagcagttattacaatctttacaaaatacaagaaaccattaatttatatgtttcttggatttatggtggtggctttaataggcggtttgattttggttttatctaatgaagtattaagggaaaaaatttacgaattgctgcgaattcgtaacgctagcgaacggggttatttttaccgggatgccctgaaaatgttttttaaaagccctcttattggctggggtggtggaggctggggggaagcttaccgggcatttcaaagttatttttatatttccacccaggtgcacagttactacctgcagctctttgttgaaacgggagtgttaggggtagcaactattgttaccataatcggaagttttttcaaatattttattaatctttggagaaaaaccagcgattactggctttcctttgaggtcgttaccctgggagcggtaattataaatattgctggtcatgcggcgattgattttgatttgtcgttagccgccctttccttggttttgtttttagccctgggctttataagaactctatacttcacagctatttctaaaccactaccggagaaaaacaaaaggaaagtacagtttaacagcatcccctattttaccttaatctcagttattgcgattgggcttttaatttttgtgggaatgcttgctactgcaagtcattatgaatattctgcatacagctactatcaagctcaagatttacaaggtctaaaaaatgtaatggaaaatgctgctcgctataatccctttaatgcttcttataacgaaaaattaagggatatttacaagtcttttggtgatttaaataatgccctcctccaggcggaaaaagcggtggcaaaaagcaaatatgatccctacaaaaaaattgaactttcttacctctattaccagaccgggcagatagataaagcggcggatttaaccgataaatttataagcgatgcgccgttcatggcggtagtttatgatgctgcagcgcgggtaaacatgatgtgcggtttagcagcggtgagaaatggtgacctaacaaaggcgcgggagtattttaataaagtagttaaagtgcgggatttggaagaaaaacaaattaccaaatacactcccgaaacccgaaaacttcaggtggtagctccggtactttcagttaccccggaggtaaagttaaatgtggggattgcttattatttcttaaaagattttgctaaggcccgggaaaatcttttggtttctaaagagaaaaccgatttagcggcggaaagtcttttgtggcttacggttttggaaagcaaagcaggtaataccgaacttgcgggcaaatacaaaaaagaattagagaaagctccgggagggggtcaacttgtaaataaaattggtgagtttttgagtttgccactgctataggttaagctgtgaagggaaaacaaaagaagaatatagtttttatcatagaaattaacggctcggtggagccgtttttttatggcagtggtgggataaatttttttcataacaaaatgaagtgctattattacaatttatttgtattttcaagtcgcacatttggttaatataaaatgatacaaatttattaaaatgctcgtattttgttgaaaggaatatttcttagatagcttcgattattttgaaaaagagattatataagcaaaactctatttaatacaataaatgtcataatttatataatatcgtcgattaaaaaatatgtaactatgggaggaaaaatattacagacatcgaatagctttttataggaggcaaagaaatgaacgtaaggggaccaacaaatggagaaagagtgataaaaattattttaattgtcagcggagtatttttaactatattaataattgctataagtttaattgaagttacctcgctttcgattacctgtcagggttgtcatgaaatgcgcccggagtattacacctggaaagcttcaacccatagccaggttaactgcttaaaatgccatgtggagccggggattgggaatttatttagatttaagggaaaaatgtttaactttgcctacctccattttaccaaaaaatatctactgccaataagcctcaaaaaagaccttcctcaacgcaactgcacccgctgtcacggctcaaaaagagctattaccccggcaggtgacttaatagttccccacgataaacacaagtcggccggagttcagtgtctggaatgtcataaaggaattgcccacggaaacatactggaccgccaggaaacaattgacggagatttcagccgctggaatttaacttacgccaggtcccagatgataccggaaaatgtaaagaccaaaatgagtttgtgcatgagctgtcatgaacaaagaaacgtgaccagaaagtgcgaagcgtgtcaccggcaaatacggcctcccaaggaccaccgggcgtcggactggctcaccacccacggaaaacttgctcgcaaaaatttaaaatattgtgatttgtgccactcttattctaatgttggtattgaatataatgaaaaagatccggtgcgggcttatattaaaggaaacagtttttgctatggctgtcattccaaaaggccggtaacccatacggttgactggatatcctctcatggcctcttaaggaccaaaaacgatatttcgggatgccttacctgtcacgactggggccagcgttcaccgattcaaaccgcgggacagagcattattgccggcgagaggcaaacgctgcaggtacccggtgggcaggttttgggagaaaagaaaacttactgcatccaatgtcaccggggtcagcataataatttctttgcataccaggtgcaaaatcacccggtaaatcttccgcccggtacaaagctgcaaggattttgttttgggtgtcataatgttcgccagtgtcagcagtgccacaaaaatgcggaagccctatttaaagaattccaggaagggagaaataaggctggtacttctaaaaagcttttaaacccgcaccagaaatattttcaaaatggtgcgcaaaaccacccggtacctttaaatgccgggaccaaacgggatagcagttgctatcgctgtcataatcaaaagtattgtaccggttgccataaaaattaaaaaagggggatttgtcttgagcacggaagttagaccggtcaaaacacccaaaccggtgcctccgcttgtagcgtatttaataataattgtttttacagcaacaatgtttgtcatcggggtgattattggtaaagcctttttttgggagaattacgatactacaccgatagcggaccggattattgaagtggccaagcagaaggtggctcaagaccccaaaaatccgaaaaactacgtggatttggggtggggttattttaagaagaaagattataataatgctttgtctcaatacaaaaaagcgattgatttagacaaaaaatactatccggcttatttaaacctggggattctttatattgagaccggtaaatatgatttagcggcaaacaccttaaagaatgctatagccctgcagccgaaaagctccaatgctcacttaaatctcggaatagcctatactaagcttggaaaatacaatgaagcattgaaagagttaaatgaagcctataaactttccccgggatcaaccaggataatttacgaaataggggttacctatgaaaaaatgggtaaaatcgaagaagcaaagtaccagtacaagtcggctttggagtttgatccgaaatttgaagaagcgaaaaaagctttagaacggctcaataaaaagtaaaggagggagggtatgagtagcaataatacccttgccgtacgcttaaaagatattttttggcggtgggatcaggaaaagctgaaacgaactctgaaatggatttttataatagagttaatattttttataatcttttatttccttaaccgtaacccggtaccgaaaatagtaccgcaaatagggccgcctggaccaccagctttcttatatgcgatttacggtaccgaccagaatccctttaaaaagccaatggcggtggcggtatccggaaaccgaatttatgtaaccgacaccggcaatcagagggtccaggtttttgactatgatggtaatcctctctttacctttggtaaacccggtaccgataaaggacagttcaagttcccctacggtattgcagtggacggggacggaaaagtttatgtagccgacatgtacaacggtaaaatttccgtctttaacagtgaagggattttccagtactattttggtaacccctcagatatcagtcgtcctgctggcctgttcatttccggtaaccgcctttatgtggccgatgtcgggaaaaataaagtaacggcgtttacattagacgggaagaaggttttggagtttgggaagatgggtactgccaacggtgaatttagggctcctaactgtgtctgggttgccaacggtaagatttatgtcgctgactccggtaacgaccgggtgcaggtctttaacctccttggcggttatgcctatactttaaccggcggcaacaacaatggtgagaccttctcctttattaaccccaggggagttggagtagatggccggggagtactgtatgtggtggataatttaaatagccgggtttgtggctttgatgagcagggtaatttcctctttacctttggcagcaaaggggctgagctaaaccaatttatcttgcccaacgggcttttcgttgatgaccagggccggatttacattaccgacaccgtaaaccagcgggtggtcgtatatcaaagctgataatgcgaccagtaaaagagctgctaaattaaatgggcagcttttttacttttgaaacgcattaatttggtagctattagctggaattttttatccgtgtattctatttttgagaatactatgcctgaaattagagggaaatccatccttgaagtcgaattaccttcttaaggagggatttttattggctaaaaagattggaattttatttttattgttattagttatccttggtgtcttggcttatggtttttcgggtctgggaaaagccggaggacgtgtttggtaagtttgaaggagctttggctaaaggtgataacaaaactgcctttacatatttatcacgtactataaaggacgatttatcacaagagaaactaaaatctttagatatttttgtccatgaaatggagaaacagggtttttcctttaaaccgacttttcccgagttttgcaggaattttttttaccgggaatttaaacggggagtggcccagggggatgtagtatatacggtagaaattggtttggtccgcgagtggggcggatggaaggtggtaagtgtccggtaatttgcaagggttttttaagtagctttgcaggaaatcggggaaaaagagagaatataactttttagttatagtatacctgcgggagggaaaaggatgcagcgttttttggtggcagcgtttttattacagttagtcctgttagtgactttgggaggggcgattggtgctggacccggcgcgtttgtggataaagaaacggggatagtggtgaaaaccgcgactcctgaggatacggcggtttccttttatgcccttttggagaaaggccgctggcagccggcgtataaattaatgaccaaaatgtcccgggacatgatttccgaagcggatatggaagcatcggtcaagcaggtgaagattgtcaagtcccggctggttaaggtatttcctgccgaccaaaagggagagtttgctactgtcggtcacgtccggataatccagttagaaaaccagcccaacgagatggcaattgtaggtattgcggttttacggcagaaccccgaaacccggggatgggaaattgttcgagtgcccaatgaaatcgaaagcgtttataaggatatcctggatttaattttaaaaaccgatgaaaaaatgagcagagaagattttgccggcgaaaatctgacgaaggagcagcttacccagataaaagaccagatcaaggccatgaaagaaatgcatgaagcccaaaaggaagcgttaaatcagcaataaaagtttttgtttagccggcagaagccggccctacaaaaatgcaactaaattccccgcccgataaggcggggaatttgcctattttcgtgctgtaaacactaaatcccgaccttcgggatcatagggtgtaagggtgaaatcccggtaaaagacgatttcccgaaagccggcatcttccaaaaaggtttttaacttttccacagtaaccggatataaaaacatctggtcggtgtaagtttctcctttttgcgggaaaacaagttcaagggagaaccgcaccaaatcgccaaaaagttcgtaccgccggcggaaaattaaatccagatccaaaagctttttttcggggaaagggaaaacgccggtttttaaaaataaggcaaagttaaccgtttgacctactaaaagacctcctggaagtaaatgtttaaaaaagtttgccagagctttttttataccatcctctcctaaaaccggtaaggtgttgccgatacaaaaaatgccctcaaaagactcctttaagtgaaaagcagtaaggtcagcggttaaaaatttaacattgtttttaccccgcgcctttttctgagctaaacttataaattcagggtttatatcgattcccgttacttcaaaacccctttcggccaaagagagggcgtaattaccggtaccgcagcccgcgtccaaaagtttttttgccggggtaaaaagcttttttaaactatttactaccgtatcattggccgggaacaagagatcgtaataccggtttaaaagagaaaagcccatccatccttcctcctcagtgggtaagcttatcgaccagcgggtaataagcttgccagagttctggtaatactgtggattgccagcgtccggtaattttagcaataatcatgccgccaataaaaaagcccaaaagaattaaagaatactgaaaaggggttaaggtaaattttccaattctgctgccaagagacaaagtgtttcttaccggacagacttcaacgcaactacagcataacgtacattcgggagaggtaacggcatttagggtcgaaacctttaaattgctgggacaaattttatcgcattttttacaggaaatacagctttcgttatttctttttatagttaggggcgaaaaaaaagcaaaaatattcatgaaagctccataaggacagagaaaccggcaccagaattgaggaaaagtaagggataaaactattaagacgataagtacctttacggttaaagcggaaggatttaaaaagaattttagcattttgatatcagcaaccgcattataaggggattggacaaactgccaggtagcatcataaggcatgtcaattaaaattactttaataaagaacagagcgataagatacttaatgctggcaagtaaatagccaagccaggttgggattagtaaatctccggggattattttttttcgaaaacggtatagaagttccgatacggtaccgatgggacagatatggctgcaaaatccgcgtttaaagagaaaagcgctcaaaataattaaaattaaaatcgtaaggcctgccgggtgtaccggatcaaaaattcccgaaaataaatagctttttaaagctaccagggctgaaatagggagaaagccttcgattgaaggaaaacggtattttaacgccgaaaccccttcggtggggaataaagttactgccttataaaagaaaaaaccggctacagaaaaaaagagaagatagtaatactggctaatctttcggagcaaggcaaagtccctccttttacttgcattataaaataatggtaaaaacttttccgtgatacttctcacaaataaaataatccttgcattacggaaaagaatggtttataatacatgaggcaagaaatggtaagcctttctgccaagctgcagaaaggctttttatgttttaagcataaatccagcaattttgcccaaattaaaaatgaaaaaaggaaaaaggagagtttttcatggaagagtttaaaaaattgggattaatcacaccgcttttaaaagcggtgaacgacctggggtttgaaatgcctactcccattcaaaaggaggctattccacttattttagaaggacataacctggtgggtcaggctcctaccggaaccggaaaaaccgctgcttaccttttaccggtgttacaaagaattcagcggggaaagaaagctcaagtgttgatcgttactccgacccgggagctggcactgcaggtggccgatgaagtggccaaactcggaaaatatcttaaagtccgggctctggcggtatacggcggccaggctattgagcggcaaatccggggacttcgccagggggtagaagtgattgtggggaccccgggacgaatcttagaccatatcggccggaagacttttccggcggcagagatcaaaatcgttatcctggacgaagccgatgaaatgctggatatgggttttatcgatgatatcgaggcaattttaaataccctgaccaaccgccagcaaaccttgcttttctcggcaacgctgccggctccaataaaaaccataattaaaaagtttttaggggggtataaaacggttaaactggttggcagggaaaaaaccgtgccggcgattcgccaggtatattacgagcttccggaaacggaaaaaatcgagggacttgtcagtatcttaaacagcgagctacccatccaggctattgtgttttgtcgcaccaaaaagcgggttgatgaggtagtagagcaattaaactttcggggttatgcagctaaaggattgcacggggatatgagccagcgggaacgcactcagaccattaaaagctttaaagccgggaaaaccgaacttttggtggctaccgatgtagccgcccggggccttgacattcccgatgtttcccatgtcatcaatttcgatattccccagaacccggaaagctatatccaccgtattggacgtaccggccgggcgggcagggaaggaaaggccattaccctgattaactaccgggaaagaaagcttttaaaagccatagaagaggcaataaataagcgcttaaagcgggaaatactgccggagccggtggatttggaagaagccagattcaaaaaaattgccaagaaaattctggataccattaccaaaggggtaccggctttgtatctggaaatggcggccagacttttagaagaggaagagtcggagcagcttttaggggcaactttgtatcttctggaagatcggtctttacagaatgatttttagcggttataattgtaaaaaaatactaacggccactgggggtgccggtcaaaaccggctgagagggagagttctcccaaccctttgaacctgatccgggtaataccggcgtagggaaagtggggtaactggaagataagcccgttttccgctttgccggagacgggcttttttgtctggtggccgggaaaaaggagggtggctgatgaaagggttagacttgcgggtggtgacccgcggggggcttgctttagctcttgctgtggttttaagtttcataaaaatctggcagatgccccaggggggttcggtaacgctcttatccatgctgccggtaatttattttgcttataccgaagggcttttaccggggttactggtaggggtcttgtatggtttgttacagtatttaattgaaccgtatttcgttcatcccgttcagtttcttctggattatccggtggcttttggggcccttggcctggcgggactttttgccaaaaagtcgccgtatccgggagtggtactggcaattcttggacggtttttatcccacctcatatccggagtggtgttttttgcgagctatgcgccaaaaggtcaaagcccctgggtgtattcggcaatttataacggtagttacctgctgccggaattaattttaaccctgggggcagtttacttgctgaaaatctttgaacgcttgcggaaggtgacgtaaatgcgggttataatttttgccgggggtgaggcccccggctttttaccggatttaacaccggaggattacttaatagtggccgatggtggggcaaggcatttgcccccggaggtcatacccgatcttttactgggggatatggactcgcttccgaaaaacttgcaggaagagtttaaaagaaaaggggtaaagcttaaaatttatcctgccgaaaaagattttaccgatttagaagcagctgtacaaacagcgcaggacctggatgcttccgaggttgtagtggtaggaggaaccgggggacggagcgaccacttttttgcaaatttgctacttcttgctaaatgtagctgcccggtaacctggattggtcacgattttaccggttatctaaataaaaaccctcttattctaaaagggaaacccgggcagttattttcggttattccccttaccggagaagttaccggccttactatcgaaggagctaaatacccccttgttggggctaatttatcctgggggactactttggggctgtcaaatgagtttatagccgatacggtcagaatttcctgggtgaccggtaaattaatactactgcaaattttttgatttgggcatttttttggaaccttaccggagtaacggtaaggtttaattatatcgaggtagctaataaattttttctaaaaatatttctgctaaaaatagcgtaatgtcaagagaaaaaaggttttaaacattttatgtatataaataaaatttatacaactataagcagggaaatccataaaaaagtcgaaaaaagcatataaaagaaaagtgacaaaaaaacattatatgctttaattccggggagctgggctataagtaaaacttagtgcttgccttgcgtttcccggctttaataaaaatacaaggagaggtgatgtgatgaggaggaagagtttagttattttgctgctggcagtgtttgtacttttatttagcggtactaccctggctgcagatcattcgcagggcaaagattgtttatcgtgtcaccagaaatatgatcactccaggctgcaaaagtacgagggatcaaaaaactgtttaccctgccattccgaccaggtaaacgatgttatccactcggaccactatacctggcagagcaaaccggtaaacctgattgatgctgccggtaagccctggcccgccgataagccggtagggaaacttgggggcttaaacgatttctgcattaccccggatattaacttcctgggaattttagttaataagaacggggctaatgtcaaaggtggctgtggccagtgccacgtaggtatgggttcaaggccggataaaattgatgaggcaaaagataaggaaaacgttgactgtttaatttgccatgccgattattcggtatacaacaggaacctgaaaactattgtgcaggatgcatatggtaacttgtattacattcctaatacctcggtaattgatattgcctatgtgaaaaaagcaaacgtttctggaacggttgatattacagcagccctaaaatcaattaagaagacccccgataataaaaactgcctccagtgccatgcttttgctggcggtggccccaacaacaagcggggagatttagaacccatcctgatgaccgagcctgccaaagtagatgttcatatgggtagtgggatgaaatgtgttgactgccataagaccgaaaaccacaaaatagccggccgtggggtagatttacggactaacgaattaaattataatgtacggtgtgaaaattgccactctactaaggtccataaaggtcctctgggagtggccttgaacaatcacgtcaagagcatcgactgcactacctgtcacgtaccggaatacgcaattacccagtctactgatgttttccgggattggtcacaggcggaatacaatagtgtaaccgccctctatgagcccaaaatagaacggggacaaaatttaaagccagtatatctctggtggaatggcctttcttacgcccagcaaactgatgtaccggcggtatttaataaagataacaaatatgctcctaataaaacaactaaacccgattacgtaactttatttgcaccggttggctcaataaacgatcccaaggccaagatttatcccttccgctaccactatgcttatatgcctattgacccggtcactggtaagttcttcccggctaaagctggttacgtatttatgaccggcgatgttttgggtggatttactaaaggctataaagaatggtttggcgtggatttggtaagtccggttaagtgggtctatgccgagcggtacatgggcttgtatcatgaagtgaagcccgcaagtcaggcgctctcctgcaccagctgccacagtaaccggggagttcttaactggaaagctttaggatataaaggcgatccaattatttatggtgcgagaaaggttgtaacaactccggcagttaaaacctatacggtaaccaagaccacttatctctaccagaccgcatctaccaaagccaagaaactaaccacactgaaggctggtactaaagtaacttatgtaagtgcttcgggcaactactataaagtccaggtaaaagttggttccaaaacttatactggctatgttttaaagtcttatctcaagtaagtccaaggaaagaaaaggataagagaggggttaacagcccctcttttctttagcagcaattagcattaaacccataaaaaagtgttggcataaaaggaattttgctactatatgtcgaattaaaagagcgaaagggggtgagacggtgcaaaaaaggcttctttggataataataattgcagcggcaattatagcgatagcagctccttttgctattcacgaaaccagtaagccgactttttgcaatacctgccactcgatgaaaccttacgtggcagcctggaaagaatcaaaccacgcaagggttgattgcatggcctgccaccgagaccccggttttgtgggactgatgaaagttaagctgggtgggcttaagcaggtggcggtagagcttactgaaaagccatcgccagatgaaattaaagggaaggcagaggtacccaacaggcggtgcgaagcctgtcataagttagatcagattactgtaaacgggacttttacctttagccatgaactgcacgccgggaaaaagggattagcctgtgtaacctgtcatggtggtttggttcatggtacagagaaaaaattaaccatgcaggattgtattgactgtcataaacagaaaaatggtcccaccagctgtgaaagttgccaccaggataaggcggctataaagccgcaaaaccatgatgccaagtggctggcagctcatggtacggaagctaaaaaggatctggctgcctgtactacctgtcataccggtgaattggggctggagaagtactgcaatacctgccacaaaggcgtgacaatgccgcatccggcgaactggcttaaaaaccataaggtttcggatgtaacagtttgcaatacctgccatgcaaaaccggtggaaggaggcaaggcccagacctgtattagctgtcaccaagtagaaatgccgcacccggcaaactggaccagtacccatggtaagtttaccctgcagaacaaaaacgttaactgctacacctgccataccaaaaccgaatgcagcagttgccacaagatagatatgccccatccagcgacgtggctttcgacccacggaaagactgcgctggcaaaagggacaagtagctgttacggctcctgtcatacaaaagcaacctgtgacagctgccataaggtaccgatgcctcatagcagcagctttaagacaaccactcacggggcaacggccttggcaaaaggtagtagtacctgttatacctgccacagcaaaaatgagtgcacgacatgccatgcaaacgttaaaattcatgatagtggattctttgccaaacacagcagtgaatatgctaaaaatccagcaaaatgtaacacctgtcacaccaacaaaaccacctgcaacagctgtcacagcaaaattggccatacggaaacctggattaccagacatggtatagcagtaggacagtatggttctgatttatgttctacctgccatgaccgggttaagttctgcagtagctgccatcgctaaagcaaaatgggcttactccgcttggcagagtaagcccatatttacattagtgaaaaaagcttttggtaaaatcggatttttttttcgtcggtaaccggataaaccccctctaccggtatcccttgcttttgggccaaagtaagtatattttccgttgcctctttttcaatcagcaagcaggttccgcagtcggaacgaatttcccgcggtagaggaatcatctggaatttaaaagatttttcttttaaaatatcttccaattgcaggagatgatggatggacgggaaagttaaaaagaccagctcacgcataaataccccttcttgttctcggttctatacatcattatatataaagcaacagaaaataggaaataacattttggaataatatttcaaacttttgttatatttgccattcccgcccatcccgaaaaacttcttaacaagtcccttcaaaggtctcgagggtaccttctaagtacttttccacggctttttgggcatccttttccgtagttaaaaccggggttataccgtgggcctttaagtcttcctgcatccgccagcccatacctcccgaaattaccacctttaccccggcaaaagcttcaagaattcgggcatggcttccaccatggccgtggccgtgttcgtggtggtgatggtgatgatggtgatgggggccgtggaaggtgttttccaagatttcacttccgactatttttccgtcttcgacggtaaaaataacaaacttgggagcgcttccaaagtgagcgctgacatcctttccggtaactgacgccacagcaattttcatatttttctcctcccttggatttgtgaaagtaaaacttcctccttcaatttttaaagcatagccgagaattagagcccgggcaattttttcccgggcggtttttaaaatccggtggaaagtcggccgggaaactcccatcttttcggccgcttcaatttgttctaagcctaaaagatcctttagcctcaccgcctccatttcttcctgagtcagggtaatttctgcaagttcatttgctggaatacctgcaggtttaaaatacttaaccggtgataaataacttacatggcggcattttggtggccgcggcatgccgcacctcctttatgaacataatttcattattaactataacgcaataatgaacatatgtcaataataaattaaccacctaaggtaatatcctgttcctgataccaggaaagggcctgatagaggtgttcatctttaaaatccggccagtaatcatcaattacgtaaaaatcggcataaatcgattggattggtaaaaagcccgaaagcctacgccgcccaccccagcgaataattaaatccacccgggagatgtcagcggaaggtagcgcggaaaaaccttgagctaaatgctcgaggtcccatttccagccataatttactaaaaaatttacctttactgaacctttgccaaaaaccgttcttttttgggtatagggtaaaagttccggggggaactggggtgaggaggtattccccacgactaaaagggccgaatccctttgggataacctttttaccgcttcaacgcaagctttccggaaagcatcccgttgatagttaggcctcttggtgttatcaacggtgaaaccataaaaggttagttcgggaatacccagtgctaagcataattcgtaaaggcgaattccggggtcaatcccaaagaaatagcctttttctttagtcattccctgggcttcggcccagcggcggttgccatcgggaattataccgatatgttttggtaagcgcttaaaaaaataggaaaccataatatcctttcggacttatggtttccttcccagggtaaaattaatcattaagataagaattaaagctattattgcgccggcggcaaaagttccggaggcgtttaagtaatggctgacacttcctgcaaaaaggcttcctaaaggagcaaagccggcgaaaacggtggtatagatactcataacccggccgcggtaggcgtcacttacatttttttgcagataagaattgctaccggaattaaaggcaatggtaaaataaccggttaagaataacaacaccattgccgggaaaggttttttggctaaaggcattgccagttgaaagatagccattaaaaaagcactgattttaattactttatctaaattaagccttttggagaaagttgccatcgagagggcacccattagagctccaaagccaaaggatgacatcataaagccaaacatctctgcgggaagctttaaatcaatcctggctaaaatgggaattaagacgctgaaattcatggcaaaaatgcttaatgcggaaacggtaaggatagcccgcaacagcggtttttgcttaaaaagatagctaaacccttcttttaaatcttcttttatagaaaaggaagagggttttcttcttgccggcaagttatccattaaaaatagtccggtaaggacagctaaaaagcttagagtattgataaagaaacaggtagctgaaccgtatttggctaagactaaaccggccaatgccggacccaaaagccgggccaagttaaaaatggtagagtttaaggcaatagcgttggttaagtcttcggggccgactaaatcgataacaaaagcctgccgggtgggcatatcaaagctgttggcaactcctaagccaaaagcgataagtaaaagatgccagtaactgactaaatttaagtaagtgagaacggttagaagcccggagagaaccatcataaatgattgggtgattaaaaggatgtacctttttggaaaacggtcggcagctaccccaccaactaccgacaaaaaagtcatcggagcaaactgcacggcggatagtatccccagaagaaagggggaacgggttagttccagagtaagccacgataaagctaccgactgcatccaggtaccgattaaagataaagcctgaccgaaaaaaaacaagcggtaatttttgtgggagagagcggaaaaagttccaagtttaattgataaatctttggccatttaaatccctcttttcctatcactattttagcatatactttctttaaaataccaaaaatttggggtaaaataatcctgatatacaaattttaagcactggaggggtataatggcgttaaaaattgactttaataatgtctttcatccatatctgcaaaaggaaaggttaggggaagcggatattgatggttataaagaaaaatttacctctgcccttgtaagcttacgggagaaaaaagaaaaaggggaattgggcttctttcacctgccgtatcttccggaagaagaaatagctgaaattgaaaaaaccgcccgggaggtccgggaaaaatttaagtattttgtagtcttggggattggcggttctgccttagggcctctggcggttcatacggcattaaacaatttacggtacaacgagctttccgaggagcttaggggtggaccgaaattttatgtagaagataacattgacccggagcggatggcttcgcttttaaaggtaattgaaccggaaaagaccgtttttaacgttattaccaaatcgggggcaacggccgaaaccttatcccagttattaatagttacggaggtactaaagaaaaaggttggaaagcggtttactgaacacttgatttttactaccgatccggaaaaaggaagtttaagggcgcttgcccgggaactcggggtaaaaacctttgccattcctcctaacgtaggcggccgtttttccgagttgacacctgtggggctattaccggcagcggttaccggtattaacatccgggagcttttagcaggagcccgggaaatggcggaaaggtgcgaacgggaaaacctttgggaaaatccggcgggtttagcggctgccattcacgttttgctcttggagcggggaaaaaatatggcggttatgatgccgtatgccgacagcttaaaatatatggccgattggtacgctcaattactcggggaaagtatcggtaaaaggttaaaccgccggggagaagaggtttttgtaggacaaactccggttaaagccctgggggtcaccgatcagcattctcaggtccagctttataccgaaggaccctttgataaactcctgattttcttggaagtagaacgttaccggaatagggtggtgattcctccggattttccgcagtatgctgaactaaagttcttgggcggacatactttaaacgagcttattatagcggagaaaaaagctaccgaatttgctcttttgaaagcgagaagaccaaactataccgtaattttcccggaggtaaatccctatacggtgggcgagcttctctatttcttagaggcgaaaattgcttttatgggagaatatcttgatattaatgcttttgaccagcccggggtggaggaaggaaaaaaggccacctatgcgctcctgggtcgggaagggtttgaagagaaacggcaggaagttttaaaggtaaaaaaagaaccgcggtttattctggaataagaggagtgccaaactccaacctccagcatcccgcctccagaagagttggcccgctttaaaaattctcccttataaaccgatacaactcataaaaatccccggcgtaatcgggcgtgcggggattttctctttttacctcgtaatctttcacaaggaaagttttaatccccagctcttttgctaccagatcttcggctggatcgttaccaatcatcaggcagtcagaaggccgggctttaattttttccaaaatttctttatagtagttaggattgggcttacagtagtgcatattatcgtaatgggtaataaaacgaaaatatttaggggataaatttgcccaataaagcctttctatgatggcgcttctggggaaaagggcgttggtagccaggattaacgtatggccttttttatgaagatagcgaatcatggatcttgccaggggatggggtttaaagtagttaccgatatttttaaaagaagtgtggtaaaaatcttcgaaaacattgcggaggttggcggtacccgggtaaacccggtcaaaggcttgccagaaaacttcgctgtttagcttttctccggtgttttttaccgtttcttcggtagcttttaaaatagccttcacgataagatcggggtcaaacttacccttaacgtaactttttacttcctgaatataaagctttaaaaagtagtcaagatttaacggaagcaaggtgccgtccaggtcaaaaagaatgtaagccacatctctccctccctaatgggtattttatcacaaaaagtaatttcttagcttatctcttaattcatttgtgatttgaaaagcgcgggttaccagggtttcggcatcgaggccaggctcatcaggaatagctctcaagagtaagtattctctaaagaaaataaaggaataataaaagaaagaaagggggataagatgaagggattattttacctgagtgttgcagtattactaatttatggcctaatgtttttggtagggttgaagccggttcatgcttattttgatagccctgaattttgttctacctgccacgtaatgaaaaaggagtaccagggatatttaaaaaaaccacatgcaggaaaagtaagctgtgggggatgtcatttaccggcgggatttccccgttacgggattgaaaaaacttattcgggaatcagagattttctttctttttccttccgtacctatcccgatgtaataaaaatttcctcccgctcgcaaaaaattgtggaggaaaactgtcttcgctgtcatcagggggtcacggaaaagcttttgggggtgtcccagcggtgcaccttttgtcaccggcaggtatttcactgaaaactgttaggaggggataattttgacccgcggtataacaattggaattattatagttgctctaactttgcttgcgggaacttttgtggcctacattactgccaaaaacgatgttccctatagaactttgacaaccggttttaagaaagatgagattaaacccgaaaagtacggccaaaaatttccggttgaatataagtattacttaaaaaataaagaaatggctctggctcccagtaagtacggaggctcggtaaaaagagaccacctcaaggaatttccttatatgaaaaccttatgggcgggctttgccttcagtaaagactatactgaagatcggggtcatgtttatgctctggaagatgttaaggaaaccaaaaggatttccgaaaaaaccgccttagcctgtatgacctgtaaatcttcccaggtaccggtttatatggacaaatggggagtagataacttttataaagccagatttagagaaaaacaaaatctttttacgataccgattggctgttatgactgtcatgatgctcagaccatgaagttacgcattacccggccggcgttaaaagatgcgttaaaacgaattggccgggatccggagaaatttacggagaaagaacttaagaattatatctgcgcccagtgtcatgtaacttattatattgacaaggcaacaaaccgggtaatctttccctgggatgggggagtagatccggaagatatgtaccggcattatgaaaaaagaaatttttatgaatgggtacatcctttaagcggcactaaaatgctgaaatcccgccatccggagtttgaaatgttttcgggaagcgtgcacagtgcggtggggcttacctgcgttgattgtcatatgccgtacgtctatgaaggcggcaaaaaatattccagccactggtggacttctccgttaagaactttagagcagtcctgccgcaagtgccaccgggaagaggaggctaagcttagagagcgggtcttttacatccaggaccgaacttatgacttattaaaccgggcggggaaagccaatgaagaagcaattaaagctataaatgaagcagtatattctccgggggcagataaagctttaattgaaaaggcgcggaagcttcaccgggaggcccagtggtactgggattatgtcagcagcgaaaactctatgggctttcataacccggaaaaagccctgactacgctgggtaaatccatcgaccttgcccttagagccaaagctaccgccctccaggccaaaaagtaacagaagggacggttctgagaatgaccattttcccgaaaagaagcagggaaaatggtggctgacagaaccgtccctccagttaaccgtggatgaggcgggggaggcactgggcgcaggcccagacgctgtcgcctttatagcggatggggaaaagagctttatcgtattcggagtttccgcagaagtggcagaagatttcttctacctcccggtgagctctgacttcttccaccgcttcgtgggagaaggggaccgtttcccgttcttcaatggttaaagcaccggtaggacaaacagccaggcaaaagccggcgccgtcgcaaagctcttctcttaacactttggctttaccgtttactatttcaatagccccttccacacagggagtaacgcatttaccgcacccggtgcagagctcttcatttattttgacaatttttcttaccactttttccattaaaaaacaccctttctttttgttttttattttgtattttgctcaattttattatagcgggattttgcctgaatatttgtaggatagcgcaaaaatctctgtgagattggtcacagcaagttgcttgaaaattttttaaaaaagtcttgtcagagagaaaaaggagtgctaaaataaaagcacaaagtataatgtatacatgaatacaactcttgggggttgttaaaatgttttatttggttagctggtcctatggggaagaagaggttttttataaatttgtaagggaagaagagcttgataagattttagaagatgataagaattatattattacccccgtttatgtagcataacttaagttgaggaacaagaccctctgattcaggtcagagggttttattttttttttttgcaacttttttttgggtttttacatcttttacaggtgtaagaatttttttttgtgggggaaaatgatgaaattaaagcgttttttagggcttataatagcaaaaatcttacttaagtttctggttattttaaaaaggggagccggagctacttcattacctgggaaatttcttaccttttttgataggaattttttaaaagatatagcattaaattttaagataattgtggttaccggttccaatgggaaaaccactactaccaggatgatcgggcaaattttaaaagaaaacgggattacttttgttaccaattatgccggggcaaatcttttaagtggcattgccactgctttgttgcagggagtggatgttttcgggtgtccactggtgccggtattattacttgaaattgatgaagctaccctgaaaaaagtaagcaccgagataagtcccgaggttctggtagtaaccaacatttttcgagaccaactggacaggtatggggaggtttaccagactttaaattatgtaaaagatggggtggctaattttaaaaataccaaacttgtgcttaatgcggatgattctctggtggcttctctggccaaagtaaagccctttgaggtattttatttcggacttgatagtgaaggcttcgaggatttacagcaaaataccgatgcccgttattgccttttctgcaaaacaaagtatagctacgaaaagcactactacggccatttaggacattttaaatgtcctgcctgtggctaccggcgacccgaacctaatttaagctgtcttaaaattgtagaaatgggagaagattattcccggtatttgcttgggataaaaggagaagattttcagacataccatgaagttaatttatctttgccgggtatttacaacatttataatagtttagctgcgcttacctgcagccaggctttaggtttaaacctgaaaaaatctatggaagctcttagtaccttttccggagcctttggacggacggaaaatcttttccttgctggcaaaaagttaaaaatagttctggtaaaaaaccctgctggttttaatcaggctttaaatctccttactcaggaaaaaagtaaagtaggtcttgcttttttaattaatgatttaccggcggatggggaggatgtttcctggctctgggacgtgaattttgaggtattaaatttaattaccgataaaattaaatttattttagccggagggagaagagctgaggatctggcccttaggttaaaatatgaaggtttagccaaagaaaaaataaaaattatggagggttaccgggaagtaattaattttgggttaaaagaaattgacccgcaggatgttttttatatttttcctacctatacggcgctcatcgggtttcgtaaaactttaaacgaaaaatttaagttaaaggagttttggaagtaatgtctgagttgacaattggtcatttttatcctgacctgttaaatacctatggagatatgggaaatatcattgctttaaaaaggcgttcagaatggcgtggaattaaggttacggttaaacctattggacttggtgatgagtttagaagcgaggagtatgacttagtgtttttgggtggtggacaggattttgaacaggagattattcaggaagattttcttgaaaataaaggtaaagagttaagaaaggctatcgaaaacaacctggtggttttagcagtatgtggcggttatcaacttctgggaaaattctatcgtactgctaatggtaaagaaattgcaggcctgggggctttagatgtgtggacgatagccgggaggaaaagaatggtcggcaatattttaattgaaagtgaactattagaaaaggtcggctatgatggtaagattgttggttttgaaaaccactcgggaaaaacttatttggggcctgaagtaaaacctttgggccgggttatccatggttatggcaataacggggaagataattttgaaggagcagtatacaaaaatgtcataggaacctatcttcacggcagtgttttacctaaaaaccctggattggctgattatctgctcacattagccttaaagaaaaaatatccagggtttttaggattacaaaaattaaacgatgattatgaaaccatggtaagacgcaaacttatcagtcggttaagtggtaagaaacactggttactaaaacgttttttctaaaaaggagaatagtggagaaaatgctatctttgatgggaaatgacgtgatttttaatcgattgcatttcccccctgactttatgcatttcaaggtaaaaatatttgcattgggataaaagcaatattctaaaaggaagagatttcctaaaataaagaaaaaagcggcaggagggggttatatgggcgaactaaataatttacttcagatggaggagaaaatttttccacctccaaaggtacaggaggcagccaatttaaaggattttgaccgggaatacagggagtcggtagaagacagtgagaagttctggggaagagtggctgaggagcttttctggtatgaaaaatgggagcgggttttggagtttaattatccctggcatcgctggtttatcggcggaaaaaccaacataacctataatgctttggatgcccaggtggcaaagggccgggggaataaagcggcgtttatttttttaaccgaagacgggcgggaagaagtttatacctaccggatgcttaaagatcgggtggagcgcttgagccggggactaaaaaatctggggattcaaaaaggcgaccgggtggtaatttatatgccgttgaccccggaaggggttatggccatgctggcggtggcccggattggagcggtgcacagcgtggtttatgctggccttgggtttaaagctttaagggaacggattttagattccggagctaaattggtgattactgccgattacggttatcgccggggcaaaaaggttgcgttaaagcccatagtggatgaggcgttagaaggggtttcttgcgtggaaaaggttgcggtgtggtttcgggaagagcgccaacctttagggccgcgggaagtggattttctgacgttatttaaaaatccaccgggggaacctgcggaaataatggaagctgaagatcctctctttattttatatacctccggtaccaccggcaaaccaaaaggggtactgcacgtccatggaggctacatggtgggaacctactaccatgctaagaccttttttgatttaaaagatgatgatgtgttctggtgtacctcggatattggctggattgtgggccacagctatattgtttatgctcctttggtagcgggggcaacgacattatttagggaaggggcgctggattatcctacccccgatactccctggcagattatcgagaaatatcaggtatcggtcgtttttaccgctcctacggcaatccggcttttaatgaaatacggggaaaagtggacggaaaattatgatctgtcatccttgagactgattacctgtgcgggagagcctttaaatcccgaagcctggcgctgggcttacgaaaatcttttaaaaacccacggaggttttattgttgacaactggtggcaaacggagctgggagggcctaccctggggacgccgccggtaaaagcggcaaagccgggcaaggtgggatttgcattaccgggagtggtagcggatgttttagaccgggaaggaaaaccggtgccggcgggacagggtggacttttatgcctgaaaaatccttttccccatatgctgagaactgtttacggggatgatgcccgctacgaaaaagcctggcgggaaattcccgggtggtattttaccggtgatgtggcggtgaaggatgaggaagggtattttgctgtcctgggacgggcggacgatgtgctaaatattgccgggcatcggattgggacggcggaagtggagagcgctctggtttcgcatccggcggtggcggaagcagcggctgttggggttccggacccgttaaagggagaaattttgaaagcttttgtgattttgaaaataggagcggcgccttcggaggaactggcgaaagagctaatagagcatgtgaaaaaggagttagggccaatagtggtgattggggaactgaaatttgtggataaacttcccaaaacccgctccggcaaaattatgcgccgggtgttaaaagcccaggagatgggagtggatccgggggatttaactactctggaggaataaaaaaggaaaaaagccctttctgtcgaaataattgtttagacaggaggggatttctttgccaaaacaggaaagagacctgggtaccggaaagcttatcctggattttattgataaccgctggtgtgttatttattactccgaattttacagtgaaaagggacgggaactaaaggaagaaaatcgctggtattttgcaagcttagaggaagcggagagatactttaaagattttgtttgctaagagcaaagatttcgggctttgctctttttcttttacctctttatttcttctggtttagaagctaaaataaaagtaattccaaaaagaaaaggggatggcgatgcagaatattaataaaatttatgcccaggcagtaacggagagcttattacagcccgactggcggtggtatttattagaagataaaattaaaaatattttaaaaaccaaaaagttaccggagttttccggacaaactttaccggagtatctggctcacgtttctccctccgagtttgcccgctgggtagatatcttaaaccggataaccggtcctgcttttaaggaaataatagtggaggcttttcgggaaaaggatttagggtataaaattgaggtgttaaaaaatctcgaaaacattgaaggagagcatcttgtggatttaatggaggaagtggcctgggaacaggtggatgtagattcaattatcgctctaaccaaaaagtttaaccaaaatgctcttgattttcattttttacataaagtgaaaaatcgggtccgggaactacctttagaaaatcttctgcaggatagccaaggggagtataaaaatgcccttctctggctttatgcccagactaaaagtgagaaagcttataacgaaattatcaagctcagggaagaattacctgaggaatattttaattatcttttactaattgccgggggggagaaagctttagaagaaattaaaggtaaagctccagcaaaatttttcgaaaatccccaggaaatatttatgctcttagaagggttagatgaagccggaatgttatccaggataaccgaaatcgttaaacccgaagatttagcggatggtcttaagtttgtaatggcttcaattttagaaagtgggggcttttatcgggaagcggaaaagtattttgctgggcttaccggctttgattttccgcagagcctatatttaaaagctaagcttaccctccacagaggaaagcgagaggaagcccgggaaatctttttaaaggctttaacagcattcagggaacagcttttaaatcagcccgattttaacggcggtgaaatcgaagaactatactatgcgggatataaagatgggctattaactctggaagaaacggcgagcttttatgctgatcttttggaaggagtgctctggttttacggagcggtaaccagggaagaagtagagccgatttttcgagaaattctcggggtgatgttgccaataccggtagaagaggtgataaaagaacttatccgacggcagggggttgtggtaacggaaaagattatcgccctaaagcgggtttctgacccccagggacttatctcccgcagagtttcccggaagattctgccctctcccctgtcggtggataccgtgttacgggttttttacggggaaagttaccggctaatttccaattatcaggagattgagaaatacctgcaaaatttaaaacaacagcagggtttattgcttttaaaccccaaactttttgatttaaaagccttaattgaacgcttccaggtggaggaaccggaagcaattgtccacagttattcgcccctggttaatgaaaataatcccgaggagtaccaaaagcttttaaactacctggaaacggtttggaacgatactcctaactgggaactatttggtatgagcgtttccgagcttaaagaattatccggagaaaaactgataaactaaattaagggaattctttctaaaagtaaaggaggtagttggatgaaaatcgagcaaaagttaaatgagatgggtatgtcgcttccgccggcgccagcaccggttgctgcttacgtgccgggggtattaattgataactatatttatgtttccggacagcttccctttgaaggaggggaattaaaaaccagaggtaagttgggagcggaagttacggtagaagaagggatgcgtcttgccaaagtggcagctcttaactgcctagcggtggtcaaggggcttataggggacctcgaccggattgaaaaaatcattaaggttaccggttatgtagcaagtagcccgggctttaacgaccagcccaaagtaataaatggcgcttcggagtttttggcagaattactgggggatgcaggaaaacacgcccgggcggcggtaggggtcaacgaactacccctcaattctccggtagaagtggagatgattgttaaggtacgttaaaaatctatggtaaaataagcatagggtttaggggagttttgggttaataattttaaacccgaaagctcccctaaagctatatatggaactgttttcctgataggtttataataaaagaaaagagaaatttcctggtatccttttaaaaggtaaggccaaagcctgcggctttcgggagttaaatagaaataaaccggttggccaaaaatttttaggtacgattcaattaaaaagtccagactgtcaaggatccggatttcttttgggagaattaataaaggccttggcaattttgtggagtctggataaaaaatataccacaggtggttaacttttaagaaaaatagaattttattgctatcgggaaattgaccgagaaaacagcgggggtagttcataacttacctccgggataaaaataggtatattatcttatttaaaacgggtggtataggtgacagaaactaaagatgttataattagggaagcaaaggtagaagatttaaaagagatttttgccatttataatgaggaagttttgcacgggattgccacttttgataccgaaccgttggaaggagaagaccagcttacctggcttttaaaacggggggcaagacacccggttttggtgggtgaagtagaaggaagaattgctgtctggggtagtttaaatccctattctccccgcaaagcctatgatttaaccgctaccgaatcggtatatgttcataaggattttcgggggaggggctatggagaaaaaatgcttatggcgcttttagaggaagcccggaaccgggggctccgggcccttttagctttaattgcggccgaaaatgaagcaagtttgcggctgcacgcaaaatgcggttttcagaaggtaggggagcttaaaaaagttggttttaagtttggtcgctggttggatgtggttattttagagtacctattgttttaattgcccaccgccggcgggttattaattcttgcctcaaccgccgcaaagtttacgggaaagaacgtttaaacttttaatattaccttcaatttggggaatggttctggcaatgtatgccgataggtctttgtttttggtatacgctaaataattttggtaatttctaaggttagcttgctcgtagcgtaaaagccgaaaaacaatttcccggtccgtcatccttttcacctccaatattggttctaatttatcatatgaaaattattaacggaggggattttgtggaagaagcggttaagatgctacttacggcccgtcacgctattgcctttaccggagcgggagttagcaccgaaagcgggattccggattttcgtggaaattctggattgtgggaacagtatccggtggagaaagtggcctcaagaagagcccttatggagaatccggcgttttttttaaatttttaccgggagcggtttaaaagctatgccaatgttaagcccaatcgggcccatgaagccctggcgcggatggaaaaagcgggaataataaaaggcattgtgacccaaaacattgatggtttgcaccagaaagcaggcagtaaaaacgttatagaaatccatggcaccttaaaacgggtacggtgcgaccggtgcggaaaatattacttgccggagaagttagacgaagaagaagtaccccggtgtaattgcggcggtgttatccgtcccgatgtagttttatttggggaagctttaccccggcgggagtggcaaatagccctggaactggctgagcgttcggatcttgtcctggtggtggggtcgtctctggtagttacgccggccaatcaaattcccgggctggttctcttagaaggaggaaaggcaataattgtcaataaagacccgacgcccctggatgaccaggcgctggttcttagaggatatgccggggaaattctttccaagctggcggatatgttaggtgtttaagcaggcccgaaggaacccttcgggttttataatatagtttggggtgttttgtatggaacgttttttgttaaaagcaaattatacgcccaagggagatcaacccaaagccataaaggaacttaccgaagggattgagaaggggctaaaaatgcagacccttctgggggtaaccggttctgggaaaacttttaccatggccaatgtgattgccaatgtaaacaagcccactttagtaattgcacccaataaaacgctggcggcccagctttgtgcggagttcagggagttttttcccgaaaacgcggtggagtattttgtaagctactacgattactatcaaccggaagcttacttaccggccaccgatacgtatatagaaaaagactcggctataaacgatgaaattgataaactccgccattcagcaacggcggcgctttttgaacggcgggatgttattatcgtggcatcggtctcctgcatttacggtttaggggatccccaggaatatcgggaacttctactttccgttagaaaagggcagatttacgagcgggaagcaattttaagaaagcttgtagatattcagtatgagcggaatgagtacgacttaacccgggggaaatttcgggtaagaggggatgtaattgaagtttttccggcgtcgtataccgaccgggcggtgcgcatcgagctttttggcgatgaggtggataggattttagaatttgatactttaacgggagagattatcggggagctaaaacacgtggccatttttccggcaagccactttgctacttccaaagaaaagttagaacgggcgataaaaagcattgaagaagagcttgaagaacggcttcgctattttgaagagcggggcaaactccttgaagcccagcgtttaaagcagaggaccttgtacgatattgaaatgctgcgggaagtaggttacactaaaggaattgaaaactattcccggcatttaaccggaagaaaacccggcgagcctccctatacgttaattgattattttcccaaagattttcttatgattattgatgaaagccatataacgattccccagattcgggggatgtatgaaggggaccgctcccggaaggaggcgctggtggagtacggttttcgcctgccttcggcctttgacaaccggccactgaaatttcatgagtttgaagcaagaattaaccaggtagtgtttgtttcggctactcccggaccctatgagttaaagcattctcaaaagattgtggagcagattatccggccgacggggctggttgaccccgaggtagaagttcgacccacccgggggcaggtggatgacctctacggggaaattaaagagcgggtagcccgaaacgagcgggtgctggtaaccaccctcaccaagaagatggccgaggacctgaccgagtatttccgggagatgggagtgaaggtccggtaccttcattcggatattgataccctggaacgggttgaaatcctgcgagacttaaggctgggagtttttgatgttttggtgggaataaacctcctcagggaaggtctggatttacccgaagttagcctggtggccattttggatgccgacaaggaagggtatttacgttcggaacgctctttaatccaaaccatcggacgggcggcgcggaacgtaaacggcaaagtaatcatgtatgccgataccgttaccgcttccatgcaaaaagccattgatgaaaccaaccggcgccgtaaacttcagatggaatacaaccggaagcacggaataacgccgcaaacggtgcaaaaggcggtaagggatgttattgaggcgaccagggcggtgactgcagaactaccggaagtaaagcgggatttcatccagaaaatgagtgcgaaagagtttaagcagtatgtggaaaaacttacccgggaaatgaaagaagcagctaaagctttggagtttgaaaaagcggcgatgctgcgcgacttaataattgagcttcgggcgcaaaaggcggtcaaaaagtaataatggaggttttacacactgatggataagattgtcattaaaggggccagggttcataatctaaaaaatatagatttaaccctgccgcgcaataaatttatcgttattaccggggtttccggttccggcaaatcgtcgttggcctttgacaccatttatgccgaaggacagcggcggtatgtggaaagtttatcggcttatgcccgccagtttttggggcaaatggataagcccgatgtggattttatcgaagggttgtcaccggcaatttccattgaccagaagaccacgtccaaaaacccccggtcaacggtgggtacggttacggagattcacgattatttaaggcttttatatgcccgcataggaataccccactgcccggtttgcgggcgggtggtagaaaaacaaaccattgaccagatggtcgatagattattagctttacccgaacggaccaaattggtaattatggcgcctattgtgcggggaaggaagggagagtttgtcaaaactttggaagatatccggcgtcagggttttgcccgggtccgggtggatggtattctttatgacttagcggaagatattaagttagaaaaaaataaaaaacacaatatagatgttgttgttgaccggctggtagtaaaagacggaataaaaaccaggctttacgattccttagaaacggcgcttaagcttaccgaaggcctggccgtggtggaagtagtagacggggaggagattactttttccgaaaactttgcctgtccccactgtgaaataagccttccggagataagcccccggcttttttcctttaataatccctttggggcttgtcccgaatgtaccggccttggttataaattggaagtggatccggatctggtaatacccgataaagatttgacgttacggcagggggcaatagccgcctggaacgcgggtaatatgcaggcatattattttcaggtgttagaggctttagcgaaaaaataccggtttagtttggacgtgccggtaaaagagcttgagccggaaattttaagaataatcctctatggccttcctggggagaaagtgcgggtcaggtattacaactataccaatggcaattcttacacctttgatgccaactgggagggggttatccccaatttagagcggcggtaccgggaaacccagtcggaggcggtgcgggaagaaattgaaaaatttatgacccagagaaaatgtccctcctgccagggagcccggctgaaaaaagaagccctggcggtaacggtgggcggaaaaaacattcatgaacttggcgaaatgaccgtggaaaagcttctggctttcctggaaaatcttgagttaacggaacgagagtttttaattgcccggcaggttttgaaggaaattaaggaacgcctggggtttttaaacaacgtgggtttggattacctgaccttaaatcgctccgctactaccttgtccggcggggaagctcagcggatccgccttgctacgcaaatcggttccggccttaccggggtgctgtatgttttggatgaaccatcaataggcttgcatccccgggataccaagcggcttttggatactttaaagcgactgcgggatctgggcaatactttaatagtggtggaacacgatgaagagaccattagggaagcggattttattgtggacatgggaccgggagctggcgaaaaaggagggcaggtagtagctgcaggtaccctggaagaagtgctaaagcatcccgattcaattactgcaaaatatctcaggggggaagaaaaaatccccgtgccgctttttcgccggagcggtaatggtaaaactattaccattgtgggggcccgggaaaacaatttaaaaaatattaccgtcgaaattcccctggggaaatttgtagcggtaaccggggtgtccggttccggtaaaagtacgttaattaatgaaattttgtataaggctgtggccggaaagttttataagctaaaagaaaaacccggagctcatgatgagattttaggtcttacttacattgataagataatcaatatcgaccagtcgcccatcggccgaacaccgcgctcaaatccggcaacctataccggagtgtttaacgatatccgcgagctttttgcggcaactcccgaagcccggatgcggggttataaaccgggacggttttcttttaacgtgaagggcggacggtgtgaagcatgtgaaggggacgggataatcaagattgaaatgcattttctccccgatgtttacgtcccctgcgaggtgtgtaagggggcccggtataaccgggaaacgttggaggtgcggtataaaggaaaaaatattgccgaggtactggatatgacggtagaggaggctctggagtttttctccgcgatacccagaatccagcgcaaactgcaaaccctttatgatgtgggcttaggctatatccgcctggggcagccggctactaccctatccggcggcgaagctcagagggtaaagctggccaccgaactttcccggcgttccaccgggaaaactttatacattttagatgagcccactacgggcctgcacattgccgatgtgcataggcttcttgatgttttaaaccgcctggtggaagcgggaaatacggtggtggtaatcgaacacaatttagatgtaattaagactgccgactggataatcgatttgggacccgaaggaggcgataaaggcgggcaggtagtggccgagggaactccagaggaagtggcccggaatccagcctcttataccggaaagtttttaaggccgtatcttaatttataaaaaagcccctggtttttaccaggggctttttagtgctattgtttggggatttgcttgagatactcttctgctttgttcaaaaggagttcagttaaagcggtgttgtggataccgtgagaagcgtcggcggatacaatgcctgctaaagtatcagcatatttgtaatttggatcgttgtaagctgctgcgtaggtggtttttagctggttaagaatgttgttaacacgagtatcgactttatcggtccaggcttttacggcgtttgcatcaaagccaacagcatcgtgacagacactgcagctgttgtaagaagctttgtaattattccggtagttgcctaaatcaggattgtttttaacagtaacgttttcaatggtgatggttggttttcctgctttaaagtagtgatagccattgggcatgtggcaggttacgcattcggcactgcccattgggttataaactttttccggtatacctaaagcagtgaaggaagcaccgagctgtccggtaaatacttctttttgtggatgatgtactcctttgctgccagaggtagcggtgaagccttcaccggtgtggcactccatgcaaagttcgttgggttcatttcttaattgcttgccgtagcctttttcgctgtgcggactgtggcaggtgacacaggtaatgcctaacttaaagtcactgagttttacagttgcattaaagtcagctgcagttttacccgggttagcctttaagtaatcttccaaagcagtgcggtaatcctgggagtggcactccaagcagctgacactgccgtgggaattttgctgaattgtttgtaaggaaatgccatgcttaccataaacagttccacttacgccggcaattgcgtattcatcgttgtattcgccgccacggtggtgcgcaccttcgtggcacttttcgcaggtagcgctggcagcaataccgtctttttcaccaagaatcttggtaggatcaccggttgcagcgtggagagcaccaggaccatggcaagcttcacagccgatacccggttcggtaaataattctttataggtatttccaactacagagtagggagtaccggtaataccattcggtccaggataaccggtgacgtggcacttagcacagcttaccagccagttctgggtgtgggaatcagctacccactgattttcggtcttatcaaaagcatacggcatgtatttgtaatccttgcctacaaatagcaattctgtaggcgagttaattacataccgaacatcgctggcctggaacttatcgttcaaggaccagagcagcatggaaccaaagaaatcgggtgtttttaccatattggggtgccaggttgccgaaaacttggagaagccatggcagctctgacatttcttggtgccagcatatgcagttggagccggtaatactcttggatattttgcttgaactgcgttaaatgctttgactacttcggtgcggcttgcagcagctgttggatcaaggtaaagcttgcttccagctttccgggcgcttaaatagcctttctttacggcccagactaaggctttttggttggcagaagctgctttggtgtagtcggcatattttttaaggtcgttagcggtaactttagcaacttcaccttgggcttttaaagctaccatcaagaagtaagcgagtctttgcttggtgatgtttccggaaaccttgccaaaggctgactcggaaagtccggaaaccctggcaaattccttaaccacgttggcttcggtgagcgggtcataatttaagtctacggctaatttcttgccgttttgcatgaacaggacgccccgctcggtcaagggaatttgggcagtgctggttggcgctgcgtggcagatggaacaacttttagcatccttgtggaatgccagcgttccttgtgtgggtacctggtggcaataactgcagggcttccctgtatctttggcgtactgatcagtagccaataccggactggctactaacaggagaagaactgcagcaaccagtacccatagacctttacgcataaaacccctccttttaaaaatttttttggttataaaatctgactataactataaatacgacattcacaaacaaattccttcttaaaaaaaacaaaaaaatgataaattttaccaatattagcaatactataagtagtaaaaagtatattcgaaaagattaaaaatataaaatcttagaaacattcatgtaaattttatttaagtcttgaaagtttaagtgataaaataaagaaaaaagttttgttacgggggagaaaggaatgattgtaggcattgatgtaggggggacgtataccgacggagttgctttagatcagggcagggttgtggctaaggctaaagtggttacgaaaaaaaacctgccggaaacctttgctgaagtattagcgaagcttatagcccagcacaatcagcctattaaaagggtggttttgagcactaccctaattaccaatttggtggcggagcgaaaatacgaccgggcggcggccttgttgcttccgggggcggggatggattatgaaaaaataaactttccctttccggtgaaggtagtttccggaatggtcgattttcgcggtcgggttttagaagaaattaacgaaaaggaagtagaacaagctttacaggaatttttggctcaggggtttaggaaagtagcgctggtggggaagttttcggtaagaaatcccgaacttgaacgaaagctttaccagattgtcaaaaaaatcaacccgcaaataaaaaccgctcttgggcataagaccggggggcgtttgaattatctccggcggatttatacttcggttttatacctgatgataaaagatgagtttaaccgctttgttgaggaattaaaggtaatcttttatgctttaaagatccccttaaacgtagtttttatcatgaaaggagatggggggattgtaccacttcttgaagttgagcgttacccgctggctactctttattccggcccggcggcaagcgcattaggggcttatgccctctgcaactgccaaaacatagtcgttttggatattggaggtaccaccaccgatattgctttagttttaaaccagcgtccgcttctttcccataaaggggcggatattggggaatttttaacttcggtaccgagtttagcagttacatcagttccttttggtggtgatacggcggttaccgttttggacggagaaattacctttaccggacagcgccagggtccggcctactgtctgggcggtccggcggttaccgttaccgacgctttaaggtttttaaatttaatagattacggggatttccagcgggccaagcggggaatccacaagcttgcccaggaaaccgggttaacttcccttgatgtggcccaaaaaattgttgatatatttaccgataccgtggtccaggaagtaaaaaatacttttaagcgctgggaaaacgaacctcgctaccggatttatgaaattatgacggggaagaaatttgaacctgaattgctaagtggagtagggggaggagcttacccgctcaccttgctgatagctaaaaaacttggaatgaaaggggtaatttatgaaaattacgaagtggccaatgctttaggagcagccctggcccgggataatctttccattaccgtttatatcgataccgagcaaaaatatgtggccataccggaatggggttacaaagaggccattcccaaactaaaaaattacagcgaagatgaggttaaagaatttgctctgtttgtttttcgcattggtgctaaaaggatgaacctgcgttatcctcccggcagtgaagaactaatctactttgagcagtttaatgtggtgcgggatatggtgacggaaaacaaaatatttattctggaaatagcggtgccggccgggattttacggccggtagaagggaggattttgtatgaataaaaccggtcttttgtttttccccgcctttgattgggccatatcccctacccatccggaaagggaagaacggctgttatatacccgggaccagataatggaggaagggattttagaactcccggggtttgtggaatacagtgcccggccgggaaaagtagaagatgtggagagggttcacctaacaatacccgatacccaaaaggtcgttaccgatgcccatttaattgcggcgggaagctgcattgagctggcggaacggattttagccggggaggtaaaaaacggttttgctctggtgcgaccgccgggacaccatgctacccgaacggtttacggcaatcggggcttttgcaatataaacaatgtcgctattactgtggattatcttcgctgggtaaaaggggttaaaaagattgccatcatcgataccgatgtccaccacggcgatgggacccaagatattttttaccatgatcccgatgttttgtttatttctttgcatcaggatgggcggaccctgtatcccggaacgggctttatagatgaggccggaactcccaatgcttacggtactaccataaacttaccccttcctccgggcagcggtgatgaggaaatattgtatcttttggaagaagcggttttacccattttggaagaattccagccggagttcattattaactcggcaggacaggataatcattactccgaccctttagcccggatggcggttaccgcccggggttacgggcggattaccgagctaatcaagccggacctggcggtattggagggcgggtattccattgaaggggctttaccgtatgtaaatttagctattttgcttgccctttacggggaaagttacgaaaaggttgtagaaccaaaggggctacctttagaataccgggcaaggcacaaagattatgctaagaagcttgctgctgtcacgctggagcgctggcggatgcgggaagaattggcagaagaagaaaaaaggaaacataacggttactactcttataacaggtcaatattttacgataccgagggctttcacgaacaccgggttacaaccgtaaagctttgcgaccggtgcccgggctacgttgggttgagcagttatgcttacgttgggaaccgggtggtttccggatttgctacaattgttatgccgggaagctgtaaagattgccgggaagaagcagaggcggtggctcttgaagccctggcgaaaaaaaattacgataaggtggctgttattcccggaaagcaggttgtgaaaatttgaaaaatgtttccggaaaaatatttccaaaaagtgtgaaaaaattttcttttttttgcttccttctggtttaataccctatggaataattattgctatgaataatgtgttgaggcaatagaccaggagggagtaacaatggaagctttaaaaatagcgccgacagagaagtttaaggaaagagttgcaaagcttttaaatccccggagcatcgctgtaattggtgcttcggaaaaaccggagaagcttggcaacgctattttaagaaatattgtttccgggtataaaggagaagtttttggagttaatcccagggtaaagaaaattcaggaaatcgaagtttacccggatgttttttccttaccgtatccggtagatttagcggttatagttttgccggcggaaaaagcggtagttgctttaaaagaggcggctgaagctggagttaagtcggcggtggtgatttcaggaggatttaaagaaacgggtaatgaaggggctttactggaagaagagataaaaaaaatagcccttgactttgagatgccggttttaggtccgaactgtgtggggattgtgaataataatttgcaattaaatgctacttttttacgcacagccccccttaagggggaaattgcctttgtttcgcaatcgggagcaatattgtctaccgttttggaatggagcttaaaagaggatttgggcttttcctacatgattagtatgggaaacaaagcggtcttaaatgaagcggattttcttccggcaattgccaatgatcccggtaccgctgttattttgctttatattgaggatgtggtggagggcagtagttttttaaaaaaagcttacgaagcgagtttattaaaaccggtggtggtatttaaagcgggaatcagcacagccggtgctaaagctgccagttcacataccggagctttggcgggaagcatagaaggctataaattggcttttgccaaaaccggtttaatccgggctaaaactttagaagaaatgtttatttatgccagggtttttgcttccggacagaaagttaccggtaaaaacatcgggattgttaccaattcaggaggtccaggagttattactgctgaccgactggaattaaatggtttaaatattaccgggttatcggccaaaaccattaatgaactaaagacctttttaccccgggctgcgagctttggcaatcccgttgatatcctgggagatgccgatgaggaaaagtatgcgatgacgcttaagacagtactggacgatgagaaagtggacggcgtggtagcggtttatggtaaaacggcagttatagatatggaaaaaatggtgcaggcggtaattaatggtcgaaggaaaaatccagataaaccggtggttgcttgttttttaggcggggttgatagcagaagagcaaaagagcttttaaataaaaataagattcctttttattcttttcctgaagcagcggcagatgctctggcagtcctttatcgttattacagctggcgggaaaagcaaaaggaaggaaaaacagagtttagttttgatgatatcgaccggaaattagcccgggaaattatcaaaaacgccctggttgaaggaagaagaaatcttacaggttatgaaacggcagaagttttaaaagcttttggttttccggtgctgccggtaaaacttgtacgaaatgtccaggaactgcgcaaagcaattgaagaaataagttttccattagcgttaaaaattgtttctcctgatcttctgcacaaatcggatgtaggtggcgttgccttaaacattaaaaacgaacaggaggcaatcagggcttatcaaaaaatgatcctggaagttcccaaaaaagtaccggaggcgaaaattcttggggttgaggtacaaaaacaaatagcacctggtttagagatattcataggagcaaatcgggacccggtttttggtccaatcttagcctttggcctgggaggaatatacgtaaatcttttaaacgatatagcattaagattaaattataaatttaccagggaagaagctttagaaatgatcaaagaaacaaaggtatacgaaattataaaaggctatcgcgggcaaaaagcttatgatctgaaaattattcaggaaattttgggaaggctttcgcttttcttggaggaaattccggaaattaaagagattgattttaatccggtattcgtttacgaaaaaggtgcattaatcatcgatgccaaggtagtacttgccgggcataatatttaggggtatttaaagtaggttttggggattgttctccaaagcctatttttttgtgctataatatatacagtatatacacaggaggttttaggggtgaacgtgcgcaaaacctttaaggtgggcaacagtttggtagtttccattccccaggagtacgttaaaagcctggggattaaagaaggagatccgctgattattgaaccatgggaacatggttttatcgttaaaacctttggggctgttggaaaggaaagcaagataccttccggaaagagtccggtagagaaattactggaaaaatacgggtttgtggtggaggagttttcttcatgatgaatttaaaagaatgcttgaatgcttattaccgctattacggggaagaaaagttgatggcggtaaatgtggatgctttagataaagctttagccgagccttacgccaaaacgtttattggaggaagggaaatttatccggaaatgaccgataaagctgctgctctttttgaggcaattatcaggcttaaaccttttcctgtgggcaatcttgcttttgcttttatcttaacggtactgtttatccataaaaacggctggcggcttaatgcgtcggacgatgaagtcaggcaatttttaaagaatttttcggaaggagtccgaggttctgtagatgtgaaaggctggtttttaaagcgaatggagcaagtgagggattaaagttgacattatgggaaaaagtcaagaatttacccgacagtcccggagtttatctttataaagacgaaaagggcgaggttatttacgttggcaaggctaaaaacctgaaaaatcgggtgcgttcgtactttcaacctccggaaaaacttttgcctaaaaccagggtaatgatggaaaaagcaagggacatcgaagtgattattacttctacggaagtagaagctttaattttagaacaaaacctcataaaaagataccggccccggtataatattttgctgaaagacgataagtcttatccttacctgaaaattaccggtgaagagtttccccggcttttaattacccgcagggtagttaatgatggtggacgctactttggtccgtaccccgatgcgggtgcgttaaacgaaacgtacaagcttttacggtcaatatttaaatttcgcacctgtaccccaacgatttttgcccagaagaagcgtccctgcttaaactttcatataaaaaaatgttccgccccctgtgccggggaaattagccgggaagaatattttaaagaaatcgaaatggtggtagattttttggaaggcaggggcgaaaatttaattaaaaaattaaaaaaagaaatggccatagcttctgataatctcgaatttgaacgagcggcaaaattaagggaccagatcttagctttggaaaaaattttggcgaaacaaaagatttcccgtggccagagaaatgccgatgtagtggttgttgctaacagggaaaacctgggggtaggattgatttttgttattcgccaggggaatttattagggcagaaagtttatacctttaccggcgagatggaaaccggggagcttttaaatcaagttttagtaacccactatggagaggccaaagaagttcctgttgaaattatcctgtcaaccagggaaaatttagatgaagaatttctcaattcctggtttgaacttaaatttgggaaaaagcccaaatttacggtcccgaagcggggagaaaaatttgaacttttaaaaatggctttagaaaatgtaaactttactctggatgaaaaaattaaattaaatgaaaagaaacaattgttaaacgaaaaggctttaatggacttaaaagaagccttaaaccttccggtggttccaagaagaattgaaggatacgacatttcccacctggctggaacgggaacggtagcatcaatggtggtatttattgacggtgagccggtaaagggaaaataccggcgttttgccatccgcagtgcggccaatgatgactataccgcgatgtttgaagcggttttgcggcgctttaaaaagtaccttgctttacaggaagagggaggagccgatggctcttttgaagagctgccggatttagtgttgatcgatggcggaaaaggacagttgaacgcggctatggatgctttaaaagaaactaatcttctggggaagtttacggtaattgcccttgccaaggagcaggaggaaatttttcttcccgggaaaaaggactctcttttattgacacaggaccgggaaggtttaaaattgttacaaagggtacgagatgaggcccaccgttttgccagaggttaccaggaaaaaaagcgggttaaaacccttgcttctcttttagagcaagtagaaggaattggtcccaaaaggcgaaaacaacttcttaataaatttggcagcattaaaaaccttagagaagcaacggttgaagagattacagcggttcccggaattacccgggaaatagcagaaagattaaaagagcttttggaaatggagtgattttttgcggtaccgattattagctgtggacctggatgatacttttttaaacaaggaattgcaggtttcgccacgggtacaacaagcggtgatagaggctttaaagaaagggattatcgtgaccctggctaccggacgaatgtaccgttcggccaaaaaatatgctttttcttttttaggagacattcctctgattacctataacggggcattgattaaatattcccgttcggaacgggaagtataccaccagccggtgcccggggagctggctcttactatttaccgcagggtaaaaggacattttcaccttaatgtttaccaggacgatgaacttttggtcgaggaagacaatcaatatatcagagattacagcaagattgcgggcgttccttttcgggtagtaagcaatatagaagaacttttagggaaaaaagctcctactaaacttttagctattggggatccagaagaattagaccagctctgggaagaaactaacggtgagtttcggggagttcttcacattaccaaatcgaaaccccattatttagagtttttagctgccggcgttaataaaggagaggctctaaaaatcttagctcaacatttagggatttcattaacggaaacggtagcggttggagatagctataacgacctggaaatgttagaggcggccggtttgggagttgccatgggcaacgctctaccggaggttaaacgccgggctgacttggtggtaccggctaatgatgaggatggaattgcttatttaataaatgaaattattttaaaaaattaaaagaagggagaggtttttatggacttaaaagaaattagggcaacagccagagaaaaactcaaaggattttgccgggtttgcccggtgtgtgacggtcgggcatgcgccggagaagtaccgggaatgggaggagtaggtaccggaaaagcttttcaggaaaatttacgggctctttcccggtataagttaaatttaagaacgattcacggagtaaaagaaccggatttaacctttgaactttttggggttaaggtaagcatgccggtttttgctgctccgattaccggaaccacttacaacatgggcggagcgttaaccgaagaagagtatactttagcggtggccgaaggtagccttttagctgggaccttagcttttaccggagatggagccgatcccaccatgtacggttcggggttaaaagcgattaaaaaagtggagggtaaaggtattcccattattaaaccaagagcgcaagaggagataattaaaaggattagagaagcggaagaaacgggagctattgctgtaggggtggatattgatggagccggattactaacgatggctttaaaggggcagccggtcagtccgaaaaccctggaagaagtaatggaaattgttaattccaccaggcttccgtttattttaaagggtatcatgacccctgatgaggccgaattagcggttagagccggggcgaaagccattgtggtttccaaccacggaggaagggttttggatgaaactcccggggctgccgatgtcctgccggaaattgctgccagagtaaaagggaaaatcaccatcctggccgatggaggagtaagatccggtgtcgatgttttaaaacttttggcgctgggagcggatggagtattaatagggcggccgataattgtggcagcttttggcggtggtgccgaaggagttaaaatttaccttgagaaaattaaaaaggaactaagggaagcgatgcttttaaccggagttgcgcgggtgaccgaagtcccgggaacaattatccggaaggagcagtaagatgggaaattatgttgtggggatagacctgggaggtacgaaaatttatactgccctggctaacttaaatggtgaaatagtggcggaagaaattgagccgactaccaaagacgaaacaaaacttttacaccagcttgggaatatggttaaaggagttattgccaaaagcgcagtaccgaaggaaaaagtgctgggaatcgggattggtgcgccgggaacggtggaccaccgtaccggaacgcttattaccgctcccaatcttccctggcaaaattacccgcttaaaataaatttgcaagcgttgctccgtttaccggtggaagttgataacgatgccaatttagcagctttgggtgagtacaggtacggtgctggccggggccataaagacatggtttatgtcaccgtaagtaccgggattggtgcgggtataataatagatggacagctctatcggggaagctccggcagtgccggtgagttaggccataccattgttgaaccggggggtccccggtgcaattgtggccgacggggctgtctggaagtaatggcctcgggtacggcaataggagaaagggcacggcaattggtggccgaaggttttggccaggaaattttaaaattggctcaggggaatattgaggctattaacgctaaaacggtgggggaagcgtttttagcgggcgacccggaagcaaaaggaatattaaacgaagtggctttttatctggggataggtctggccaatgtggtgaacctcttaaacccatctctaatcgtcctgggaggcggggttataaatattggcgaaccctttttagagttaattcgagaagagctggcagagaaggctttaccccagccctataaagatttaacggtaaaaaaagctgttttagggagtaaaaccggagtcatgggagcgatagctttagccttggagcggttttcttaaaggatgggatcaaatgttttccggtgattttcatacccatacccgctatagcgatggccggggaagtttacgggaaaatgtctgggcagctttaaagaaaggtttacttttttacggagtttccgaccacggtccggccaatattggtaccggggtacggcaggaaaaggtctatttaaccatcaaagaagaagcgcggaatcttgaaaaagaattttccaaaattaaaatactggtgggggcggaagcaaatgttatttcattagagggggatattgatattagcagggaaattgtttccgcccttgactttttaattattggtcttcacccgtatgttttacccaaaactttaaaagatggctttttgtttgtccttcctaacctgttaggccggcttttttccggtataaaaaagtatcttgtccgggtaaatacccgggcgttaatccgggcaatagaaaaataccgccccctggtaataagtcatcccaacctttttctacccgtggatttagaggaactggcgcaggtttgtgctaaatacggggtggcgttggaaataaataccggacataactatcccaaggatgagatagttctggcagctttaaaaacgggagcaaaactgatggttaacagtgacgcccactacccccaaacggtgggcgaactaaaaagcggggaagagcttttgctgcgttataattttcctttggacagggttttgaatataaaaagatctgaattaaattaaacggtgggtggaataatgcgctttttaattgtaacgggactatccggagctggtaaaacgcaggcaatgcgcgctttagaagatcttggctatttttgcgtggataacttgcctccggttttgatgcccaagtttgcggaactggtagctcatgcggaaaataaaatagagaaggtagctctggtggtggatgtccgggggcagaagttttttcaggacttagactgggctctgggagagttaacgaagcttggaataaagtacgagatcttatttttagaagcccgggacgaagtattattaaaacggtttaaagctaatcgccgggggcatccgctgggagtacggggcagtcaaattttagataacatcaaaaaggaaagaaaatttttagagaatttacgggcaagagccgataaagtaatagatacttccgatttacagccggcagatttacgaaacgagattttaaactattacggagaagagcaaaagcgcagcaaaatttccataaatatcgtaacttttggttacaagtacggtctacccttagatgccgaccttattatggatgttcgttttttgcccaatcctttttacgtaaaggaactaagacccctttccggaagcgataagccggtttatgattacgtttttaattatgaggttaccaaaaaatttaccgaaaaatttttggatcttattgaatttttaatgcccttttaccaaaaagaaggaaaaagcaatctcgtcatcgccattggttgtaccggtggccggcaccggtcggtagctattgctaattttctggccaggactttagaagaaaaaaattacgaagtgtacctgcggcaccgggatctggaaaaacaccgggaggaataaggtaatgaaaaaatatttattatggttgtaccccggtttaaaaattaagagatacattttgcttattattgcgggaatattatcctttgcctggggttttcaccttttaatagttgaaaaccaaaggctttatttgttgattgttttatgtataagtatttttttaattgcatatggttttaaaaagctcttaaattccgttttaaagagtttgtatccggacgaacggggaaatgtcattgaagaactttatcttagaaaaaagcttttaaggggcccaaaaattgcggttattggtggtggaaccggacttgccaccttacttcggggattaaaacattacacaagtaacattaccgctattgtaacggtagccgatgacggaggaagctctggccgactccgggaagaaatgggtatgctgccaccgggggatttaagaaactgtttggtggctctggcggataaagaaagtctcatggaaagtttattgcagtttcgttttaccgaaggtgatttggccggtcacagcatgggaaatttgcttttagctgccctctggaaaattaacggaaatttttcccaggcggttttttccctgggacagatcttaaaagtaaggggtgttgtttacccctcgacggaagataaggtggttttgcggggtattcttgtaaacggcgatgaagtggtgggagagagccgttttcgggaagtagcggtgccgattaaaagggtttatctccatccaccgggagctaagactttgccggaagtggagaaagcgttgctggaagcggatttgataattttaggaccgggtagcctttttaccagcattatcccgaacttgctggtaaaaggggtggtggagagcatcaggaaaagccgggcgccggttctttatgttatgaatataatgaccgaaaagggagaaaccgctggctttgcagcgcacgaccacttgcaggctattatagagcacgcgggaccgattgtggattatgttttggtaaataacgaaagctttgccgaacaattgttagctaaatatcagcgggaaggacagcagccggtggcggtaaacgaaaagcttttaaaaaagcttggggttaaaaaggtgataaaagcaccgttattagaccagaagcagtatttacgccatgattcggagaaactggcccgggtaattataaatttttaccggaaggaaattgcggaaaaaatttaagcaaatgggggaaaatagatgaagcggatattacttgcctttttactggcgttaattgctgtggcaagtattgttaccgtcggatggctttcttttcccagggaagcctttgccgattaccgggagcgaggggtaccgattttaatgtatcataaggtaaaccccgaccctaaaaccggcggccttgggcttagagttttgccacgggagtttgactggcagatgcgctttttaaaggagcatggttttcacacggtatctttggatgaagcggtggattatcttgaattcggtaagcccttaccggaaaaaccaattgtgataacttttgatgatggttaccgggataattacgtttatgcctttcccattttaaaaaaatacgggtttcgtgctacaatctttataattaccggaattgttgggaaaactaacgagtgggatgagcgggaaggaaagcctaccaattacatgttaacctggaaacagatagatgaaatggccaattacgggattgaatttggcgctcataccgttaaccatccccggctaacaaaagtaccgctggaattagcggaaaaggaaatttttaattccaaaaaaatgttagaagcgcattttaagcgcccggtaaaatatttttgttatccctatggtctttacaatgaccaaattgtagaaattgtaaaaaaagccggttttcgagctgccactactacccagctgggaattaatgcccggggttgcgatttgtaccgcttaaaacgcttgcgggttaccggccacatgagtcggaggcaatttgtggagcagttagaaaaatatttaagggaagatacgtggaaaagggagcataaaaaatttctaccgggttatgttaaagatacaatccttcctttattcccggggcgctccggaagtaccactcctggccggtcaggtggttgtatggtataatttttttgaggtggtaacatgtcttttgcccgggaaacgaaagaagagctggcccacattatcccccagaaaagctgctgccagagggcggaactgggagcatacgtcaagatgctgggggatttgggtatttccaataaaaagttaaaactatcccttaaaactcccctttcttttttggcgcgaaaaattttaattcttctaaaaaataatggttttaaaactaaaaccctggtgcaggaccacgggagactttcccaaaaaaatttttattatattgaagttgaagaacatgttgacgaacttcttaaagagtatggctttatagatgaaaaagggaatttatctaaccgcattaacgaaaattatataaaaaacgattgttgccggcgaagttttctaaggggcgtttttttagccggtggctctttaaacgatccggcaggagactatcatttggaattaaacctgcccgatgaggcttttgcccggcaggtttcaaaggttttgcaaaagtaccattttacttttcggctcttaaaacggaaaactgctccttttttatatttaaaggatgcggaacagattttatcctttttaagtttgataggggctcaccagtcgcttttaaaatttgaaaacgttcgggtggtgaaagaagttagaaaccaggtaaatcgcctggttaactgtgaaacggccaatatcaaaaaagcggtaaaaacggcggtgaagcaaattaaagatattgaatatatagcggaaaaaataggccttgataacttagaaccggctttaaaggaaattgctcttttaagactggacaatccggatttaagtttaaaagaactgggtagtcttttaacccctcccctgactaaatccggagttaatcaccgctttcgcaaattagaacttatagctgaaaaaataagaaacggggcgcttgggtaatggatttagaagggcttgatcgggaacttagagaaaaaacaatttatggaattgaactggcccgggaaagattcaggaaaaggaaggaaccgaacaatagcaaagaaagctttattttgtttgccggcaccgggggcaatcccgaagcggttttaacccagaacccttataccgcgggctttattattaaacttgaacaatttttaatgtgggttgatcctggaccgtcggcaatagtgcgggcccgggagttaaacatcgatttaggtagtatctctgctgtttatatctcccatggccatcaggaccactacggtggtgcggaaccaattattgaaggtatgtgctggggaatgtttgcccgtagaggttttctcctggctcccggcaaggttttagatgaccgcatgataagtccctttcatcagggaattaataccggcttttattccgggggaccggaagtggtggttttaaaagcgctcactccagtggagattggaaaagtaacggtaataccggtggctgcgtatcacggggaagaaaattacggatttattttaaaatacaaaaatttggccatcggttataccagcgataccaactacattttaagctaccagagtttaacgggagttaaaaaggtggaacgaatggggccggttaacgattttcttgaggttgtggattatcgcgaggatcttaaaaaatttttttccgaagtggatattttaattgccaatgtaaccgctcacaattcctggatgcaccggcacttaaccactttaggtcttgcccatcttttaaaggacagtaaagttaaattagcggtgcttacccactttaactactgttgtctttatcccgaagatttgcgggagaagatggcccggtatgtaagggagaaatccggaattaaaactattgccggtaaggatggtttaaaacttgaactgaatccggagggagtatgaggaggttaaaggaatatcccaagccgggaccggagaactcgatgtactactggcgcagttatgtaaacttttttaaagtggctaaaaattttatatttatcagcataggcaggtatttgccatttctcggattaaagcggtggctttaccggtacggtgttgggatgaaaattggtaaaaatgtgagccttggcttaatgatgatgcccgatgtgctttttcccgaattaatcgaaattggggacaacaccattattggttacaatgctacgattttaacccacgagtttcgtgtggagagctttaaaaccgggccagttaaaattggccgggatgttttaattggtgcaaacgctacaattttggcgggagtggaaattggggatggagcaatgattggagcgggagcggtggtgacgaaagatattcctcccggggtgttagcggtgggagtgcccgcccgggtggtgaaaaaaattgagtaaaattaccggggtaatcgctgactactggcaaaacccccgcaaaaagctttatgtttttttgctgctgctggtaaatttatttggcagtatctgggggtacctctggtaccggggacaacttttgcaagaaccgcttattttctggccgttaatccccgacagtcccgtgtcgacaacgctgttaactttggccttttttttgatgctttttggacgggaaattactgctcttaccctctgggcggggatgatgtgctttaaatacggcttctgggccttgggaatcttaatgcagttttggtatctttccggacgaatcgagccggttgaggtaatgctttttttaagtcacctgggtatgattgtggaaagtatcatttacgtgaagggtctaccggtgaccaaaaaagcctatttttacagtgtaatttggcttattctggaagatgttgttgactgggggtttggcttacatccctatcttttcttagaggaacagttttcttttgcagttgttttagctgtagttttaagcggttttattttggtttattttaaaaagttggttcatataaattaacaagaaggataatcttaagctttgggcgaattatttacataaaggttttcttcttaggagtgaatgacgaatgccgatggattttggactgaatttagaacagacgcaaaagcttgttttaacgcccgagctaaaacaggccattaccattttacaattgaatactttagaattagtaagttttattgaacagcaggtggaaaccaatccgcttttagaaattgaaatttgtgaagataaagaggaaaatgaattgggcgaaaatgaagaatatcaggaattgcgggaaattgctgaatattttgccgattccagtgatttggggatgggcttgaggcaagaggatgaagaacggaaaggttttgaaccggcaagttccgaaagcagcctgtgggaacatctttatttacaacttcatttattgaatttaccccagcttgataataaaatcggagagtttattattggcaatattgacgaaaatggctatctaacctgcccggtggaggaaatttctgaaaggctgaaagtggaagaagaagaagtggtacgggttttaaaaattatccaaacctttgatcctccaggagttggcgcccgggggcttttagaatgtcttttaattcaggcggagcaaaaaaatattttaactcctttgttaaaagagataatttccaattatttacccgatttagcccagagcaagtacttgaaagtggccaatcgcttgggagtaacggtagaggaagtttaccaggcgatggatataataaaaagtttagacccaaagccgggaagaaattttgctacgctaaaagaagtaaggtacgtggtaccggatatcactgtggaaaaagtggaaagtgaatatataatcctggttaacgacagccttttaccccgtttaaatattaataaaatttaccaaaacattttaaaacaaaaggattacgatgaaaaaacgaaaaaatatgtggagaaaaaattaaatcaagccctctggcttatcaaaagtatcgaacagaggcgttttaccctgtaccgggtggctcgtttcattgtggactatcaacgggaatttttagagtacggtttaaaatatttaaagccgttaaccctaaaacaggtggcaaaggcgttgaatttacacgaatcgaccatctcccgggcctgcgccaataaatatatggctactccccgggggacttttgaaatgaagtacttctttgcttcggcgttggaaagcggtcaaggaggtttttcctcttccaccagtatcaaagcgcaaattaaagaactgattgcccgggaaaatccccaggatcctttatcggaccagagaattgccgatattttaacccagcggggtgtaaaaatatcccgacggaccgttgctaaataccgggaagaaatggggattttagcggcagcaaaacggagaaaagtgtagaaattccggcgggcacaagcccgtcttagtacggggaatttttagcgcccaagtttgccaaattcccaaaacttctaccggaaagattgccaaagtgcagttaagagaaatgtttaaagactggaagccggtaaaaaattaagtttaaaaggcggtgcaacccgccttttcgtatgtttaatattcaaaaaataaaaacattttggaagggtagctgggattactttaaaacttgcctaccttagaaatatcgttttataatacaagagaagcatagttatttttttctaatttaatttaatataaaggaggaattgggatgcctgtaaaagtagggattaatggttttggccggattggccggaatatgtttcgggcagccttaaacaatccggaaattgaaattgtagcggtaaatgacttaaccgatgccaagactttggcccacctcttgaaatacgactcggttcacgggatttttgctgctgatgtggaggccaaagatgatgctatcgtggtaaatggtaaagaagttaaagtttatgcggaaaaagacccggctaacttaccctggaaggagttaggggtagaaattgttattgaatctaccggaaaatttaccaaaaaggctgatgcggtaaaacacctggaagctggagccaaaaaggtaatcatttctgcgcctgctaccgatgaagatattactatcgttatgggagtaaatgaggataagtacgatccggcgaaccaccatgtaatttccaatgcttcctgtacaactaactgcctggcgccggtggccaaagtgctgcatgaaaagtttgggattgttaaaggcttgatgactaccgtccactcttacactaacgaccagcggattttagaccttcctcacaaagatttacgtcgggcccgggctgcagctacttccataatccccaccacaaccggagcggcaaaagcggtggccttagttcttcccgaattaaaaggaaaattaaacggctttgccatgcgggtacctacacccaatgtttcggtagttgacttagtggtggagttagaaaaacccgcaaccaaggaagaaattaacgctgctttaaaggaagctgccgaaggagaattaaagggcatccttggttataccgagctccccttggtttcggtggactttaacggtaatcctttgagctctattgttgatggactttctaccatggtaattgaagacaatatggccaaagttattgcctggtacgataatgaatggggttattccaaccgtctggtggacttagcgacttacattgccaaaaaaggtttataatagtgggggccaagtcccccgtttcccattttaagaagggaaggggagtgttatgaacaaaaagtctataagagatgtggaggtaaaaggcaaaaaagtttttgtgcgggttgattttaacgtacctttaaatgagaaccgggaaataaccgatgatactcgcatccgggcagcccttcctaccctccagtacttgagagaacaaggggctaaacttatcgtcgcctctcatttaggccgacccaaaggtcaatttaacgaaaaatacagcttaaaaccggttgctaaaagattggccgagcttcttggtatagaggttaaaatggctcccgatgtagtggggcctgaggtggaaaaaatggccggggaattacggccgggagaagtacttcttttagaaaacgtacgcttttatcccgaagaggaaaaaaatgatccggaatttgcccgaaaactggcgcggcttgccgaaatttttgtcagcgatgcctttggggctgctcaccgggctcatgcttctaccgccggtatagcatcgtatttaccggctgtagccggatttttaatggaaaaagaaattaacttcctttcccgggcattaaataacccggaacggccctttgtggctattattggtggagccaaggtttccgataaaatcggggtgattgaaaatcttctcggcaaagttgacgttcttttaattggcggtggcatggccaacacctttttaaaagctatgggctatgaaaccggaaaatctttggtggaagaggataaagtaaatttagccggggagttaatgaataaagcaaaagaagtaggagttaaacttttgctgccgagtgacgtggtggtggctcccaggattgaagcgggcgtacccagcaaaattgtagcggttgacagcattcctgctgaagaaatggctttggatattggcgaaaaaaccgcaaagcatttccgggaagagattttaaaagctaagaccgttgtctggaacgggccgatgggggtttttgaagtggaaccctttgaccggggtactgttgcggtagccgaagcggtagccgaaagcggcgctctttccgtggtcggcggtggagactcggttgcggcggtagaaaaggccggagttgcggacaaaataacccatatttccaccggcgggggagcatctctggaatttttagaagggaaaaaacttcccggagttgaagttttaaacgataagtaattacggggggcggggtatgagaaaaccttttattgctggcaactggaaaatgtataaaacccctgtcgaggcggccggatttgtccgtgagctcatcgatagcttaaaagatgttagcggtgtggacgtagcggtctgtccgccttttcctgccctgtggccggttaaggaagcattagaggggagcaatattgctctgggagcccagaacatgcattttgaaaaggaaggggcttttaccggtgaagtatctccggccatgcttcaagatataggggttaagtacgtaatcttgggacactccgagcggagagcttactttggggaaacggacgaacttattaaccagaaaataaaggcagcttttacctggggactaaatcctatcttttgcgttggcgaaactttggaagagcgggaacggggaattaccaaggcagtagtggaaattcaggtgttaaagggcctggctggagttacggcagagcaggccgaaaacctgaccattgcttacgagccggtatgggcaattggtaccggaaaaaccgcaactcccgatgatgctcaggaagtgtgccagtttatccgggaacttttggtaaagcttttcgggcgggagatagcggataaagttcgcattcagtacggtggtagtgttaagccggaaaatattaaagagcttattgccaaaccggatatcgacggtgccttagtaggcggtgccagcttaaaagtagaaagctttaccgcaatagttaaaggcagtatttaaggaggacttaaagtgtctgtattactgacaatattagacggctggggtatagcggaaactacctatggcaacagtataaaagaggcgggaactcccaatttcaatcggtactgggataattacccccatacaattttagaggcctcgggacttgcggtaggtcttccccgcgggcagatgggcaattcggaagttggccacctcaacatgggagccggaaggattgtttaccaggaattaacccggattaccaaagaaatagaggaaggcagcttttttcaaaatcgtgagcttttagaggctgtaaatcatgctcaaaaaaccggaggcaatctccacctcatggggttattatccgatggtggggtgcatagccatattgaacacctctttgctttgttagaactttgccgccgggaaaaattttcccgggtatttatccacccctttctcgatggccgggatgtgccgccgcaaaacgcccgggaatacatagaagctttggaagctcggttaaaggaacttggctttggccaaattgccacggtgatggggcggtattacgctatggaccgggataagcgctgggagcggacggaaaaagcttaccgggcgatggtttttggggaagggtttaaagtaacagagccggaggcggcggtggctttagcctacgaccggggggaaaccgatgaatttgtttctcctacggtggttttgacttccgaaggtcagccccggggagtagttaaagaaggagatagcatcatctttttcaatttccgtcccgaccgggcccggcagataacaagagcttttgtggacgacgactttaccggctttaaccggaaaaagatagaaaatctacattttgtttgttttactcaatacgataaaacgataaaagctccagtagcttttttaccccagacgattgaaaattgcttgggcgaatatctttccaaaaaacaaaaaaagcagcttagaattgccgaaacggaaaaatacgctcatgtgacctttttctttaacggtggcgtcgaaaaaccctatcctggggaagaaagaatattaattccttcgccgaaagttgcaacttacgatttaaaaccggaaatgagtgcttatgaagtcacggaaaagcttttagaggaaatggaaaagggttacgatttaattgttttaaattacgccaatcccgatatggttggccataccggggtgtttgaagcggccgtccgggccataaaagcggtggacgaatgcctgggacgggtggtagataagtttttatctttaggaggaacggccataattaccgctgaccacggcaacgccgagaaaatgcttgaagaagatggcagcccgcataccgcgcataccacaaatccagtcccctttattctggtgggggaaaaataccgtggaattaagttaaaggaaaagggaagtctggctaatgtggccccgacgattttaaaaattttagagctggaaatacccgaggaaatgaccagtgagcctttattttaaattttatgaaggagggttattttgatgagcgaaattcgggaagttatcgcccgggaaattttagactcccggggaaatcctactgttgaggtagatgtgatcctggaagatggtacctggggaagagctgcggtgccatccggtgcctctaccggggcgtttgaagcggtggaactccgggataatgacccccaaagatatctgggtaagggggttacccaggcggtagaaaatgtcaactccattattggaccggaaattctcgggtttgatgccttggaccaggtggggattgacgagtacctcattgaattagacggtactcccaataaaggtaagcttggtgccaacgctatccttggagtatcgatggcggtggctaaagcggcggcaaattacctggggcttcccctgtaccgttatcttgggggaaccaatgcccgggtactgccggcgccgatgatgaatattttaaacggtggcaagcatgccgataacaacgtggacattcaggaattcatgatcatgccccttggtgcttcttccttcagtgaagcattacggatgggtgcggaagtgtttcacaacctcaaaaaagttttaaaggggaaaggatataacaccgctgtaggtgatgaaggaggatttgctccaaacctcaagtccaacgaagaagccattgaagtaatcgttgaggctatcgaaaaagcaggctacactccgggaaaagacatctatatcgcccttgatgtggcggcaacagaattgtacaaggacgggttttatgtcctggaaggagaaggggttaaaaaatctgctgcggaaatggtggagtattacgaaaaactttgtgctaagtatccgataattagcattgaagatggaatgagcgaagaagactgggatggctggaagcttttaaccgagcgcctggggaagaaaattcagctggtaggggacgatttgtttgttaccaacgttgagcgccttcagaaagggattgatttgggagttgccaacagtattttaattaagttaaatcaaatcggtaccattaccgaaactttaaataccatcgagcttgcccggcaaaacggttatactaccattatttcccaccgttcgggagaaaccgaggatactaccctggcggatttagcggtggcggtaaatgccggtatgattaagaccggagcgccgtcgcggaccgaccgggtagcaaaatacaaccagctgttaagaattgaggaagaattggactatactgctatttacaaaggactaaaagctttttataatataaaagcgtaattttttaaaaggcggtcgggaagcagccttcccggccttaaactattttttaactttaggggttatgtataaatatttaaaatagtgcgaaaattattgttaaccaacctaaaatgtggtataatttttttggtttttaaggaggtgaggcggggtggccgttctcaaggggatcttagtttttctgcacatcctggcagctttaggagtaatcgctgcagttcttctccaatcggggaaaagcgccggactttccgggtctattgccggtggagcggaaattttgtttggcaagaaaaaaggccttgatgagctgtttgagaaaatgacggtagttgcggtaattttatttatgattttgtcgttggtgctggctttacttttttaaagataaataatttattttaaaaattgaggagggtgagaaatggaaaacgggatgactttagcttattacggcttgggagcggggatcttagcaattctttttgccctgtatcttttttcctcggttttaaaggaagatatggggaatgaaaaaatgcgggagatttcccaggccatctttgaaggggctatggcgtatttaaaccgccagtacaagacgttaattccttttgcccttgtggtttttgttttgctggttgttggttttggttataaggaaggggactttggctacggacttaaagttggtgtatcgtttctggtaggtgctattgcctcggctcttgccggttatgccgggatgaccagtaccaccaaagctaatgcccggacgacccaggctgcgcggaaaagcttgaacgctgccttaaacgtagccttcagagccggtggcgtcatggggatgtccgttgccgggcttggtttacttggtgtttcggccttatatattatttttaaagatgttcatgttatcgatagctttgcctttggggcttcggccattgctttctttgcccgggttggcggtggtatttataccaaagccgctgacgttggtgccgacctggtgggtaaagttgaagcgggtattcccgaagacgatcccagaaacccggcggttattgcggacaacgtgggggacaacgttggcgatactgccggtatgggtgccgacttgtttgaatcttacggcgctaccaccatggcagctatgctcttaggccttacctttgccaagaaccacggctttagtgaagttttaggtgcaactttcccgttgcttctcggggcggcggggattgtagcggcaattatcagtactttctttgtgcggacttccgaagatggaaatccccaaatggctttaaatattggtttgtggtctaccaactttattacggcaatctttacctacattatagcccagtacgtatttggcagtgagtgggctccgaaaatctttatcgcggtagtttccggtttagtggttaacgtggcaattggctccttaaccgaatactatacctccaacttaaagcctccggctcaaaaaattgctgaggcttccaccaccggtccggcaactaacatcatttccgggattgcggttggtatgcggagtacgtacttacccattatcgtaattgtagcggctattatggtgggctactgggctgcaggcttttacggaattgctctggcggccatgggaatgctggctactgccgctatggttgtggcggtggactcctttggtccggtggccgacaacgccggtggtattgcagaaatggcggaacttggtccggaaatccggaataaaaccgacaagctcgatgccgttggtaacaccactgcagcggtagctaaagggtttgccattggttctgcggctttaactgcccttgctttattctctgcttataccgacctggccaaaactaaccccaacttgcaaaagtacctggtaaacggcaagtttgacttaaatattaccgatccatgggtcttagtgggtctcttcctgggtggtaccgtggcctttttagtagcggctctaactatggagtcggtaggaaaagcggcttttgacatgattgaagaggtacggcgccagtttagagagattcccggtctcatggaaggaaaagcccggcccgattatgcccgctgtgtttccatcagtacggcagcggcgatccggcagatgattgcaccgggcttactggcggttggtgctcctctggctattggctttatccttggctttaaagcattgaccggttatttagccggcgttaccgcaaccggagtgcttttagccatttatatggccaatgctggcggtgcctgggataacgcgaaaaaatatatagaagcgggaaatcttggcggaaaaggtagcgatacgcacaaagcagcggtagtgggcgataccgttggcgaccccttcaaagatacttctggccctgcgatgaacccgctgatgaaagtggccggaacctttgcgctgatcattgtgcccctgttgctattctaaaagaatctaacggagcagccctaataagtagggctgcttttttattacctttcccaatcttgccgcggaagaaattacctgctaaaatgagaccagaaaggatggtatagggcatgaacgaggaggaaaaatccccaaactactgttttgcctgcgggaaagataatccttatggtctaaagttagagttttcttatattaatgatgaggcagtagcggaatttacggcccggccggagcaccagggctacaatggagtaatgcacggaggacttattgcgaccttactggatgaagctatggcccagtggctttcctttaacggtgttcgggcggtcactgcggaaatgagtattaaatttaaaaaaccggtgcctattggagtgccccttacggtaaaagggaaaatgatttataaaaaacggaaaatttacgaaatggaaggctatgttttcgggccggaggaacaaatactggcttttgcggtggcaaaattctggcaaacggagggggagaagtaatggatagggaacaggcataccgggaacttactaaaagagtgaaaagccccaatttactaaaacatatgttagcgacggaagcggtgatgcgggaactggcgaggcattttggtgaagatgaggagttatggggattagccggacttttacacgatattgattatgatgaaacaaaagatgatccccggaagcatagtttaataggagcggaaatcctggaaaaactcggacttcccgcagaagtggtctatgcggtcaaggttcataacgaagcccatggcctgccgcgtaaatcccgtttggataaggctttatatgccgttgaccctttaacgggcctgatagttgctggagctttgatccgtccggagaaaaaattagaagcggtaacggtggagtttcttatgaatcgcttccatgaaaaatcttttgcccggggggccaagcgcgaacaaatagcagcctgcagtgaaattggcctgactttggaagaatttttagctattgctttaaaagcaatgcaggaaattcacgaggagttaggtttataggcggggaaggtgtacccgccttttgacataattgtagtaaatttaggtgaaaataagtgacgaagtgacgttaaaaggaggagtaataaatgagagaaaaaattttggagtatttaataaaagctaattctccgcaataccccgataaaatcatcgaaggtcttggccttactgatgtttcggaaataaagaaattgcttgcggctttaagagatttggaaaaagaaggagaagtgtatgtaacaaaggccggtaaatatggccttcccgagcaaatgaacatggtgcggggaaagattcaggggcatccgaaaggatttgcctttttaatacccgaggaccgggaaaagcaggacgtatttatttctcctaccaatttaaaaggagcaatgcataacgaccgggtactggtaagataccttcccttttccgatggtaaccgtccggaaggagaagttgtcaaaattttagaacgggccaataaaacggtggtggggagtttctaccggcggcggcattatggtttggtggagccggatgatgagcggattaccggtgccataattattcctctggggaaaaagggagtaaaagcaaagaacggtgaaaaggtggtagtggagattaccgcttatccccggaaaggagaacttcctgaagggaaaattattgagattttaggcgatccagaagatcaagagacgcggttaaaagccatcatcaaaaaatacggccttttagattcctttaaaccggagacaatcaaagaagccagggctatttcccaggaaattggcccggaagagctaaaaagccgccgggatttaaggggagaaatgattgttaccattgatgatgaagatgccaaggatttagacgatgcggttagtttaaaaaagcttcctaacggtaattaccagttgggggtacatattgccgacgtatcgtattacgtgcgggaaggttcggctttggataaagaagcgctggaacggggaaccagtgtttacctagcgggtaaagtgttgccgatgcttcccccggagctgtccaacggaatttgcagcttaaatccccgggtggaccggttgaccctatcggtggtaatggaaattactcccgccggagaagtggtgagtcatgaaatttttccgtcggttatcaagacccgggcccggcttacctacaccattgtgaaaaaagctgttttggataaagatccaaaagcccgggaagagctgggggatttggtgcccatgttggaggaaatggccaaccttgccatgattttaagaaagcgccggcttgagcggggggcaattgattttgaccttcccgaagccaaagtaatcttagatgataaaggggaagtggtggatatcgtccggcgggagcgaaacattgctcaccagctaattgaggagtttatgttaataactaacgaaacggtagcggaaagatttttctggcaggaagtgccgtttttgtaccggattcacgaagatcccgacgaagggaaaatccaaagcttaaaagagtttttaaggctttttggttataacttaaaaggtggccgggacgggaaataccacccccgcgaatttcaacggcttttggaaaaagtggcgggaaggaaggaagaaagggtaatcaatgcggtcatgctgcggtcaatgaaacaggcccgttattcggcggaaagaatctggcattttggcttagcggcggaatactacacccactttacttcacccattcgccgttatcccgatttaatgattcaccggataatccgggaagtattagaagggaaacttaccccgcggcgggaagcaaaacttgccaaaattttaccgaaggtagccaaacattcgtcggagatggaacgccgggccatggaagcggaacgggaatcggtggaaatgcggatggtcgagtttatggtaggtaaagaaggtaccgaatacgatgctataatttccggggtaacttctttcggcttttttgtgcagttgcctaatttaattgaggggttagtgcgcgtatccactttagaggatgattactatctttatgatgaaaaaagttatgcccttattggtcggcgcacgaaaaaagtgtttcgtttgggtgatgaagtgcgtgtaaggttggttaaagtaaacactgtctcaagagaaattgattttatgcttgtaaaaaaacttggggaaagtcctgaaactaatgaatcggcggaagaaattttggagcggttaacgtaaaaaaatttctgagcaaaggtttttgaaaatatgatataataatttaagtcatgtatgttacgagattttaaggggtatgtttttatggaaaagataattgcggaaaatcgtaaagcttatcacgattatcatattctcgaaaaatacgaggcaggaatagcattaaaaggaaccgaggttaaatccattcgccttggccgggtaaatttaagggatagttttgcccggattgaaaacggtgagctctggctttacaacatgcacataagtccctatgagcaggggaaccgctttaaccacgaacctaaaagaccccgaaagctattaatgcataaaagggagattatgcgcctttttggtaagaccagggaaaagggtctaactttggtaccattaaagctttactttaaaggaaattatgctaaaatagaattgggcttagccaaaggtaaaaagatttacgacaagcgggaagagatggcaaaaagggatgcagcaagagaaattgaaaaggctcttcgagctcgttattaacctgggggcgtaaagggttcgacgggggagcgaagggccgaaagtagcgaggcgaggaccccatcttacctcgttaaaaatggtgggaaaagataactgccaacgaaaactacgctttagctgcttaataacgcagctacgtcctgacggaagcttgcccggggcttctgtcggggcgtgaccggaccgggctggcttatgaagggtgtcccggctcttcataagcgagattttacgggatagcccgattgtggcctgccggtaggcaccaatcgggtgaaagcaaaaataccggctgccctcggagaagctttcggttcttgtcctccggacggtgggttcgattccccccgcctccaccattaaaaaccacagttattttaaattcaacatccgttttatcattgtttacagtaactttatcaataaattcctggcaaggtgtaagagcgactggatcattactatccagttgctcttttttgctttttaagaaagaaataatgttgtactccacatctccggaacttcctcttatagatagcactgtcatttctattgcgggcgaagcggtccagtttgtgaatgagaacaataccaaataggccaagcttggcgtcactatccattccaagaaagtttggcctgtcatcggttagtgctgaacgtgtttcatcagcgtatattttgacaatgtggtagcctttttgctttgcatattcagagcaggcccttacctgggtagttatatattcttcgcattggttgtcaatggagaaacggacgtagatcacagcacgcataagctacctccaaaacaaatgttcgaaataaggataaaaagaaaaagcggtgggccgcaaactacaaaatattttaaaattttttagcttattaagcaattttcacacctaaatttctcatcatatcaaacgtatcaatatatggtacattaaaggctttgcatacattgggtataggaactttcttccttatatttggattatatttttcatgagtaacaagaatacatcctttaacttttgcataagcaattaaccagccatcagctccactagcaaattctgctttagcttcttctaaaaactgatcattgctatttacccattccattatttctcgataggcattaataacatcgggctgattagtagaattacaccaattatgaaaaatggtttttatccatttcgatagttcgtcctgatttcgtactatttcatcttttacccaatcaatactgagcacatcaccatttttagcgtggtcaattaagattctccagaaagcaggcacaagatcaaaagcataatatcgccgtgctgcttccacaaaaacattagtatctagcaaatatgaagaattatgcttcatagcatgcctccccaatcgataaactttgcatattcttcgaaagttttgccataaagtccggtgagttgataagcttcgcgataaagtattttaccttcttttgctgcgcggattacagcttctgcaaaacgtcttccaagacgtaagttttgagtcttataaaaattacctccttcattgtctttgactccaaatagacgttctttttcaaggtaattttcgtaaaaatttaaaaactgttcccggttaataagctttaaatctaaagctcttcgggctataactatctcgctcactttaaatctactagcaagcatttgaaaaacgtctctaccatgagcaatagaagaccatgcttggcgtaattcagccgcaggtactaaaaattcagcggcgacgtaattacaagcttgttcaattttgtcattggctggatgaagggactgcaaatcaaaagcagcactactgccgtaccaaatgtgtgctaactcatgagctaatgtaaacatttgtgccgctttactatcagcaccgtttacaaatattaaaggtgcgtactcatctactaagacaaatccgcggaactctgctggattaagcttgcggtgcgtgttatttccaactatactgttgacaactacaataataccaatgtcttcgattttcttttgtaattctcttagtgcagcggtccatgtcggttggttggctgcccagtcattttttagtcctaacgtatttcttattttctgagctacatcgtgaggattatcttcgagcttagcagttttgacaaaaggaagaggttcatgtccaaggtcaataaggtagtcgcgcatccatgcctggcgacgtttcattgtatagaaagtctcgataaattcggggcttaaccgttgtatagtatgatctccgagagttcgaaaaaatggtataggtagtttttcttcaggtggcttagaaagaaaaaagtaaccaagtggggtagaagttgcctttgctaagtcttccaactgtcgtaaagtaggcatactcttgccagttaaccattcattaatttttggaaattttctgctaatatcatgaaagcggccagaacgttctaacgcccaattgagaacaggcacactaatgtttactcttactatattagatctttcttttttactactatccataatgtatgacctggctcactaagtttgcttgagtaaactgaggagggaatttaaactgaaccaggtgtagcacctcctttcttaatattttaacattttttattacagaaaaaaccctgctgccccttagttacggtattgtcatttcatactttttcttcccatagaaagctctattaacttattcctatctattagttcaacattattagcctttgcaagatttattgcattttcagtgaagtagttattggtgcaaactaaagctttgtggcaaccataaaattttactgctgaaatagcctcctgaacggcttttatccctactttgtttttatgccttttggcttggacaacaatttttatattgtctttttcaattattaggtctgctccgtaatcagcggttttacgggtttccttgactttgtaaccgtagtccttaaataatttctttaaccacttctcaaactgttctccggtgaatttatcaacttctttgattccagattttcgatatatagtgtctataaaaatacttgttaaaagccttaccaccaaaaaaaatgctgaaagtattgtttcaacaactaaaacagtaacaaaatcaaaactgtaatttgcttttggaaaagttaaaaatgcaatgagagttaaaaatagtgcaacaaagaaaaatcccgctatacttcccgctacatagtcaacatattccaataatcttaaaattggcatttataattacctccaacttagcataattatttctgccaattcatctattttttctctaatttttcatgttgcatattaaggccaactaaataggagtaaaaagaaatagacgcaattctttcttctaacccaaaacgcgggctggccatattattcttatgtttaagctcctttagttcgtctaaggctttcccaatattcttctgccggcgggtctatagtccaactaacaaaaccgccatgtaattcttctatggcttttctaatttcttcaagaggaactttgaagaattcttttctggggttaactttatttacttcatattttctaaagcgttcatgtaaggccgcttcaagggcgggagcatcttcgctaaaaattattgcgtgaacatcaaatttaaaaggtacagaagcatcacctaattcgtttattctgtccattggatcaagacgccttgtcatacctattttgaagacattttcgccaaatgcatctatatttgagataatgtaaacaaaacctgctctggtattttgttcacggttgataatatcttctttggctttggttacttcttctaatttttcctcgatagattttatttgttctatataaaagcttttttctacatcacttgttgccttttgcatatgagccattaactttttaatttcgtttctgaaatgagtttcctctttttcaagcttttgtctttctctctcaagttctttacgcgctttttcttcatccaagagttgctcgcggatagctttttgtaattctttttcttgttctttctttagttggtatgcataaacaagattaagctcttcaagtttactttctaagtattctttggacaaagctacaccgtcggttgcaaatattttattaagcgtttcaaaagattttattattttattgcgagcagtatctacgttacgcgctgagacatttacaataatattttcacattcagcgttaaagcatcgcagaatctgtttcatattattttcgattacttttcttttatcagaagtagctgtaatttccagagctttgtcattctttattaaatcctgttgtttaagtcggagtaaatggagctgatttttaatttcttccgaagtaaattcttcgtaggctgtcacattgacagcagcaactaagacttctttagaaagagcttttagttcaagctgtaatcgtttaacctcattattcatttcggtaagttttttttcgaggttaagcttttcttggttaagattttctacttctcgagtagctgtttcgataatgttcttggcttcttcatttgctttagctaaggtttcgtcagctgaaccgtatactttttgttgtattatgagaagaatgatgcctatgattgctggaataccatacagtggccatagggctaccaataacgctataaaccaagtgttcaaataccacctttgtttcatacagaatattcctcccacgttagttttttatccaatgttaacaagcgcagtattttgccgcgctttcagccacactgtaatctgttttccggctttgcatttgccggtatattattctagcttctctatcggccaaattttctttattattccggattaagcgcaagattagcttatattctgataattcacaaattaagtgtagagctcatggataaacacgaatacgcgctaaggtacatcaagatcctgattaaaaaccgtttacatttggatataactgagtaatcttaactctaatatcataagcggctaaaatgtcctggaaaaggtcgggattgttcattaaaagctggaacaattcgtttttggaaagcttaagcggttcttccatgtttgcctccctggttttgtcgcatgtttggagattttgtcgaaaagtttagataacacaaaaacccgctatcttttgtcgagatagcaggtcttttgctttatttaaggcttaatccgcctaagattgaaaaatcactgcccataaaggaaaaaattttgccagatattctcaaaaaaattttaacatattttcctgatttttaaaattcctaatttacaattaaaaagtttttttaaaaacgaaaggcctttataataataaaaagggagaaactaaacaggtgaatatggaggagaatatgcgcggatttaaggttgtaagtttttttgaggacaaaggaattaacatcccacagcgaaagaccaaagccagtgccggttatgatttggaagcagcgattgacgtggttttaaacccgggtgaggtaaaactggtacctaccggtgttaaagcttatatgcccgaagatgaggtactcctcatttacattagaagtagccttgcggtgaaaaaaggtttgcttttggccaacggcgtaggggtagtagatgcggattattacgataacccggaaaacgaagggcatatcatgatacctttgtttaaccccggaaaagaaccggtaacgatcaggaaaggggagcggatagcccaggggatttttaccagatatttaaaggccgatgatgacgaggctctgggccaaagaacgggcgggtttggttctaccggtcagtaaaaaataacagtaaaatttctttattaacaacttgccttcaaacgaaaaatgtgtataatagtaagagcgaggaataaagaagtgcgcccgtagctcagcggatagagcgccggcctccggagccgggtgcgtaggttcgattcctgccgggcgcaccataaactgcacaaaaaccgggttttgctgcgaacccggtttatttttttagctaaagcaggaaaaattaaactaatgtagaagagaatagtgaaaaataatcagaaaattttaccaacagggagtgaggggtattaaaggcaggtatttttacctgacccttttgttggtgctgccattagtggtgcagggaacggtcatgtattattttttatacctcgaaataccggagttatcggaaaaaaatttaacatatgttgcggtacatatggcgaaagaaattgagaaagacctaacggatatagatataaataatttggaaattgccgagttaaacgaaataaatttaattttaactcattttcccgatatgatgataagttttataaaatatcctaatttagaaattatagctcactattccaataaaaacggcaaattagctaaagataacgaaataatcggtggggtacttaccggagaagttaaagatattataatcaaaaagcgctatccttattttggtaagctaagcttagccgacgggaaagcctatgtttacctccaaccggtttatgtgaagggagagctggtgggttttgttcttacccaccaaaatcgaaattatctatcggtagtggttggcgaaattttaaggcttaccggaacggtgctatttttaatgctcctggtgggaatagggtatagtttgcattatgtttttttaaacgatcggaggactattgcccttacaaaatctaactgggatttgcagcggaaattaaatgccgttttagaaaatgcgcaaacggggattgttttagttgacagggatttaactattacttacataaatcccatggcggaagatttttttaagatttcttttgcagaagctgttggaaaacagtacgatgaatttatcaaaagctatattataaccgatgaggagaaaaagtcatcatttttagtgcatactttaaaaaccggaaataccgtttataaaaaaacaataacctttaaagttctgggagaaatgcgtttgggggaagtttgcacgggaatcatccaaaataatttgggacaaattgacggagcttttttatttatccaggacataaccgataaaagacagaaggaagagttagctgccaaaaccctgcagttagcagcagcgggtgaaattatgtcggaacttacccacgaattaaaaaatgcctttatggtgttaaccggtttatcaaaactttgtcaggatggacggcccgagttaaaaatgcttgatgaggaaataaatcggctgtaccgcttgactactgattttcttagcttaaccagagcttaccgggctaaaaaagaacgttttgattttcaacagttagtggtggaagtattagcccttgttgataaggaagctcgtaaacaaaaggtaaaaattgagacttttctccattacccgccctatttaaagggcgataggaatcttttaaaacaagcgctcttgaatgttttattaaacgccgtggaagctatggaagggggaggggttcttaaggtttacctggactacaacgttaaaagccaggaaatagttttaacagtggccgatagcggtcccggtatacctccggaaattctgcaaaaaatttgccagcctttctttactaccaaggagagggggaccggcctggggttaccttttaccaaaagggtagtggaatatcacttgggaaagttaatgattaaaagcgaagtgggcaaaggaacgtgggtaataattactttaccggtagaggagaatatccatgaaaaagtccaggtggtatgaaatagtaagtggcagaagaggctaccggcagaatcggtgggcattttttaggtattgttctcggtaaaagctttcgatagtaatgcacaactccttttttggtggtaaaattatataaagaccgaaaaaaaggagcgggtgcagtgaaaagggttgtcagtgtaagcctgggttcctccaagcgcgacaaagcaaccgaggcggaatttttgggagaaaaatttattatcgagcgccggggtaccgatggggattataataaagcattgcaggttttaaaagaattagatggtaaagtagatgctattggacttggcgggatagatgtctatctttatgccggaggacgccggtatgctataaaagatgggctgcggcttttgcaggcggttaaaattactccggcggtagatggaagcggcctcaaaaatactttagagcgggaagtggtgcgggaacttgcccgcatgggaattatcacccctaaaagcaaggtgctgctggtttccgccgtggaccgttttggtatggcggaggcgttagccgaaaccggtgcggaagtaatttttggcgatttaatttttgccctgggaattcccattcctattaagaaaataagcactttaaatttcttagcggctatactactgccaattattaccaagctaccatttcagattctttatcctacgggcaaggaacaagaagttagagaaaagaaaagtaagaatgaccggtattaccactgggcggatattattgccggggattacctctatataaagaaacatttaccggagcggatcgatggcaagataattttaaccaatactactacccgggaagatgtggaggagttaaaagccaaaggggctaaaatgttagtgacaactactccggttttaaacggacgctcctttggaaccaacgttatggaaggggtacttttaaccctgttaaacaaaaaatgggaggaagtaactcccgaggattatttaagacttttaaaggagctgggctttaagcccaatataattgagttaaattaatcatagatccttaaaagtttatacatttccatgtttatccgattatcagagggtaggccgtagtcagcacgaaatttaactacggccttttccatttttcggccaaaaataccgtcaatgggaccggaataataacctttaagctttaaaagttcctgcaggataagaacatcgcttcctttagaacctaccactaatgttctccaggggatttcctgataggtaaaaggattgccgaggataattacttgatcttgaaggtgaaccttttcgtacagttcttccacatgccggtttaacatccggatacagccgtgactggcgtaacttccaatggaaccgggcttattggtcccgtgaatgccgtacataccccagggtacgtttaaaccgagaaagcggctgccaaaaccgctgccccagtttttgcgcataaatgtaattttaaagcaaccaatcggggtaggagttttcaggtcacccagggcaaccgggtatttttttacaagcttattttcccggaaaagataaaggaggcgggtccgcgtttcaatgacaatgatatttttttcgttggctaaaccggtgaggggagttaaaaatatcataaggaaaacaagaaaaaaaagtttttttaccattttatctacctccggtaataaacttgtcctttatcgaatagttatttattagtgtggtacatcagggcaggtttatttcgggaggtgaaaaaatttgatcaggaaaattatggcaggtattttggtggtttttttactggctggggttgccggttgtagctggtggaataagatttttgaacgaaaggcggtagttccggacaaaaccgaggttaaagaggaaagcgtagaagtaggtcaaaaaggcgagatgattgaagtagttttatattttgccgatgaaaccggcgaatatttggttccggaaaagcggatgattgccaaagttccttctatagcccgggaaacattaaacgaactttttgccgggccccaatcttctaatttaaagccggtagttcctcctggtacagttttacgggatatcaatgtaaaacccgatggcttgtgcattgtggacctgagccgggaagtaattgataaccacccgggaggatcggcggcggaagcgttaaccgtatatgctattgtggacacattatgccaatttcctacgataaagaaagtagagttcagggttgagggggaaaaagtggaaagtttaaaaggtcacatggacctgacggtcccggtggagaaaaatgaggcaatgattaaaatccaaaattaaccacaaaccttttttggcctgcggccaaaaaaggtttttttcttaaaaacccttgactttttttgtatttagagtttttctaaaaggggcaatggatggaaaaaaggaggtttgtgtgggataatattaagaaaggtacagagaaacggtcttggcagtaaaatatcttgttaaaaaactttaacccatttacaggaggtttagcattttggacaaagcatcattgggtatcggaatttttgattcgggggttggcggagtaacggtattaaaagaactgataaatttgcttcccggggaaaacttttactatttgggagacactgcgcatgtgccttacggctcaaaatccaaagaggaattattaattttgggcgatgccataattcgcttttttcttaagttaggggttaagatggtagtttttgcctgcaataccagttcggccataaccttacccattttaaaagagagatacccggttttaatggaaggaatgcttgaacccttaaggaaaaatatgccggccaaagccaaggtcggggtgctggccaccgaggcgacggtgaaaagtgggctttatcaaaaaaagcttatggaaactaacaagtttcaagaagtttatatgatagcttgtccccagtatgtacccttgattgaaaaggggattgtttcggggaaagaagtagaagaagctacccgggaatactttgagccacttctaaaagaagaagttagagatgtggtcctgggttgtacccattatccttttttaaccgaaactattcagaaactttaccccaaaattcaggtaattgacccggcggcctatgttgcccgggaggtttatcgaaaattaaaggaaaacaagcttttaggtgagaatggcggaaaagtccagttttatgtgaccggcgatgaaaaaagtctaaaaaatcttggaagcttgtacttaggctataacatagatagggtccaaaaaattgacttggaggtaatagtatgaaagaggtaaatttagtgctcggggtgattggggctgatgttcacgccattggaaataaaattttagagtatgcactaaccaatgccggttttaaggtacacaatttaggggtaatggtaagccaggaagaatttgtgaaggctgctttagagaccgatgccaaagcggtattggtttcttccctttatggccacggggaaattgactgccgtggtcttaaggaaaagtttattgaagctggtctggatgatgtgctcctgtatgttgggggtaatttagtagtggggaaacaggatttttccgaagttgagagaaagtttaaagcaatgggatttgaccgggtatttcccccggggacgatgccggaagaagcaataaaggcccttaaagaagaccttgggctaatgtagggggcttttaaggtgaggttagggctttttttggacataggcagtacatataccaaaggacgagtggtggagttagaacggggggagcttttagcctcggctaaagcttatactaccgtagaaaccgatgttacccttgggataaacgactgtcttttagagttatcacggcagggaattaaagagaaatatgatataaaacttgcctcttcttcggccgccggcgggctcaggatggtggcggtagggctggtacgggatttaaccaccgaagcggccaaaaaagccgcattgaccgccggggcacgggtggaaaagagctatagctatgagcttaccccggaagatttggacgaaattttggccctgaaaccggacatcattttactggccggaggaactgacggcgggaacaaaaaataccttttagaaaatgccaggaagttatcacggctaaaacttaaaggaacgattttggttgccgggaaccgctcggcggcttccgaggttgccggaattttagaaggtaaggtagacttcaggatcgctcccaatgttttaccggacctcaataccctaaacattgaaccggtccaaaacctgatccgccagatatttttagaaaaaatagttgaagccaaagggttaaaaaaagccgaaaaaattgtggacaaggtaatgatgccaacgcccctggcggttttaaaaggggcggagctcttagcccaaaaaatcggggagcttatattaattgatgtcggaggagctactaccgatgtacattcggtagcaaaggggctgcccaccttagcgggggtgagtttaaagggacttccggaaccctacgctaaaagaactgtggaaggggatttggggttaaggagaacggtgaaaaatgttgttgaatacggacgagaagaattttataattcaggaattacttccgggcaactaagcgattaccttgaaaaaattacaaaagatccgacgtatcttccccaaaccccccaggaaaaggaaattgaaaaagcgcttacccgaatttgtgtcaaaacggcaatgaatcggcatgcgggaagattagaggaaatctggactcctgccggaaaaagttttgttcagtacggaaaggatttaaccagggtagaagctttggtgggaaccggaggacctttagtttatgccgaggaaccggaaaaagttttagcggcagccttttttgaggaaacaaatcctaatattttaaaacctaaaaatccggaaatgtatttggataccgagtatatattgtttgcagctggcttactggcggaaaatgatcgggaaacaggtttaaaactattaaattccgttaaaaaactttaaacaagcgggaggcaacggggaatgaaagggaaaattgatctggagaagtttttgcaaagtcggaaggaagttttggctacctggcctacgggagcggaagtgtctttagaagatggtataaactaccataaagctttaccgccggaaaaaaactttgctgttaagcttaaaaaagttaaagaggaaggaattactgccattcaaccccgggcgggggttgctttattaaacgagcatatagctcttttgaaatatttagaaaaagaaggggaagcggactttcttcccaccaccattgacagttatacccggcaaaaccggtatcaggaagcccagcggggtatcgaagaaagcctagcggaaggccggtcaatgttaaacggctttccggcggtaaattacggggtgtatccttgccgcaagattattgaagaagttaacgtgccggtgcaggtacgtcacggtactcccgatgcccggcttttagcagaaattaccctggccgggggtttttcaagctttgaagggggaggtattacctacaatattccctatgccaaggaagtcccgttgagaaaatctattgaagattggcagtatgtggaccggttaatcggttactatgcggaacacggggttttaataaaccgggaatcgtttggaccccttaccggtactttagtaccgccgtccgttaccattgccattaatattttagagcttctgttagccgtcgagcagggagtaaaaagctttaccctgggactcgggcagtgcggcaatttaaaccaggacgtagcggctttacacgggatggttgaactggcggaggagtacttaaagcgttttggttttcaggatgtggatttaaccaccgtatttcaccagtggatgggtggttttccgcaggatgaagcacgggcgtttgccgttattgcctggggagcggtggctgccgctttagccaaggccaacaaggttattgttaaaacaccccatgaagctttgggggtacccaccaaagaagccaatgcccagggtttaaaaaccacccggcagattgtcaatatgctaaaagaccagcgatttatggttaatgaggaataccttttagaaaaagaaatggtgaaaaaagaagcccgggccattgtggaacgtactctggaattgggtgaaggggacttagttgcgggaattgagcgggcgtttgccgcaggggttattgatgtgccttttgcccccagtcgttttaacctggggaaaatcctgccggcacgggatgataccggtgcggtgcggattttagagtttggcaatctaccctttgatagcgaaatccgggaatttcatagggaacggctaaaacggagaggggaaaaggaaggacgggagcccagctttcaaatggtgattgacgatatatacgctattggtaaaggaatgttagtaggaaaaccgaggacaaagtaggtggagcgatgaaagttggcataacaacaaccataccggtagaagcggtttttgcggcgggcaagacgccggttgatttgaataatatttttataaccgctccttcgcctcaggctttggtggaggaagcggaagaagaaggttatccgagaaacctttgtgcctggattaaggggctgtataccgttgccaagaatgatccggaaattggaacgattattgccgtaacccagggagattgcagtaatacccatgccttaatggaaacactgatgctggcgggaaaagaaattataccttttgcctatccctttgaccgggattacgaccttttggcccaccagttagaaaaattaattaccgccctggggactacctgggaagaaactgttcaagttaaaaagcagttggatgaaataagaaaatttttggtggaacttgactatttaacttttgccgaaggaaaagtcacgggttttgaaaatcacctgtggcttgtatcatcaagcgattttaatcaggaccccgtaaaatttcaaaaagaactgctggagtttttagaaaaagcaagaagaaggcctggagagaaagaaaagctgcgtatagcttatattggtgtgccgccgataatccccgacctttatgattacctggaagagaggggcgcacgggtagtttttaacgaggtccagcggcagttttccatgccgtatttggcagaagacctcgtgcggcagtaccagctatatacctatccctacggcatttttgctcgcctcaaagatattaaagagcaacttgaactaagagaagtggatgcggtaattcactatgcgcaaagcttttgctatcggcaaattgaagatttaattatccggcgagaaattaagcttccggttttaactttggaaggagataagccgggaagaatggatgcccgcacccggatgcgggtggatgctttcttggatatgcttcgttaaaaggtgatgaaaatgtatgtaggaattgaccttggcagcagaaatgtcaaaatggcagttaaagaagatggagaaataaggtttttactttttgatacggtgagtttttaccgggaatacggaaagcttgtggatggcgagctggtggttgatttttcggctctggggttaactcccatcgaaaaaatcgtttccaccggatacggacgccaggcggtaaaaatcaagggtggcattgatctcccggaaattcgggcccatgctttgggggcggtttaccagaccgggcttatggattttaccctgttggatttagggggacaggacagtaaagttgttttggttagaaaaggtaaggttgcagattttttaaccaacgataaatgcgctgcttctaccggaaggtatcttgaaaacatggctgcggtgttaaagatttctttagaggaattgggaaacttttatgaagatccggtggaactgtcaagtacctgcgctatatttggggaaacggagcttttaggcaaggtggtggaaggctaccctttggaacggttagcggccggggtaaactataccatttataaaaggattgctccaatgcttaaaaaacttttttctcctcaggtggtgtttaccggtggagtagcttacagccgtgctttaagaaagatcattgaaaaggagcttggggtcgaggttgtaataccccgggaaccgcaatttaacggtgctctcggttgcttaaaatacggaggagggatttaatgcggctaacggttttagggtgctgggctcctttcccggcaccggggggagctacatcgtcatatcttttagaaacggaaaaggcaacgattttaattgatgcggggagcggggcagtagcaaacctgttgaagtggggacaaccggaaaaacttgatgcggtggtactttcccactggcatgaagaccatactgcagacctgccgattttacgttatcttgtcagaagcctattttttaccggaaaacggacagaaaaagtaaaacttttttatcccgaatccccggaaaggccggatatgagtaaatatcaggaattttttgagttaataccgattaaagagggagagtttttagatattaaagaacttaaagggtgggccgttaccaattcgcaccaggctttatcttacggctttaaatttaccaacggagttaaaacctttggttataccggtgataccggctatttaccaaagcatgcggagtttttttacggagtagatttgttactggcggagtgtaccggctttaaaaaagatagcagttatacccaaaataaccatttaactaccgaagagtgtgcgcttttagcgaaaaacgccaaggcaaaaaatcttgcggtgacccacttctggcccttttacgatgttttaatgcttttagacgaggttagggagatttaccccggggcctttgccgtacgggaaggaatgagtattgtatgaacatttatccccatgaatatcttttaaaagcggtttattttgccccccggggcaaacaccggcttatggctttaggttcggttttggccgagagatatttaagccccaaggataagctggtagggctaattggtgatgctggagccggcaaatctttattaattcgcgggatgtttccgggattagagctaaccaatgatgatgaagggataaatttgcggccattaccgttactggaagattatgaacggggaaattttcgccaccattcgtatcacgtggatatgcgctttgaaatggcttttactccgccgtaccgtttagccgaggcggttaaaaaagctatcgataaaggacggcgggtagtaattgaacattttgatttgctgtatccctatctaaatattaatgccgagcttttaatcgggattggtgctgaagtgattttatttcgtcccaatgtttttggaccctttccccatgaggtggccaatgaagtgtttccctctttggtttaccggaaaatggcccattcggcggaagacctgaccggttatgttttaaaagaaatggggattatcaaaccggaggttcacagtgatatccgtaacggtttcttactggagtttaaagaaaagcccgaaatagatttggaggttttggaaaaaagggtaaaagaattaattgctcaaaatctctcaatttgctattatgatgaagaacatatcaagcttggccaggaaaaggttgaatgcaccggcccaaggattcatgtttccaaaaccggtgaaatcaaaggttttaaaatacttaaagaattaaaatacgatcctattgaaaaactttatataattgccggggttgttggtcagcaggacaacgaaaatgaggtgatttaatgcgaattgatggtagggaaaaagaccagttacgaacggttaaaataaccacaaactacataaaacatgctgaaggttcggttttaattgaaatgggtgatacccgggtagtttgtaccgctaccgtagaagataaggtgccaccctttgccaagggcgaaggcaaagggtggattactgcggaatacggaatgcttccccggagtaccgaaacccgcaatgttcgggaagcgaccaaaggtcggcaatcgggccggaccctggaaattcaacggctaattggtcgagctttaaggggagtggttgatctaaaagctctgggggagcgaactttgtggattgattgtgacgtaattcaggcggatgggggtaccaggactgcagcgattaccggctcttttgtggctttagcattagcgttaaataagctcgttgaggagggaattttaccggtaattcccttaaaggattttgtggcggcggtaagtgtgggtattgttgacggcgaggaaattttggacttaaattttgaggaagattcgaaggctttagtggatatgaacgtggtgatgaccggttctaaccgttttgtggaagtgcagggtaccggtgaagaagcaactttttcaatggaagagctgcaaaggcttttaacactggcccagaaggggatcagagagttaattgaacttcaaaaacaggccctgggagatattgcccggaggatagggatggaaaatgcagcggatagtaatagccagtaaaaatcaaggaaagatcaaagaattttcagcgcttttaagttctctgggtttttcctttgttagtcttttggattttccggaaatcggggaaatacccgaaaaggggacaaccttcgaagacaacgcccggcaaaaagccgttacggtttccaattttaccggtttgccggcactggcggatgattcgggattagtggtggatgccctgggaggaagacctggggtattttctgctcgttatgccggagagcccaaagatgatttgaaaaatatccaaaaacttctaaaagaattagaaggtgtaccctgggaaaagaggacggcccgctttgtcgcggtactttgcctttatttccctgacggctcacttgttacggcccggggggaatgtgagggctatattttagaggaaatgcggggtagcggtggttttggctatgacccggtcttttatcttccggattacggtaaaactatggcggaacttccgttagagataaaaaacaaaataagccaccgggcccgggcgttagaggagcttttaaggaagctaaaggaggaaaataggtggagtacctggtagttagcgatactcacggacgcattgaaaaggtgataaaatatgcgcggagcaggaattttgccggaataattcatgccggggattactaccgggacggtatagctctgggggcggagctcggtattccggtgtttgcggttcacggaaattgtgatggggtctggaatgggatagaagaagaattattagaattaaacggtataaagatatttttgacccacggtcacttatactatgtcaagcacgatttaaaacagatcgcagaaaaggctgcccagctaaaagtggaccttgcggtttttggacacagtcacgtgccgatttttaccgagctaaatggtgtaaggttattaaatcctggaagcccggaaagacccagggaggagcaaaggggaagtttggcggttttaaaaatggaggcaaaaagttttacggcagatctaatttatctctaaaaaaccaaaattcaccattaaattatttattgacaaaagccaatgatttatatatactaattgttgcacggaggaacgagcgggtgtagctcaatggtagagccctggccttccaagccagtcgcgtgggttcgattcccatcacccgctccatttattcatgtgtccctgtagctcaatggatagagcaacggacttctaatccgtaggttgggggttcgagtccctccggggacgccatttctggaggtcagaagttggaagttagaggttagattacatctaacttcagttaattaataaattattttccaacctccaatttccaatgtccaattttccaatatggtgggtgtagcccaacggttaggaggcgcatgactgtggatcatgacagtgtgggttcaaatcccatcacccaccccattttccaatttctaaattggggcgtcgccaagtggtaaggcagcggtctttggaaccgccattcgttggttcgaatccagccgccccagccatttgataaaaacagcaaaagctgttacaataaatttttgttgtgagccattagctcagttggtagagcacctgacttttaatcagggtgtcgaaggttcgagtccttcatggctcaccatcttttttttatttctaacttccaacctccaacatctaacttccaaaaggagcgggtgtggcggaactggcagacgcgctggacttaggatccagtgggcaaccgtgggggttcaagtccctccacccgcaccagattaactttagatgcggaagtggctcaggggtagagcatcgccttgccaaggcgagggtcgcgggttcgaatcccgtcttccgctccagaaggtaagccctgcagttatcgtgcagggttctttgttttttgtcccaagccttttcttgaaggcagtttttagttgcacattgtttatattctgtgtagaatataatagtaattaaatatattgttgcaacgggatatgccaaaaaaaggaaaaggtgacaacagattaaaatacatattgcaaggaggattaagatgaaagttaccaaagaaactttagaaaagagtcgggtggagttaaccatcgaggtagaggcggaggaagtttctaaagcatacgaaaaagcttataaaaagattgctcaaaaagtggttatccctggttttagaaaaggaaaggctcccagggttttagtggaaagacatgtgggtaaagagtatattttagaagaagccctggatgaactgttgccggagagctatgttaaagcggttaatgaggcaggaatcgaaccggtagataagccggaagtatcgttagtttcctacggggttaacgaaccgctggtttataaagcggtagtggatgtgaagcccgaggttgagcttggtcaatataccggcttggaagtaaccaaaatgcccgttgaagttaccgacgaagaagtagaaaaagaactggaatatcttcagaatcggtatgcgaaacttattaccgttgaagatggtgaagcaaaatttggtgatattgtggtaattgactttgctgggaaaatgaatggagaacctctcgaagggggtagtgcggacaattaccggttagaactgggctcaaaggtttttattcctggctttgaagagcaaattgtgggtatgaaaccgggagaaacaaaggaaattaacgttaccttcccggaagattaccagaaagaagaccttgctgggaaaccggcagtctttactgtaaccttaaaagaaattaaacggaaagagttagcgccccttgatgatgagtttgccaaagatgtttccgaattttcaactttggcggagttaaaagaagacctcaagaaaaagattgctcaaaccaaggaaaatatttcccgggaaaaaatggaagcagaagtagttgaaaaagcggtagataatgctaatgtggaaattcccgcaagcatggtaaatcatgaagttgagcatatacttcatcattttgaggaagagctaaagtaccggcggttaaccttggaacagtacctgaattaccagaagaaaaccctggatgaattaaaggaagaattaaaaccaagagccgaacgcaatgttaaaaccgaactggttttagaagctattgccaaaaaagaaggaattaccgctaccgatgaagaaatagataaggaacttggtaaaatcgccgaactttaccagcaaccggtagaggaaattaaaaagctttttgctcagcggatggatgatcttgcctattccattgttcgccgaaaaacgattgactttttggttgaaaatgctaaagctgtttaattaaacagataagggggtttggttatgagctatcttgttcccattgtaatagaacaaaccagccggggagaaagaagttacgatatttggtcaaggttattaaaagaccgcacaatatttattggaggacctatagacgaccatgtggcaaatttagtgatagcacaaatgcttttcttggaagcggaagacccggaaaaagatattcacctgtatattaactctcccggcggagtaataaccgcaggaatggccatatacgatacaatgcagtatattaaaccggatgtttctaccatttgcataggtcaggcggcaagtatgggtgcctttctgttagcggccggggccaagggtaagcgtttttctctgccctatgcccggattatgatccaccagcctttgggtggagtgcaggggcaagcgaccgatattgatattcacgcgcgcgagatattaagaatgagagatatgttaaatgaattattaaccaaacataccggacagccgaaagagaaaattgaacgggataccgagcgcgacttctttatgtcggctgccgaagctaaagaatacggaatcatcgatgaggtgattaccgttcgcaaataatttttgaggtgatgaaatgtttgataaaaatcagctaaagtgttccttttgcggtaagcatcaggaccaggtgcgaaagctcgtggctggaccaggagtttatatatgtgatgaatgtatagaactgtgtaacgaaattattgaagaagagttagctgacgacctggaactttcccttgaagaacttcccaaaccccaggagattaaggcttatcttgaccagtatgttattggtcaggaggaagctaagaaagtactggcggtagcagtttacaatcactacaaacggattaacctcggtggcaaaattgatgatgtggagttgtccaaaagcaacatcctcatgctgggaccgaccggttccgggaaaacattattggcccaaactttagccagatttttaaatgtaccttttgctattgctgatgctactgccttaacggaagccggttatgtgggagaagatgtggaaaatattcttttaaaacttattcagaacgccgactatgatattgagcgggctgaaaagggaattgtttatattgacgagatcgataagatagcccggaagtcggagaatccttctattacccgggacgtatccggagagggggtccagcaagcccttttaaaaatcttggaagggaccattgcttccgtgccgccccagggagggcggaagcacccgcatcaggagtttattcaaattgatactaccaacatcctctttatcgttggtggagcttttgaagggatagagaaaataatccaaaaccgaatcgggaagaaaggcctggggtttggtgcggaaattaaacccaagagagagcaaaatgtcggcgaaattttaaaacatattatgccggaagatttactgaaatttggcttaatccccgaatttgttggccgtctgccaattattgtaactttggatgccctggatgaagatgctctggtcagaatccttaccgagcccaagaatgctttaataaagcagtatcagaaactgtttgaattagatggggtaactttagaatttgaagaagatgctttaagggctattgcccagaaagctattaaaagaaataccggggcgcggggtcttagagctattttagaagaagttatgctcgatgttatgtacgaaataccatcccgcaaagacattattaaatgcatagtaacgcgggatgttattgaaaataaagcaaaacccattttagtagggactgcagaaaagcggaaaaaaggtaaaaaagaagagacggcctaattggagattggagattagagtttggaagctggaagataatttaaagacagaagaagtggttctttaaaaaaaggaccacttctttttttattgtttagaagcagatatcggaataggattggcaagtaaaataaaagggatggggaaaactaagagtaaattaatcgaggaggtgttaggggtggttcatttaattgggatattactttagtacttattttaagctttttagaaaacttgggcagggagatgatttttaatgcatcacttaaagaagaatcttcccaaaaaatttcgttttttagagccgggctggtggatggtacatttaactggactgacattaacgggaattttaatgtacctggtctttcgcaacgaaaatgagttagatctttaaataaactgcctctttccggtaataataggaaagaggtgagaaaaatggacggatttagcggaattttagcggtgggccaaattattcttttagcagcaattttggcccttctcttttctcagggaaaagcccagcaggtaaataagagttatctcgagcgggaaagtgaaaaggagctggctaaattaaaccatttacgcaggatttctttaacggaaccattagcggaaaagacacggccggaaaatttttcggaaatcatcggtcaggaagaagggattgaagctttaaaagccgcattatgcggtcccaatccccagcatgtaattttatacggaccaccgggagtagggaaaacagctgctgcccggctggtgttaaaggaagcaattaaaagtcccgcttctccctttaaagaaggggctgcctttgtcgaggtggatgccacctgtacccggtttgacgagcggggaatagccgatcctcttctgggctccgttcacgacccaatctatcagggggcagggcccttagggattgccgggattccccagcctaagccgggggctgtaaccaaagcccatggggggattttatttattgatgaaattggggaacttcacccggtacaaatgaataagcttttaaaggttttagaagaccggaaggtttttttagaaagcgcttattacttttccgaaaatccggaaattccccagcatattcatgaaatttttcaaaaaggtctgccggcggattttcgtttaattggggcaaccacccgaaagccggaagaactgccaccggctttaagatctcggtgcgtggaaatattttttaaaccccttggcgatgaagaaattcgggaaattgcccaaaatgcggcaaaaaagatagggatatcccttggaaagcatgccctgcaaacaattgttaaatacgccaactccgggcgcgaagcggttaatatcgtccagctggcggcggggctggcgctgggggagggaagaaagaggattttggcaagagatgtgctgttcgtagcccgggcgggtaattatcatccaaagccccagattgttttatccgatgagccggcgataggaagggctctgggccttgcggtgactggaccaaaaagcggtgcggttttagccgtagaagcattggccgaacctgccgaaaacctgcccggaagtatcaacgtttccggtataattgaagaagaaaagttttcccaaagtcataccgagcttattgcccgcagtaaaattcgcggggctcttgataatgtttttgcggtttttcgaagccaaacgggaattaatccccaaaaatacgatatttattttaactttccggctccctggccggtggatggtccgtcggccgggcttgccttgctggtagccctttattcggcagttttccgctgtttaattccggccaaaaccgcttttaccggggaaatttcccttttaggtgaaatttgtcccgtaggcggaattcccgataaaatagaagctgcagtcagggccggagttaaaactgtttttttgccctggggtaattaccccgaagtagaaggaaataaaaaaataaacctggttcccgtaaaaagtgttgatgaagcgttaaattatttatttgcgggaaaggaccaatcccttccttcttccttagcttgaacttactttttagattattttatgatagaataatgatactcaaaaagggaggtggttagaagtggaaacaagggaattaccgcttttgccattacggggccttttggtttttccctatatggttatacatttagatgtaggccgggaaaaatccattgctgctatagatcaagcaatgatttccgaccgcattatttgtctggctacgcaaaaggatgcccaaattgatgagccaactccggacgatatatttgcggtaggaaccatcgccgaaataaagcagcttttaaaacttccaggaggaacgttaagggttttagttgagggtatccagcgggccaaaattaaaaagtacatagaaaaggaaccttttttccgcgtggaagtggaggtgacccaggaagaggtaagtaaaaccccggaaatccaggcgttaacccgcagtttaatttaccagtttgagcagtacgttaaactttccaaaagaattccgccggaaacggccataaccgtagttaatttagaggaaccggggcgcctggcggatgtggtggcaagtcatttgcctttaaaaattgaagataaacagagaatccttgaagcactggatgtaaagaaacggctggaaattttgctggaaattttagcccgggaactggaaatagtagaaatagagcggcggataaatttgcgggttagaaagcaaatggaaaaaactcagaaggagtattatctgcgggaacagcttaaagccattcagcgggaattgggggaaaaagacgaaagggttgccgaaggggaagagtaccgggaaaaaattaaagaagctaagcttccgaaggaagttgaggaaaaggccttaaaagaagtggaaaagttagaaaaaatgccaccgatggctgctgaagcaacggtggtgcgaaattaccttgattggatattggctcttccctggaatcgtcgcaccaaagaccgcctggatattaaacttgcggagcagatactggaggaagaccattacgggttggaaaaggttaaagaacgaattttagaatatttggcggtgcgaaaacttaccaagaaaatgaaagggcccattctctgctttgtgggaccgccgggggtgggtaaaacatccctggcgaaatcaatcgcccgggccttagaacgaaaatttgtgcgtatttcgctggggggcgtacgggatgaagcggaaatccggggacaccggcggacttatgtgggggccttaccgggacgcataattcagggaatgcgcaatgccggaagccaaaacccggtatttctcctggatgagattgataaaatgagcatggattttagaggtgacccctcggcggctcttttagaagttctggatccggaacaaaataacagcttttcggaccattatattgagctgccttttgatttatcccatgtcctgtttattacgactgctaataatttatataacataccccgtccgcttttggaccggatggaagtcatccatatccctggctataccgaggaggagaaactggtcatcgcggaaaagtatcttttaccaaagcagctaaaggaacacggtttaaagcccaaaaatctcaaaatctccaccaataccttcttaaaaattattcgggaatatacccgggaatcgggagttagaaatttagaacggcaaattgcctccctttgccggaaagctgccaaagaaatcgtcaccgataacgtggaggaagtaaaaattaccgtaagcaacctggagaggtatctgggtatacccaagtaccggtacggtatcgcggaagcggaggatgaggtaggggttgctaccggtctggcctggacggaagtgggcggcgatgtaatgtttattgaagtttcggttcttaaagggagcggcaagctctaccttaccggtaaattaggagaagtaatgaaagaatcggcgcaagcaggcttttcctacattcgctcccgggcaaaagagctgggcattgaagaaaacttccacgaaaaatacgatttacacatccacgtccccgagggagcaattcccaaggacggcccatcggcggggataacgatggcaacggctatggtgtcggctttatcgggacaaaaggtgcgtaaggacgtagccatgaccggggaaattaccttacggggaaaggtactgcctattggtggacttaaagaaaaaattttagcggccaagcgggcaggaataaaaaccatcattattccccatgagaaccggaaagaactggatgaaatttctccgcaggtaaaacggggcctgaagtttatcctggtaaagcacatggatgaagttttagaggcagctttaattcggaaagaaaaacctgaaattgagccgccggtgccggcggaagaaaaggaagtcaccgaaccatcggagatttccgtgcactaaagaccaccgttattcggtggtctttttatgaaaagattttttgaaaaacaaaaaggagaagatcggtaaaactaactttttccctgatttgctgcaaaagttttgtgtaaaaagagctttgaaaaaaagggccctgagggttattgtagtattgctgagctatggccacggttgccgggttaaaggaaaggttttttgagaaaaacccctcattattcagaaaaagaaacagcttttgctgtgttgcgggggcaagggataaaaaagcggtggcttcagggttctggtaaaaagctttttgtccgtgataaagggcggaaataatattttgtaagtccttaaatttgatatcatcttttaccgctaaaacagcaagatccggggctttaataaccgcgaagggagttaattttttcaggggagttaaggtggaagcaatgtaaagatttccaataccggccgtaaatgcttcttcttttatttcttccggtaaatcgaagtaaggggtgtagtctttatatggttttatcccctgccgggataaaaaatccactacatcccggtactgtttacttcccctgggaggaaggattatcgctttatttttgaaagaaaaattttgagcaggatttcttagataaatagaatacggctcgaagtttgacaattttataagtattttatagccggcagggattttttccgatgcttttacggcgattaatgccgcctggtctaaattatccacaactttaactttagttccgtataactcccagtagcccttatcggttaaataatacagtaaccagaaatggggggaatttttgggtaagaaaagtccgtaaatagtttgtttatttaatttcagggttaaaaatattccaaatatcaaacaaactaacagaaggatgctaccaataatttttttcataatatcaccctaaaaaaactgttatgcagcaacttgtttaaagttgacagtttcccgggaagaatataaaataatttccaagcgaaaaggaaaaaatgatgccggggaggagtaccgaaatgcctccatgcagagaggaaagcccctgggctgaaaggctttcctggcaggcttcgggaacgtcgcccctaagattgtgaaggggaagccagtacctttcaccgggttatgcccgttatagctataaagtgccgggagcgttgtatcccggaagcaaggtggtaccgcggaaagtgcctctttcgcccttgggtgaaaggggctttttctataatggttgatatgatacaacataaagagaaaaggaggaatgacggtgaccttaccttcggtttattctccccaggaagtggaaagaaaatggtataaatactgggaggaaaatggctttttccataccgaacccgatgaacgggaacctttttgtattgttatgccaccgcccaatgttaccggtcagcttcacatggggcacgccctggataacaccatgcaggatatccttgcccgttacaaaagaatgcagggttttaataccctctggcttccgggaaccgaccatgcggggattgccacccaggctaaagtagaggaagaactgcgaaaagaaggacttaccaaagatgatttgggccgggaaaagtttttagaaagggtttgggcctggaaagaaaattacggtaaccgcataaccgaacagcttagaaccctcggggcttcgtgcgactggaaacgggaacgttttaccctggatgaaggttgctccgaggcggtaaaagaggtatttttgcgcctttatgaaaaagggcttatataccgggactactacattaccaactggtgtccccactgtaaaaccactatttccgatattgaagtagagcatctggaaagagaaggaaaactttactatattaactatcctctggaagacggcagcggctatcttaccgtagcaactacccggccggagaccatgttaggcgatacggcagtagcggtccatccggaagatgagcggtaccgggagctaatcggcaaaaacgtgattttacctctggtaaaccggccgataccggttatagccgatgagtatgtggataaggagtttggcaccggagcggtgaagattactccggcccacgatcccaacgattttgaagtgggacttcggcataagctgccgcaggtagtagttttagatgacgatgcggtaatgaatgaaaacgccggaaagtaccgggggcttgaccggtatgaggcgcgtaagaaaatagttgaagatttaaaagatttgggccttctcgttaaggaggaagagataacacactctgttggtcattgttaccgttgcgatacggttatcgaaccgcggctttccaaacagtggtttgtcaaaatgaagcctctggcggagccggccatagaagcggctttaacgggaaaagtgaagtttgtgccggaacgctttaccaaaatttatcttaactggctgtataacatccgggactggtgcatttcccggcagctctggtggggtcaccggattcccgtatggtactgtgacgaatgcggtgaagttatcccttcccgggaagaagtaaaaagctgtcctaaatgccagagtaccaaggtccatcaggaccccgatgtgctggatacctggttttcttcggctctctggcctttttccaccctgggctggccccaaaataccgaagagctgaagtactactatccaacctcggttctggttaccggccgggatattatcttcttctgggtggcccggatgcttttcatgggcctggaattcatgaaagaagtaccttttaaggaagttttaatccacggtcttgttttagatgcccaggggagaaaaatgagtaagtccctgggtaacggggttgatccggtagaagttattgcaagccacggagccgatagcttaaggtttatgctggtaaccggcaacactcccggaaatgatttaagatttcactttgagcgactggatggggcccgaaactttgccaataaactctggaacgcttcccgctttgtgttaatgaatctcgaaggatttactcctcagggaataaagcaagaagagcttaccttagcggatcgctggattttagcacggttaaacgctgtaattgacagggtaactgcttttttggacgagtatgagttaggggaagcggcccgggaactgtacgagtttatctgggatgagttttgcgattggtatgtggagcttaccaagccccgtttatacgggaaaatgcccggtggggataccgcccgggaagtgctgtatgcggttttaaagactaccctggagttactccatccctttatgccgtttattaccgaagaaatctggcaaagacttccccatgaaggaaagacgataatgctggcgccctggccgaaaggacgggcggattatgaaaatcccgaggcggttaaacaaatgagcagcttaatggaggttatccgggaaataagaaggcttagggctgaggttaacgtcccacccgccaagcgcggtgaagttattttagtgactgcggacgaacaattaacccgcttacttaacgaaaacgcctgggcaatagcagctttagcccaaagcgaaccacgggttgttccgaagatggaggtgccgcagggagctttaaccggagttgcggcaggagtgactatttatttaccgcttaaggacctaattgacctggaaaaggaaaaagagcggcttaataaagagctcaaaaaagttctggcggaaatcgaacggcttaatcagaagttaaataatcctggatttttagctaaagctccggcagaagtggtcaataaagagcgggaaaagctaacggccttttaccgggaaaaggaagtcttggaacaaaggatagggatgctttcccatgaactataacgaagcgctggaatttttaagtaaccttaccaaatttggaattaatttgggtttagggaggatttctgaacttttaaaaaggcttggcaatccgcaggaaaaggtaaaggtagttcacatcggtggaacaaacggtaaggggtcggtttgttcgttaacggcttcggtgttggcggaggcggggtataaaacggggctttttacctcgccccacctttcccggtataccgaacgctataaaataaacggtaaagaaatttcgccggaaagggtttctcagctggtgacggaaataagaccgttacttttggcgatggtagaggaaggttttgaacatcctaccgagtttgaagtgtccacggcgatggcttttaagtattttgccgaagaggaagttgattttgtggttttagaagtaggactgggaggcttaattgattctaccaatgtggtttcccgtccggaagttgtggcgattaccaatgtgggaatggaccatatggattatctgggaaataccattaccgaaattgcccgggttaaggcggggataataaagccgggagtgccggtggtaaccgcggcaacaggggaggctctggaagttatcaaagaggtagcaaaagagaaaaacagtccccttttggatgttaataaggacatcgttttaaatttaaaagaaaaaagcttaaaagggcaggtttttgaccttatttaccggggtgaaacctatccagagataaaaatccgccttttaggagcccatcagcttttaaatgccaaaacttcttttggtattcttaatatcctgcgggaaaaatataacataccggtggaagcaatttaccggggatttagcaacgccacctggtcggggcgttttgagtatattccgggaaatccgccggtacttctcgatggggcgcacaatcacgatggagttagagctttaaggcaagcttttactgactattttcccggtgtaaagccggtactgctcctgggagttttagccgataaagagcgggaaaaagtggtggcggagcttttagatttacccttagaagtggtagtgacccgaccgccaactccccgagcaggagatatcaccgtcttagcaaggctttttaaagaaaaaggggttagggtgaaggttatcgaagaaccgaccgaagctttatcttacggcctggaaattgcgcaagaataccaaaccctcttattaattaccggttccctttatatgattggcgaaatccgccctttacttttgcaggatagagattagacgggcttttgcccgttttttcttttttatttgtgaaggtatagctgtttttaccgaccactgaccaccgacgacttacgaccgttaatgcatattcttttcgcttttcctcaatactataaagaggaaaggagggacaaaatgggattatgggtaaaaattacaaaaatttttaagggtaagggaaacagttcatcttttaaagaagaaaagccaaccaggctttcgcagtataaagaaaaaaagttttccggtaaagtggaggtagatgttggtgaaataaaaaaaatcctcggtaatccttcggatcttttaataagggagtttagctattacggggttgcggcggcggcggtaatgattgatggtttggtggataaaatggtggttattgatgggattttaaagcctttgatggttgaagccaaaattgcccgggaaaagcccgctgacccttataaaagtttgaaagaagaaatgctggctattgcggaaattaaagaggttcaaaccctggacgagtttctgctggcggtgctgtccggtgaagtcgggcttcttctggaaaattgttcggtggcccttttggccagcgccaagggctgggcaagccggtcggtgaccgagccgatgaatgaagtggtggtgcggggcccgcaggaaggttttaccgaaactatccgggtaaatacaaccttaatccggcggcgggtccgttcgccctacctccggtttgaagctttaaaaatcgggcggatttcccagaccgatgtggtaatagcgtatctcgaagacattgctaatccccaaattgtggaggaagtacggaataggctttcccggattgatgtggatgctattttagaaagcggttatattgaagagtttatagaggacgatccctttaacatctttccccagattaaacataccgagcgacccgataaagcggtagcggatttgttagagggaaaggtggtaattttaaccgacggaactcctttagccttgatagtaccggctacctttcccgagttctttcaagcggcggaagattattatgaaaaatatttcatcggaaactttttacgcttaattcgcgttttagctttttttattgctatgtttttaccttccctttacattgctattattacctatcaccaggaaatgattccaacggaacttttaataaatatctgggcttcccgctcgggcgtaccttttcctgcttttgttgaagcgttaattatggagattgcctttgaagctctcagggaagcgggggtgcgcctgccgcgtcccgttggtcaggcggtgagtatcgttggagcattaataatcgggcaggcggcagttgaagcgggaattgtatctacttccatggttattaccgttgccattaccggaattgcttcctttgccattccggcttttaacatggccgtagcggcccggatttaccgctttgggatgatggttttagcggcaacttttggcatgttcggactgatgatgggctttatccttttagttatcatgctttgcaatacccgttcctttggcgttccttacctggccccgatagcacccttaagcattcccgaccagcgggacgttgttgtaagattgccccggtggcttatggtcaagaggcccaaacactttcgtccactggatgagcggcggataaaagaaggattaagaccgggctttccgaaaggggaaaaaaggagatgaaaagaaccttagcggctttgttaattatcgggcaaattttcttttttggctgttggagcagaatggaattagaagatttagcaattgtgcagggcgtaggggtggatgaaaataaaaaaggtttaaaaaaagaccggtacttattttcggtgcaggtggtcaatcccagcgctcttaccagtaagggaggtggcggtggagaaaagccttacgtcataagacttattagcggcgaacttttttttacctctttgcgggaacttaatatggaaacggctttacgcctgtattatgcccacaaccgggtgatacttatttctgaagatgtagcccggcgcggtttaaaaaaccttttggatttttttgagagaaacccgcagtttcgccgggataattacgtattaatagttcagggtaaggctgttgatgtttgggatgggttttctggtctggtaaaggttccggcaatagctatctatgatttagctcaaaagtcgtatcttactgcggaagcagggattatcgaattaggggattttatagaactgttggaagaggaaggagtggacccttacgctccgggggtaaagattttgaccaagaagggacggaaagatattcgggtatttcaaacggctctttttaaaaacgacaagttggcgggctggcttgatgaaaaacagtctcggggtttgctgattgttaccaacaaagtgaaaggcgggattactgatgttactaacccctttaatcccgaagacaagctttcggtagaattggaaaggtcaaaaacccagtgggaactgaaagtgtttgaagataaacctgttgtgaaacttaaggtggaaacagaagggattataaccgaggcccagaacggccttgattttagtaaaaaggaaacttttcaaaaattaaatcgggagtatgccaaatcggtccgccgcgatattttggcgtttattaataaaaccaaggaaattggcgcagatcctgccggttttggccgttttatctaccgggaaaaccccgggctctggcaggagttaaaagatgactgggaggaggaaattaaaaatttgacgatagaggtaaaggttcaagctaaaattgttagaacagggatgacaaccgcttcaattaaaccccagtagggtggtggttttcttggcatatcttgtggtagggttatatttgctgatattgggtgtttttggctatcccctcctgcgggatagggaataccgggaattaaccgtattttccgttttaatgttaatttccttttattacgtattagcggttatgctggattggcccttaataaatcctgctttaccggttatgaaaattggtaaaattattagcggtttctttaaataatttttgatagtttttggcttttttctttaaataaaaaatttgagtatataaaggtaatttttttggaacaaggagaattacctataaaaaacttttattattaagggttattgtttatttttttttctttgtgttataattcacctataaggaggggagcggcatgaaaggctttaaaattccagaagctacgatttcaaggctttcggtatactcccgctatctggaaaacctgtaccgtaaaggcattactaccgtgtcttcggcggacattgcccagggggtaggggtaacttcagctcaggtcagaaaagatcttgcttatttcggagaatttggtacccggggagttggctacaacgttaaggaacttttagaccatactttaaaaattttaggattaaataatacctggaatatggtagtggtgggcgctggaaatctcggctcagctctttgtgcttaccggggctttagagagagaggtttttacatagtaggggtttttgataacgatttgaccaaaattggcaaaaaaattaacgaatacgaagttttaccgattgacaagttagaagaagtggtcagggaaaacaacgtggagattggaattattgccgttccggctgcttatgcccaggatgtcgctacccgcttggtaaaagcgggggtaaaggggatcctgaactttgccccgacggttttaaacgttcccgataaagttatcgttagaagcgtggacctaacggttaatttagaagttctaacctttaatattcgccgcgactaagaccctggtgtttaccggggttttttgtttgaaaaaagtaattgcatgggttttacaaagatgataaactttttgtgaaagaagggggattttgcttgaaaatctacttggcttcgaaatcaccgcgccggcaggagttattaaaaaaaatttacagccggtttgaaataattccgccggaggtaaaggaagaggtttattcgttaaatcccatggaattggcgcttactctttcccgccaaaaagccgagaatgtggctgcaaaaataaaggaaggagtcatcattgctgccgatacggtggtagcggtagagggaaaagtattgggtaaaccccgggatgaagaagaggcttatttcatgttaaaaaccctgtccgggcgggaacacgaagtttataccggagtaactttaatggaactgccgcaaaaacgggaaaaaagttttgtagaggttactaaagtctggttttaccctttaaccgatgaagaaataaaaagttacatagattcccgggagccctttgacaaagcgggggcttacggcatacagggcaaaggtgctctttttgtggcaaaaattgaaggatgttattttaatgtggtggggcttccggtggcccgattgtatcgtgagcttagagagtggggatattaatgggggagaaaattaaaaacctgccggaagagctaagaccccgggagcggcttttacgccatggaccggaaagtttaaacccggcggagctcctggcggtgctccttggaagcggtacgccccaggaaaacgctctggaattggcgttacggcttttaactacttttggcgggttaaaggggctaatagaggtgcatcccgaacagttaaaaagctttaaaggaattggccaggccaaagcagcaaaacttttagcggctttggaattagcccggcgctattatgagctcaccggtgaaaataagctaaattttttaaatcccgatgatgtgtataattatctaagatacaaaataggccacaaaaagcaggaacaagtggtggtgttatatttaaataccaaaaaccagctttgtggtgaaaatatagttgccattggcggcgtaaatcatgcgggggtgtcgccgggagatatttttcgggaagcggtgaaaattggtgcctatgcggtaattattgcccataatcatcccagcggcgacccgactcccagcaaagaagacatagattttaccggccgggtgaaaaaggcgtccgaaattttaggaattaaactcttagatcatataattctcggagaaaataaatatatcagtatgaaagccgagcggttattttagaaaggggaagttaagatggcctttaaatttggattggtagcaaaggatttaggcattgacctgggaactgccaactctcttgtatacgtaaaagggcggggcgtagttttgttagaaccttcggtggtggctattagaaaggaaacggggcaagtgctggcggtaggcaacgaagccaagcagatgattggccggactccggggaatattgtggctatccggccgatgaaagacggagttattgcagattttgacattacatataacatgttaaaacattttattaacaaggctttaggcgataagacttatttaattaagcccaacgtggtggtatgtgtgccttcaggagccacagcggtggaagaaagggcaatcagggatgcggctttggccgctggagccagggaagcgtatttaattgaagagccaatggctgcagcgattggagcgggactaccggtggaagaacctaccggcaatcttatcgttgacatcggcggaggtaccaccgaagttgcggtaatttcttttggggggatagtaaccagccagtccttaagaattgccggggatgaaatggatgaagcgattattaatcacattaagaaaacctacaatttaatgattggcgagcgtacggcggaagaaattaaaattaacattggatccgcttatcctcaggatacggttaccacttatgaggtaaagggccgggatttaattaccgggctgccgcgaacaattgaagtgagttccgaggaaatttataaagctttaaaagaaccggtttcggccattgtggaggccataaaagctactttggagaagacgcctccggaactggcggcagacatcatggaccgcgggattatgctggcagggggaggctcattactaaaaggtcttgataagttaataagtgccgaaacccacatgccggtccacgtggcggaagagccgatgtattgcgtagcttacggtaccggcaaagctttggaaaacctcaatgttttaagaaatgttttaaagacccctaaaaaatccataaaagaggcgtgatatagttggctaagaggtactggggcaagactcttttaattggggtattgctggcggtgctcctcctgtctcttgcccgctatacaaccaaacagcttccctttttttccgaagttaaatccggacttaaagacttgacttaccctattgcccgggcggttagttttctctgggatggggttggcaatgttacccaatactttaaggatattaatgagctaaggcgggaaaaagatagacttcttcaggaaaatactgctttaaaataccagttaaatcgcttacaagaagtagagagggaaaatctgcggcttaaagcactgctgggctacagtcgggaacacccaaattttaaacttattgtggccaaaattatcgagcgggacccggcaagctggtataagtcttttacggttaatcagggaaaaagttctgggatcaggaaagatatgccggttttggaccaaaacggtttggttggccggatgatgaatgtggccgctttaaacggtgaagtattgctaattaccgacccacggagcagtgtggcggcggtcacttatccgggaagggtgccggggataataaaaggaacggctttatcctccgagcttattatggataacattccgttaaatcttgaagttcgtaccggagagaaggtgcttacctccggtcagggaggagtatttcccgcaggtatacctatcgggtacgttgtaagtgtaaccaaagatccatcggggttggtgcaggtggcgaaagttcgtccttacgttgattttgaccggttagaggaagtatttattttaaaaggcagtcgttaacacctgggggcaatggtatgtctaatctaaaggctatgctgtattttttatttttttatataatagcccaaacggtttttagccggctggcggtaaatggagtaaagccggacttaatcttaattttaacggtaattttaagctttttatatggtccccccaggggggcctttttcggtatgcagggaggtcttattgaagacctctttaccggccactttatcgggcttaatactttggtaaaaatggttaccggttttttggcaggggtgttagaaggaaaaatttatccggaaaactggtggttccctggggtcattgtttttgttttaacttttgttaaggattttctttacgtagcttttttaaatctcttgggtataaatattgccctcaccgaggcctttggcaggataatgcccgtagaggcgttatacaattttttcctaacacccgtcttttatttctttttttaccgcgccgttagggggaataagccttgagaaagaacattaaagccaatttaggctggatgggtgtggtggtaacgtttttcctgtttattttatggggaaggcttttttatcttcaagtatacgctacggccaaatatcagaccttggcccgcaaaaacgccatcaggataattgatgttaaagccccccggggagaaatattggaccggaatggcaaaaaaatagttaccaataaagccgtttataccgtttctttactgtttaccggcttaaaaaatgccgatgtaattttacccaaacttgcgcaaatccttcaggtttccgaagaggaactgcggttaaaaattaaaaactctaaagcacggccgtatgaaccgattcgtttagctaccgatgttccctgggaggtggtagcgaaaattgaagagagaaggtacgaacttccgggagttacggtaagcatcgagcccgcccgggattatccttacggtaatttattggctcacgtggtgggatatattcaggagataaaagatacccagctaaaagagcatcaggccgaaggatacaagttgggggatatgttcggacaaacgggcttagagagtttttatgaatcggttttgcgcggaaaaaatggtggtcgggaaattgaagtggatgccaagggcaatcctgtccgggacttagggataaaaacccgaccggagcagggtaattccttagttttaacaattgatgtagacctgcaaaaagctgcggaagaaagtttgaaaaaaaccattgcagcgctgcaaaatcgttatcccgatgccagagcgggtgcggtagtggcccttgatgtgagaagcggggaagtgctggccatggccagttaccccacttttgatccggcggcttttcccaaggggttaacccaaaagcaggtggatgagtacataaggaatcccgatcggccgctttataatcgcgcggtatcagctacctatcctccaggctccacctttaaaatggtcaccggcatggctgccctcttaaatcgggtaactactccttccgaaacaattttcgatcctggttactacaaactgggaaaccgtgcttttaaagattggaacccaaggggccacggggttgtaaactttgttaaagccattaaagagtcttgcaacgtttatttttggacgatggcccggcggctgggagtagaaaaaattgtggaagtgggtaaacaatttggtttgggaatgatgacaggcatagaccttcccggggagagttcgggacttttaccgactcccgagtggaaaaaggaaaccaatactgccattatcgagaaaaatttaaagcctaaaatagataaaataaaaagtgattacgagcaaagaatagcccgggctaaaacttccgaggagaaaaagcggttggaggcggaacgggacaaaaaaattcaggcaattaaccggcaaattgaaatttaccgctgggaaaccgagtggcagcagtatgatacgcttaatatggccatcggtcagggttataacaattatacccttttgcagcttgccaattatgtagccatgatagccaatgggggaattcgttaccaacctcatttggtaaaaaaagttttggacaatcggggaaaggttatagaggaggtaaaacccagggttttaagtaaagcaaagatccccgagaatattttaaattacgtgcggcaggggatgcgggaagtaacgatgcccgggggaactgccggaggagtgtttgcaggatttccggtagcggtggcggcaaaaaccggaacagctcaggttttcggtaaagacgatcacggcttgttcgtggcgtatgccccttttgaaaatccccgaattgcagttgcggccattattgaacatggcggtcatggtggttcttcggcaggtttggtggccagggatgttttagcggcgtattttaaggtgccaaaagtaaataccagggtttttggcccggtggaataagagcaggaatttttccaaagatgtagaatacatcaacttagctaattttaaagaaaaggtgctttacgatgttgagaggagagtttttcttagaaaatactttgctgatagataaaaccttacgttccgggcaaaaggtaaattatgctggaaacgtggtagtccttggggatataaatcccggagcagaagtggtagcggccgggagcattatcgttctggggacggtcaggggagtggttcacgccggcgctgaaggttttaaaaaagcggtggtcttagcttttaagctcttaccaactcaacttcgcatagctgatcatattacccgaccgccggaagatgaaaaaataaccaaagacaattttagcccggaaattgcccttattaaagacgggatggtagttattgaaagctacgaagggaaccttggaaagcttttaaaataaaaggaggaagattatgggggaagcaattgtcattacctcgggaaagggaggcgtcggtaaaacgacgactaccgccaatctgggtacagctttagcgatgatgggccagaaagtggttttggtggatacggatataggtttacgaaatcttgatgtggttttggggttggaaaaccggattgtttatgacttagttgatgttgtccacggaaattgccgtttaaagcaagcgcttatcaaagataaacgtttagaagggttgtatcttttgccggcggcgcaaaccaaggataagacggcagtaagtcccgaacaaatgcggaatttggttagtgatcttaaaaaggagtttgattatgttttaattgattgtccggcgggaatcgagcagggatttaaaaacgcggtagctggagccgatcggggaattgtggtaactactccggaagtatcggcggtccgggatgcggaccgcataatcggtttactggaagctgaggggattaataatccccggcttataattaaccgtattcgtcccaagatggttcggacgggagatatgatgggaatcgaagatattatcgaaattttggctattgaccttttaggggttattcccgatgatgaaactattatcgtaactaccaataaaggcgagccggccgtctatgaccagaactcccgggcgggccaggctttccggaatattgcccggcggataatgggtgaagaggttccgctgatgaacttagaggaagaagggttcttcagcaaggttaaaaagttgttcggtatcaaccgctaaggggaggggacggccgtgctggaaattttaatgaaactgtttgggaaggaacagcaaaacagcaaaaccatggcgaaagaacgccttagactggttttagttcaggataggaccaatgtttcacccgagctcttacaaaatttaaaagaggatttaattgctgtcattaccaaatacatggaaattgacgaaaaagctctggaagtaaatatcgatagtcatgaagaccaggtagcgcttattgccaatataccgattaaaaacgttaaaagaagtgtccgggttcaaaccaattagcgaaataatttgcgagataattagcatatctaagaaaagcgaaaaatattgagaataaataacaagcactgtaatattttcggttttacaacccaaaataaatgtgttaattttttaacggaaaaaacagaaaaaattaggtattgttgttattattcctgcatattttatactaagaaaagtaaataagaggaaaaagtcccgagactttaaagtccagaggccagcagtaaaaaatgctggctttttttgccagcattttgtgttttcagttaaaattaactctattactgctgccgtaattttttagctaactttgtgctttttgtaactaatttatatagttaggatacatttagagctaatacagtttagggagggggatgaaggtggtggatttacgatgtaactgtggaaaaattgtttgtcaggttgaaggaagtatgattatcattaagtgccgtcattgtaaacagtatgtttacctttattttgacggcgcgaagattcgaagggtaaatcctggcaggcaattttcccaaaatttaataccaccttccagtccggaggcttttagcccagaggccagcgtttaaaacgctggccttttgctttattttgcaaaagaaaggggggaaaaatatgttgatggcagttattgggcttctcctaattattgctacttttgtgttttgcgagtgcggactatggtattttattttctatcatgaaaaaaaaccctttaccccaggatatatagctttgtccctaactactggttttttggcctttattgccatggttttggtgctatactttataatttatccgccaaacattatgacgtggttttaagaaaaactcattttcggtaaacgaggtgttaattatggtaatttttttgttttggcttttggtgataacgattagcgttttttccttttccttaagctattatttgtttttctttaaagttaaacgggaattaaccggttttaagcgtggaattttaaccttaatggttggtcttttactttttgctttaatatttaccgcggtgatgtttgtagtttggccaccagtaatttaaggaggaggagcgatgagcgaacgggagaaaaatccaggggaaccggaagcgattcggtgccggtgtaaaaaaattgttgctcaaaaaaataaagaggagattatcattaaatgccgtttttgtaaacgaagagtagtgatttcggtccgggaaattaacgggattagttataccgattaaagaggaggggagtagcggatgttcgatagaagaattataatgttttttttcctaattttttggcttttttggattcccaatgtggccttggctgataaaaataaagaaaatttaaaaggtaatgaagaatgtttaaaatgtcacggggcggttggtttaaaaatggagtgggagggggttaatatttctctttacgttgattccggaaaatatcgcgactcaatgcatggaaccaataagtgtcaatcctgtcatcctggatttaactcttatccgcaccctaatgtcaaaagtcgtcaacaatttttgcaggaaattaatgacagatgtaaaaactgtcacgattatattctaaaaacctttaagggatcggttcatgaccggaaagacgtatattgtttttcctgccatacggcccataccatttttaggggaactgatccgcgcgcgtctacttaccgcaataacattgtaaaaacctgtagccagtgtcataaagggaatgttttgaaaagctatcaagaaagttttcacggtaaggctgtagctttgggcagtaaaactgccgctacctgtaccgattgccatggaaaacacaatatttttaccaaaaccgattctcgttcccttaccaacccggcgaatgttcctaacacttgtgcccgttgtcacgtttttccccgcaaaaattttgcccggggggccgagcactttgtgaaaacatcaacgggaaacggtaaagtggtttattatacggagaagttttttgtctggctaacaatttccgtggtgactttaactttaatccacattgaaatggaattatatcgacgatacaaaaagattagagagcagaaagccttagaggtgacagggggggaaagctatgaccggtaggacttatgaaaggtttaacattcatcatcggatacagcatattatgatgtttgtaagcttttttatctgtacctttaccgggttagcgattaaatacgagcaaagcaattatgctaaggtttttacaaaactggttggaggatttgaaaatcttttagttttgcacttagtcggtgctgttattatgctcatcggcagttgcttgtatcaccttttgtaccttttaatctatgttattgtaactaagaaagtctcttttgaagctctaccgacgctaaaagattttaaagatctttaccaaaatcttaaatactttttaggtttatcaccggaaaagccgcaattcacccgcttttcttataaagaaaaatttgattattgggcggtattttgggggattttcattatcggtggttctggacttatgatgtggttccctgacgtagccgcaaaatattttccccgaacagttatcgatgctgctcgagcagctcacagcgatgaggcaattttagctattgtggtaatttttacctggcatttctttaacgttcattttaatcctgactttttcccgggaaatctcgtttggtttcatggcaaattaaccgaagaacaaatggaagaggagcatcctttggaacttaaaaaattaaaagaagttcggggcaaggaggggtagaaatggcaacaggaaaattcaaaaataacacctttttaatcctgttagaaatgcttttttactttggagtattaatttggtttttaagttactatttacctcttggactccattaacgggaaaggggtgcttgctttgaattggaaaaaggtatggggtgtaattaccttcgtgctattatttacggtgtttagctttttttgttacagctatgtatcggtgacttttgagcgaaaaataaatgacccagagttttgtgtaagctgccacgaaatgaaatacgcttattatagctggaaagcaactagccatagtactgttaattgtcttagctgtcatgaaaacccggatttatttaaaatggtttatcggcatcgggttttaaagcctagcggccaagtcataaagaagatagtggttcaggatcaaaagtgtgaaaaatgccacctgagaaatcgaaaaattactccttcctgggacttaaaagatccccatccaattcactttcaaaaaggcctatattgtgtagattgtcattataatgtagcccacggtaaagctaattttccggaaaaaagtgaatggaccacctattataatgatgctattctcaaaaagatttctacttttacttctaggcaaaatcaggtggataaaggtgtctgtaataaatgccataatgggaaaatggcgtcgaagacgtgcgatacctgtcacatccaaagtagtagcaaaatagatttggcttctaaataaattacggcttttaggccgtttctttttttatgagcaaaagtttggtataattaaacgcgaacaagacgtgggagtggagcatatgcaatttcgccggatgttaaaggaacttgactggggagtgctggccaatgtttttttaattattattttaggacttgtgttaatcgccagcgctacccgggcaacttctcccgatgatgttcttggtttagctaaaacccagctactctgggttttttctggtcttcttttaatgtttggtagtttgtacattccttatgatgactttccgcgctatgccaaattcctctatctttttaaccttgttatgttggtgaccgtattatttgccgggagggaagctttaggggcgcagcgctggattaaaataggccccttttccttgcaaccctcggagtttgcaaaagatatcataactataactctggccaattatttagctgcccgtcagggacagattgataaacttagcgattttatccgggtgtttgtccatattggtgtccctatgctgttaattttaaagcagccggatttaggtacttcgctggtttttgtcgccattacttttgctcagctttatgtagcgggggcaaaccgtaaactcttatttagtctctttggcgggggcctggttttggccattggctggattgctctccatcttcactttccccaaatctggattcctttaaaagaataccagttaaatcggttaattatttttttagacccgtggaaggatatgcagggagcgggttaccacgtgattcagtcacagattgccattggttcgggaggtttttgggggaaaggactttttcggggaagtcaaaatcagctgaactttctgcccgagcagcacaccgattttattttttccgtgttaggggaagaactgggctttatcggtgcttcggtgctactggtactatatttgactcttttttggcagttgattcgcattggccagcaggccaaggatttactgggaagtttactggtagccggagttgtggccaagcttgcttttcacacttttattaatattgggatgacctgcgggattatgcccgtaaccggtatacccttaccttttgtaagttacggaggaagtgctatgtggtccaatttattatcggtgggcctggcgcttaatgtttacttaaggaggaaaaaattatcgttttaggttttaagggaaatagttaaattttcaaaaaattctcttaacaaagaaaacaaatttaagtataatggagaaaaattaattacgggttttccaggaggaggggcttggtgtggcggtaatttataaagccggtgacaatatctggcaggttgatttgtttgaacaggggattgctggcagaacgagctgttttattgtggcggggaaagaaaaggtagctttggtggaaaccggacctacgccatctaccaagtatatcttagaagccttagaagttctgggaattgaccgggaaaggatttcttatgtttttgtaacgcatattcatttggaccatgccggaggagctggaaaccttttgcggtatctacccagggcatatcttgcggtacatccccggggggcaagacatatgatatccccggaaaaattggaagctgctgctaaagctatctacggagagcggtttttaccgttttttgaaaaaataattccggctccggtcgaaagagttctggaaactgccgacggtcaggaatttgatttagggggcagagtgcttaccgtctaccatacttcagggcatgcccgccaccatcaggtaattaccgatagtttaacccggggtcttttttccggcgatatggcgggagttttaaataacattattaaaaaccggtacgggaaggtgtttgtctatccttcaacacctgctacggagtttgagccggaaaaaatgattttagagttaaaacggtttttaaacttaggattggaaaggatttactatacccattttggggtggtagaaaatcccggggaaatttttcattacttaataagggaagtggaagaatacgaacgtttgggccaggaaattttagcgcaaaatcttggcataaaggaaatgcggcaggctttaacctaccgggtatatttggaagcagccaaaaagggtgttttccttgatgacgatattaaaaacagctttgagcttgacctggaattaaatgctgccggcatacttcattacttaacaaaataaaagtcatgaaaaattatccctcttcataagatgtagtaaaacatcttaggggagggattttttatgtccgacaaggacaacctgaaaatttacggagattggagcaaaccctacataagaaagaaaagtatttatcgaccccccgggaaaaaacgcgaatttaagtttttttacaagtttttgctggtggtggtaattgtagcgggttttactttttgggtaagtaaagatttaccgggagcatctaagcttaaggaagctgtgaaatacgttttaactaccgagacggaggttcaaccggtttttgaccgggttttggagattgggatgggaaatgaagaggctcttactgcctctaatttagaaattccggttgatggaaaagtaatccggggatttggcttagatagtgatggcttttttcacgggggcttggatatactgggtgaacccaataaaccggttaaagcagcagctcacgggacggtggtaaaaaccggttataaaaaggggtacgataactatttaattatttcctggggcgaacaggaggttttatatgcaaatttaaaggaagtatgggttaaagcaggagaactggtggaaaaagggcaggagataggttgtaccgggaacagcgggatgctgcatgtggaatttcacgataagggtcttgccgttgatccggcaccggtctttaaggtaaagagctaaatgaaattaaaagttcacccgctgttctgggtttttctcttaatgtatctggctttaggagcatttgccaaaattggcatacttttattttcactcttgtttcacgaactatttcacctttttctgtataaaaaactttttcagaaacctgtttctttgaccctgttaccctttggaggggtaatagaaacttccaatccggtagaattctttccgggaaaggagtttttggttgcggcggtggggccgctggctaatttaattttgatgttttttgctttagggataatcaataatggcttttttaacgcaaatgtagcttttttattggattttaactttatcatggcggtttttaattttttgccggttcttcccctggacgggggacgaatgttgcgggcggttttaaccagggttactaatttaagaatagctacccggattgtttccaatatttcgctggtaaccgcttttgcggtggtggcggcgggaatttacggctttttattccggataaatggtgccgatgtggtaattttgggagtgttattgatttttttagcctttcgggaaagggtaaaaaacagcttttactttttgcaaaacctaacttataaggaaaaaattttaaatgagcagaaaattttaaattccaaggttttgacggtagcccgaaatactccactaaaagaggtggtagacaaattcttaccgtcccattaccagtatgtggtggtgttggaacggaaccaggaaatcttaggagttttaagcgaatggcaaataatggagggagttgtgaagtttggcctgttaaaaccggtgggagagcttttacaaaaatgagaagctttcctgcttatttttttcttacgggaaattttgtggtaaaatagcaatgaggtgaaaaaggtgaattttgctaaacttttagctttagtccagaaaccggcgagatatttgggcaatgaattaaatgcggtaaaaaagccctgggagaaaaatttggttaaaattgccttttgttttccggatttatatgaagttgggatgtcccatttaggacttagaattttatacgaaacggtaaatcgccgggatgatgcccttttggagagggtatttgctcctgccgaagacatggaaaagcttttgcgggaaaagggttattttcttttttctctggaaaataaaaagcctctttgggagtttgacctggtagggtttaccctgcaatacgagctaagctattccaatattttaaatatgttagaattgggtggagtggaaatatttgccgaaaagagaaggggatggccccttgttatggccggaggaccgggggcttttaacccggagcctttagccgattttattgatttttttgttttgggagaaggggaagaggtagtagcggaaattatcgaagtggtaaaggaagccaaagttaaaggctgggagcgtaacgatacccttttggctttagcgcaaattccgggggtttacgttccgaaattttaccgggttagttatgatgaagccggaaggttgaccgagtttatgccgcttaaaaaagatcttccggtgaaatttaccaaaagaattgctcaaggctttttatccggatactccctgccatctcccatagtaccttatcttgatattgttcataatcgggccatggtggaaataatgcggggatgcagccggggttgccgtttttgccaggcggggatgatttaccgcccggtacgggaaaaaactccggaattggttttggcagaagcagaaaaaattatggagaaaaccggctatgaagaaatatccttggcttccttgagctccggagattacccgtatattcgggaggtagcgaaaaagcttttggataagtaccaggaagcgggggtaaatattagccttccttccctgcgaattgatacctttgcagtagatttggcgtccgaactgcagcgggtgcggaaagctaccttgacttttgctccggaagccggaacccagaggatgcgggatattattaataaaggggttaccgaggaagacctcattaatactgtgaaagctgcttttaaagcaggctggcaggcaattaaactttactttatgattggcctgccttatgaaaccgacgaagacgttgcggggattattcatttagcccagaaagttgccgatatcggcgttaaagaagggagggtaccccgaggacggctgaaagttacggtttcggtttcaaactttgttcccaaaccccatactccctttcagtggctggggattatttcagcggaagaaattaaaaggcggcagggaatattggaaaaattggctaaaaaagaccggcgtcttagtttaaaaatgcacgattaccggacgagccttttggaggcagccctttccagggcggaccggcgtattgggcgggtaatttaccgggcgcataaattaggcgccaagtttgacggctggcaggaatattttaattatgagctgtggcaaaaagcttttttagaagaaggatttgaccttgaagcgtatgcccggaggagcttttctttggatgaccgtttgccctgggaaccatttgccgggggaataagtcagaggtttcttaagaaggagtatcgggacgccatggctggaaagaacaccgctgattgccgggagggtaagtgtaccggatgtggggtttgccctgctttggaaatttccccggtgctgacaggagggcggaaggttagtgaaatatttgcttaagtattcccggggaggagaattaaaatacatatcgcacctggataccatgcgggtttttgaaagggcttttcgcagggcgaatttgccgatggctttttcagaaggctttaaccctcatcccaagttttccatagccttgcccttagcgttggggcatgaaagtcaaggggagctaatggaattaaccttaaagcaatttttacctcccgaggagataaaagaacgcttaaacagtgttttaccttccggttttaaagtgttagaagtaaagccgtatttagatgataaaagcttaatgtcgcgggtaagcaaggttgtttaccggataaaaatcaatctttccaatacagaacttttagccaggaaggaaaagcttttaacggataaaccgcggatagtaaaaaacaccaagaggggagaaaaacaaattgatttttggcaggcggtcgaagctttagaggtgcaggaaaatggcataaatgtggttataagggttggagaaaactccttgcgtccggaagaggtagctaaaatttttttgggttatttgcccgaggatattgaatatattcgggaagaaattattttaagttaaagggagctatcatgactaagactttagtttttcaccgacagccggaatacgatttagcggcggtaatggttgacggaagtcctttttcgctttttgcgaaacggcgagacgaacaaacgcagattaacgatatttatttggggaaagtagagaaagtagttccggggttacaggcggcttttgtaaatttaggtttggctaaaaacggctatttacctcttgatgagataaacgttaagcccggggatgtagtgttggtgagggtagttaaaaaccccacagcccaaaaaggcgccaagctgtctacggtgatttcccttccggggcgaaaccttgtttattttccccagaaagagatgaaaggtatttccaggaaacttacggaagacaaaagggagtattatcatagggtattagaaaacttgaatcttcccggcgggtttattgttagaactttagccggtgaggaagaagaccttttgcaggaagccaaacgactttatgaagaatggcagggaattttagagcgaagtaaaactgctcaagccccggctttactttataaagaagatgacctttttacctggtgtcttagggaattactggacaaagactttactgccctttatgtggatgattttgaacttttggagatcgggcagaagtttcgcgaaaggtttcgcgtgttgctgccgccgatttataaaagctttaatgtgatggaagaatttaacctgataaggacaatggaaaaacttaccagggagcgggtctggctgaaaaacggcggtattttagtcatcgaaaaaaccgaggctttaaccgccattgatgtaaactctggaaaattcaccggaaaaaaagatttaaaagaaaccgcttttaaaataaatttagaagcggcccgggaaattgccaagcagattaggttaagaaatatcggtggaattatcgtggtagattttatttccctgttggaggaggaacggtgggaagagattttaagggttatggaagaagagtttttgcgggataaagccaaagtaaagattaccgggaaaactccttcggggctggtggaaattgcccggcagaaaatagggctttccatcggcgagctttttacccacgagtgcagtgtctgccagggcaccgggagaataacagatattactgtcaagcgtctctgactttatcacctttatgtgtctcgactttgacccgttgagcggatacaagagtgacaatatcacagattaataacaatcgccaaccttattgattgactatatcaataaaaagaggtataatacgtatttggcaatttctccgagtggaccagggaaaatggagcaaggtccgtttctattctttgagggaaaggagcggtacctatgtcaacatcaggtagtgctgtagaagttcgtcggatcgatgcgcttttgctccgtgcactgtacggaggttccaaatcctactgggaattgatgcgagctgggcaagcgcagacccaccaagtgctgaaggtcctgcagtcgctcttggagagcaagcttgtgacctacgacggtgagcgcttcgtgctcaccgaagcgggacgccggcaggtcgaagccttagggctggatcgggtggccgagcagcgctgtgagacctgtgcgggacgaggcatcgtcctgcgcccgcctttcgaccgggtccttgaaacattccaaaaaatggtgaccatgcggccaaaagcaacgcccaactttgaccaggggtatgtgacggtggagaccaccgtgctacgtctggccctgatggcccagcggggcgatctggtgggtcgcgatctcctgctgttaggcgatgatgaccttacggccattgcggccgcgctctcaggattaccgcggcgcatcttcgtcctggatgtggacgaacgcattgttggcttcatccgcgacgtagcccgggaccggggttgggacaacgtccacgctgaagtctacgatgtgcaagatccgctgcccgagaacctgcggggccagttcgacgtgttcttcaccgatccggtggaaacggtgcgcggtatcttcctcttcttgagccgttgcaccgaagcgttgcggggtcccggttcggccgggtatttcggcctttcattcctcgaagcctcttggaaaaagtggcgcgacatccagcgcggcatccttgatatgggatttgccatcaccgatatgctcggggctttccaggaataccagctggaaaacatcgtggcccagggttatccggtggcccgcatggcgccggtggcggtcaaggagcccgatgtttccttctacgtgagcaccgtctaccgcctggagctaaccgaagaaccgcggcccctctttaccggccgggtggagctcgggcgggacctgtattacgacgacgaagcatgtgttacactcccccgataatctccgaaaaatttgcgccccggtggggggtatttccgccaccggggcgcatacgtttaagaacggcggaataacagatattacttgacaaaaaagaaaaaattaagataaaattttaaggtaagccgctcaaaaaaggctttaaataggctttgggccttgccttttttggcgagtctaatgcgggaggttttggagcatgtacgcaattattcaaaccggcggcaaacagtacaaagtggccgaaggagacaaaatttttgtggaaaagttaaatgcggagccgggaagcattgtaaccattaatgaagttctggctgtagttaaagatggcagcattaaagccgggaatccctatgttgaaggggcaaaggtcaatttaaaagtggtacgtcacgggaaaggccgcaaaattattgtctttaagtacaaaccgaagaaaaattaccggagaaaatacggtcaccggcaaccgtttacggaagttattgtggaaaaaattgaggcgtagggccgggaggtgaggtagatggcacataaaaaaggcgttggtagttctaagaacggtcgggattcaaaagcgaaaaggcttggagttaaaagatatgccggtcagtttgttaccgctggaagcattttggttcggcaaagaggaaccaagtttcatcccggtaacaacgtaggtattggcggtgacgatactttatttgccaagattgatggttatgttgtttttgagcggaaagggaaaaacaaaaagcaggtaagcgtttatccccaaaatgtagcaatttaaccagccgagcagggctggttaattttttattatgaaaaaataaaagtgagaggataatacatggaaagagcaataaaaattattcgccgggagcggcatgaatttttgaactatctgcaaattttgcggggtttttttcagttaggtaaatatgacaaagttttagagtatattgaccggataagccggaatatccaggaacgtcaggaattctttcgcctgtttaacccggaaacggcattaattcttaccgagctttattatttgctggaaagtgtggaagctaccctgacaatttccggtgataaaaggggacaatataataaagattttggacctgttgttgaacgttttgttttagaaaactgggagctcctgaaaacttttaatggcaaaaaagaggtaaaaattattttagatcattttcccaggatagaactaatagttaacgaccagaaaagccaggaacagttgttatagggaggtaaaaaatatgttttatgatacggcaaaaatttatgttaaagctggagatgggggtaatggttgtgtatctttccggcgggaaaagtatgtgcccaatggcggtcccgatggaggcgatggcggccgcggtggcagtgttattttagttggggatgaaggtttaaatacgcttttggattttcgctataaaaggcattataaagcgcccaggggtgagcatggcaaagggagtaaccgtcatggtaaagccggcgaaaatctctatattcgggtgccggtaggaacggtggttaaagatgaagcaaccggcgaaattttggccgatatcaccgagcacggtcaggaagtagtggtagcaagaggcggaagggggggcaggggcaatgcccattttgccagccccacccaccaggcaccaaagtttgcggaactgggggagccgggggaagaacgctggcttcttctggaactaaagcttttagccgatgtgggtttggtaggctatcccaatgctggaaagtcaacgttaatttcccgggtaagtgcggcccgccccaaaattgccgattacccttttaccacccttactcccaacctgggagtggttgaagtgggcgaaggacagagtttcgtcatggccgatattcccgggttaattgagggtgctcatgcgggagtagggttgggacaccagtttttacgacatgtagaacgtacccgggttttattaatggttttagacatgagcggttttgaaggacgcgatccggtagacgactttgaagtgcttctaaaagagcttaagctgtacaacgaacagcttttaaccaaacccctcgtaattgctgccaataaaatggatacggccaatgcgcaggaaaacttagaaaaattaaaacagcatattgccggaaagtacgaaatctatcccatttcggcccttaccggtgaaggacttaaaccgcttatttatcgcctctgggaaattatttctactttgccgcgggagagtttggaggtaaaaccacagaaagtaataaaagagcagccggaagaaggttttgtggtggaaaaagttgatggaatatttgtagttaaagggaaaaagattgaacggttggtggctatgaccaacttggataacgaggaagcggttgaccgtttgcagcggacctttacccgaatgggtttagaagaacagttaaaacgtgccggggtaaaaccgggagacttggtgcggatcggcaagtttgaattttattttgtcgatgaaaccgaggggctggaggaagaataaaaaatcttaattgccgttgagacaattttatccacttttttagccggtataagcgaatgcgggatatttttaagtttttctgtgcggccataattgaaaattttgattatcggcagcttccaagtttttggcgttttctcggaaatattggctttttacgtcgggataaaatccggggggaggtaattaaccggcggggattttaatataaaaactgtttatggtaatagtaattttaataactaacaaaatcccggcatagtgatataatttatatgaggtgtcctttatgaacttaactaccatacgccgatatgccctggatattttagataatattaacgatggggtgtttgttactaacaaaaagcggaaaattatctattggaataaggcggcagtagaaattaccggaaagaccagaaaagaagttttaaataaaagctgctatgaagtgatgaactttccgcaaaacgaccagggaaagtgcctttgcgaaaataactgtccccttttatcaaccattaaagagggaaaagcgataaaacggtatagaacgatttttacgaaaggcgaagaaaaaataacgttagaagtttctacctcaccaattatcaatccccttggacaggtgttaggcggggtagcagttttccgggaaattaaagattaaaataaaaaggttgggtgattttcccaaccttttttaatttcttttcagggcccagggtaagagcagtaccgccaaaagagccatcatgctgccaaagtaaaaggcggcggcagggttaacgatatcccacaaaataccggcaattaaactggccggaagggcagaaagacctattgcggcgttataaagtccataagccgatgcccgtttttccgacggtactaaatcggcaaccatggctttttccactccttcggttataccgtaataggcgccataaagaatatacagtaaggcaaaaattttaggattgcttgccaccgcaaatcccaaatacaatagggcgtaaactatccaacctccggcaataagtttaagacgaccaatcttatccgacagagctcccgccgggtaggataccagaacgctaattaagttaaaaaatcccagcataataaagatctcaacaatcgtcatgccgttttcttttgcctttaaaattaaaaaggcatcggatgaatttcccagggtaaataaaattaaaactaccaaaaactttttaaaccgcagatcgagttcttgaaaagatagggaaaactttttaactgttttttccccttttggcggtacttcttttatgaaaaaagcgagcaaaagcaaaactaagatcccgggaatggtggaaataatgattaacttttgaaaaatctcccggctcatggagacggtcgttgcttcactccactgaagaatggcggcagcgataaataaagccaacacggctccaaaggggtccaaagcccggttaaagccaaaagctttgcccaggttttccggctcagtagagtcggctatcagggcgtctttgggagacgtacggaccccttttccaacccggtcgagaaagcgaattaagagaactaccggccaggtagtggtccagtaaagaaaagggcgggagaggttggaaagggcgtaaccgagaaaaaccagggcttttcgctttttaacgatatcggataaataaccggagattaactttaagagggtagaagtggtgtcggctattccttcgattaagcctattatttcggttttaattccaagaacattggagagaaaaaggggaagggttcgcagggtaagttcgctggaaaaatcattgagcatactgataaaaccaaaaaggaaagcgttttgacttaagccccaaaattttttctgtggtttatctttttgcatccaaatcatcctttcaaaaattgaccgaacagtcaattataattttaacattaataaatccttaaaacaatatttcacacttgacttgtgaaaataagtacaatataataaagacaacacgtaaatcttttaaaaaatacaaaatttttaagggctgtgtttttatttatggtaaaaagtgaaaatagtcacaagatttactacaggagggacatagtaatggaaaaaaactttttaacaccccaggaaatcgtcaacttcaccttagaaactggaatcaaaaaagcaaagcttaactttttagcttcttttatccttgggattttagcgggtagttatattgcttttggagcgtttgctgccaatttaattagtcattcggtggaaaactttggcattgccaaatttttaggggcggctgttttcccggtgggattaatgttagtggtaatggccggtggtgaactttttaccgggaatactttaatgactattgctcttgccgaaagaaagattaccttaaaagcaatgttaaataactggttatgggtttatgctggcaattttgttggttcttttttagtggcatacctggtgggaaggtccggtatgttagagttaaataaagggttagtagcagctgcagcgcttaggacggcagctctaaaagcaaatctgaccttcagcgaggcgtttattcggggaattttgtgtaatattttggtggttttagcggtgtggcttgcctatggagcaaaggatgtagtagggaaagtagttggaatctggtttcccataatgacgtttgtcctttccggttatgaacacagcattgctaatatgtattattttgctgtaggacttcaggccaaagctttgggagttgccaaacttgctcatttaaaatcagagtttttaacaaatttaaactggggacatatctggctttataatctgattccggtgacccttgggaatatttttgggggtagcattttaattggccttggttactggctggtttacctctatttgccgcgggttaatgaactctccttggctggtcttttaaagaaatttatctttggagttgaaaaaccaaaacttcaggaaaataactaacagcggagggcaaaaacctccgcttatttttaagtttttgggaggaattttgctttttttagcgaataatatatcaaaaaagacataatatatttggaggtgcttgaatgaagcggattttgggtttgctaagtttgttttttttgctaatttttggggtcgctggttgccaggaaaaaggagctgttacttctaaaaccaccgctccgaaaaatccggaagtgattttggctaccaccaccagtacggtggataccggtcttttagaccagttaaaaccggaatttgagcaaaaaaccggttacaagcttaaaatagtggctgtcggcaccgggcaggctctcaaaatgggggaaaagggggaagcggatgttcttttaacccatgcaccgaaagatgaagaggccttagtagctaaagggtatgtgattgaccgccaaccggtaatgcataatgattttatccttgtaggccccaaaaatgatccggcaggagtcaaatcggctaaagatttaaacgaagctttaaagcggatttatgagaaaaaggccctttttatttcccggggggatgattccgggaccgataaaaaagaaaaaagtctctggaaaactgcggggttaaatcccaaaggacaaccctggtacaaggaagcaggggtgggcatgggagcgtgcttgcagcttgcttcggaaaaacaggggtattctttaaccgaccgggggacataccttgcttataaagggaagattgacctggcaattgtccgggaaaaggacccgggacttataaattattatcacgttatgttggtaaacccgcaaaagtatcccaaggtaaattatgaaggggcaaaaaagtttgctgaatttttgttgagcccggaagtccaaaaagagataggcgaatttaagaaaaatttatacgggcaatcgttatttattcctgatgcgcaaaaataggaggaatttatggaatttatctgggaagggattaaagaaagtattcgtttaattttaaccggagacccggaactttaccaaattttacatcttactttaaatgtaagcctaacggcaactttgcttgcggcaattgtgggcttaccgataggtgcttttttaggtggcaaaaaattttggggtcagaaaataattcttggaatctttaatgctcttttaggcctgccgccggtggtggtgggcctttggcttactatgtttttgtggcgaagcggacctctgggtaacttaaaccttttgtatacccccaaagccatgattttagctcaattttgcattgctttaccggaagtaatagtatttaccgctgtggcttttagccaaatttccgagaacttttttcgtcaggttaaagctctgggggcaaatcgttaccagcaactttacctgttattaaaggaagtacggcttgggttactggcagcggtgattgccggttttggtgctgctatttccgaagttggggcttcgattatggtgggaggcaatatctatcaggagacccgggtcttaactacctcaattttactggaagtgggccggggaaattttggtctggcaattggtttaagtattattttaatgttgatctcttttatcgtagttggaacacttacttactggcaaagaaagggttattagcggtgattttagtaaaaaatttgcaggtttttcgcgcccgaaagcaaatacttaaaattaaccagttaaaagtagttgcgggagagaaaattagcctttttggacctaatggctcgggtaaatcaacgttactaagaagtctcgcactaatcgaaccggaaagtttgcgggctgttttttacaattctcgtgatgccaactggcaaataggatatttaatgcaagaaccgtattttttccggggaacggtggaagaaaatttagtactgcctttaaagcttaggaaaattccggaaaagataattaagaaaaagcttggggagtttacagaaaagtataaacttgaatcacttttaaggaaaaatccgaaagttttgtccggaggcgaaaaacaaaggatcaatcttcttagaactctaatttatgaacctttttatttatttttagacgaaccgtttacaggcattgatgctttgacaaaaaaagagctaaacaaatatcttcaaagctacttagaacaagaacccggaaggattttaatttacgtaagccacgatttaaaggagcttttaaagtggggtaagcgcttttggtatttaaaggatggagaaattaaatttgatttggcaaaggaagagtttttaaagcttaattatcaagacgattatctccaattattatttgaggagtaaggggtatgaaaattaaaactaaaatctggatagaagaggataatgcggtagtttttggtgaaggaaggtatttaattttaaagacagctttagagcttggttctttaaaagctgcggcggaaaagcttggcctttcgtaccgggcagcctggggtaaaattaagactacggaaaagcttctggggattaaactggtggaaagcagccggggaagaaaaggcggtattagtttaacgacagaagcccataaattactggtcctgtacgagcagttaaaaaatgacataaaaaattatgccgaccaaaaattccgggagcagtttttagaaaaaatttggcagaaacgttgaaattataggtaaattaaggtatagttttggcaaaaagggtggcggtggaggaaaaaatggaagcacttacgcgtgtaaaagattttttgtcaaagcaaaatcctccggtggaggtaattgttttaaatgccgataccagcaccgctcctttagcagctaaggcgttgggagtggaagtaggggcaattgccaaaactattgtggccgttggtaaaagtaaagcggttttagtggtagcagcgggggacgttaagcttgactttaaaaagttaaaagcggtaactggcgaaaaaatgcgtttagcccgggcggaagaagtggaggagttaaccggctttaaacccggcggggtttgtccttttgctttaaaaaagcctcttccgatattaatcgatgaatctttggagcggtttccggtagtttatgctgcggcaggttcgcccaactcagctgtaccaataacggtatcaaggcttttagaaataaccggaggccaaaaatgccgggtaacggagtgagttaacaatgcgcgaaatattaaaaaatgtccgccggctggttgtaaaaatcggttcttcgtccttaacccaccccgagacggggaaaattaaccttgcggctatggagcgttttgtaagggaatgtgccgatttaaaaaatgcaggattcgaagtaattattgtctcttccggagcaatagctgccggaatgggaaggcttgcccttccagaaaagccgaaaaatttaccggaaaaacaagcatgtgctgcggtaggccagggggtattaatgcatttatacgaaaaatttttttccgaataccaggtgatcgcagcgcaggtgcttttaaccggggaagatttggcggtaaggaagcgttttttgaacgccaaacatactttttcggcccttttaaattacggggttgttccggtggttaatgaaaacgatacggtagcggtagaggaaattcgctttggggataacgatacattatcggcccgggtagcggtactggtggaggctgatctcctggttcttctttccgatatcgatggcttgtataccgcagaccccaggaagaatagtaatgcccgttttcttccggaggttttggaaattaatgaggaaatcgaacagctggccgggggaagcgggacggcagttggtaccggtgggatggagaccaaaatagaggcggcgaaaatagcggtaaatgcggggatacccatggtaattgcccgggcagattatggcaatttgcggcgaattttaagaggggaagaggttggaacctttttttacccgaaaaagaaaaagcagtggaaaaagcaatggctgttatccggggcaagagtgcagggaagtatcatagttgatttgggagctgaagaagccctttgcagtggcggaaagagccttttgccttcgggagtgctgggagtggaaggagaatttccgacaggagctatagttgcggttaaaaatttaaagggacgggtgattgctaaagggcttaccaattatgcggctcaggatatcttaaaaattaagggacttcattcctgggaaattgctgacgttttaggccataaagattatgacgaaattattcaccgggataatctggtgctggtggattaaggaggtaagcagcagcttcgataaattgcactgtaagtgactgtgtttaactgttttgttatcataaaagtatggaactcttatccattggagaagtggcaaaaagattaggcgtacacccgaacaggctgcgggcatgggaaaaacagggactgatcaggcccgtgcggttgcccagcggccagcggagatacccggtagaggaaatcaaccgcattttagaaacgggataaaggcagagccggaggcggttgtcctttatgcccgggtatctacaaagaaacaggccgacgctggaaatctcgaacgccagatggagagactgcgggcatacgcacgggaaaaaggctaccgtgtagtggcggagtattcggatgtggcttcgggtttgaaccagaaccgccgtggtctggaacgggtgctgaaaagtgccgaacggggtgaattcagaaagttacttatcgaataccccgatagattggccaggtttgggtatgcctacctggagcgtcatttaaaacactgcggcgtagagatagaaatcacttcgcagaaagagcctgaggacgcgcatacggagttggtccgggacttgttagccatagtaacttctttttcggcccgactgtatggtgtaaagggtggcaggaaaatccggcggggtttccgggagctgataagggatgccgaagaagcaggagaaagatgaatttagctttacagtgtgcggggagttcttcccggaagtttacccgtcctatcggtcttctaaatggagcaggggcggggaagaccctcttgtcacagagatgcggcttttctgcgcctgtatgcggtgggcctttaaccggcttctggaaggcacttcccgcgacgagattaaaaaactcggtcaggaactttttgggctaaactcccggtatgcggacgacgccaggcttaaggcacaaggtgtgctggacagccaaaaaaagcttctggagctggagattgaggaaacggaaaagaaattgggccgggcaaggaaaaagctcggcccggttatgaggaagctggcaaaggcagaggaaaaaggagctacaccggaagttattgaaaagctccgtttagcggtcaagggacggaacaaccgggtagcgtctttagagaagaagctggctgaactggaagtataccgggagaacgggactgtacccagggtagtatttggcgggagaaaactttggaaaagagtcagcaggggccgggccacacgggaggaatggcaggccacacgcaaaaaccgtctctattcccggggcgacgagaccaagggcagcaacccgaacataaaggtaacttaccgggatggggaattccacctggcggtgactgtttcccacctctcggaaaaggtgggcgaagacgtcctgggccgcccgaagatgaaccgcgctccaagagtggagggcaggttgtggttgccggagaaacaccgggaactggtgcggatatggctgaccatgaggctgccctacacagtagaacttatacgcaccctggagggccgctatatagtgcatctgacgtttaattttggcagggtacaggagcccgactttgctcagggttgtttagccctggacaccaaccctgatggagtggccttgtgcaatgtaaacgcttcaggccagccggaaccctggccggaaggttttagcatcctttatccgggcaacccgggcaaatatgaaagagaatttcaggtcatcacttacccgaacggttttctttgcatcaaggtgcccgatctaacttatgcttccggcttccggcgggattacctgataggcgttttagctaaattggtggtagacattgccctctttttgggcaagcctatcaccctggagggtttagattttggtaaagacaggctggacaccagcaagaagtttaaccgcatggcttccaactttccctttgccaagatggtggaggcgatgtgccggagggcggtcaaagagggagtatcttttaaggtagtagctgcccggcacacgtccaccataggttactggaagtacatgaagcgttatgccgttccggtacattgcgcggcggcacttgttataggccgccgggcgatgggtttcaaggaacggataacgaaagaaatgaagcaattggtgaaccgtataaagcaaaacctgacctggaaagtcaatcctgatataccgagggaaggaaaaggaatgacccgtaaggtcagggcctgcttgaggcagctggacaggaagcttcctgtgcacaacgggtttgccccgtggcagcaagaagcatactactccgtctggcacgacctgaagttattggccctgtccttgcggtgaccccgtttagccggtaccggacaaaccggtaggcgtcctaacaggacgcgggaggcggggctggttccccaccgggaggccgacacaatccggtggaagtttaagcttccccgcgtgaacggtctgtaccggttgtgcccttccggtgcagcactcccgtccgggtgggactcccgggccgaggccccctgtcgccctgcccctcgggggcaaatcaaatatccgaaaggaggcgaaaacctggtctgggggccgacttggttgaaaataaaaaacagtcaagttttttgaaccaggatggttagatggatgaagtgttaaatttagctaagaaagccaaagaggcttcgaaaaaacttgctcagctaagtaccgaacaaaaaaaccgggcgcttttaaagatagcccaatacctggaagagaatatggagaaaattttaaccgaaaaccaaaaggatctggcggaagcgaaaaaaggcggcctatcgccggcttttattgaaaggcttacgttaaacgagaaaaggattttggatatggcggaaggggtaaggcaggtagccaaacttcccgaccccgttggtgaagttctcggaatgacccgccgacccaatggccttgtaattggtcaggtgcgggttcccctgggggtggtagggattatctatgaatcccggccaaatgtaaccgtagatgcagcggctttgtgccttaaagcaggaaatgcggttatccttcggggtgggaaggaagcttttaactcaaaccttgctttagttactcttatggaagaagcgctccggagcgaggaaattcccgaaggggcagtagggatgattaaaaccaccagccgggatgcggctaattatttaatgcggctaaacggttatttagacgttttaatcccccggggtggtgccggtttaattaaaacggtggtggaaaacagtacagttccggtaattgaaacgggagtaggtaactgccacgtttacgtggaagaagacgcggacctggaaatggctgaaaggataatcattaatgccaaatgccagcggccggcggtatgtaacgccatggaaaccctgctggtgcacgaaaaaattgctccggttttcctaccccaaattgggaaggccttaaaagaaaatggtgtggaaattagggggtgtgaggtaacccgccggtatattcccgacgccttaccggcaacggaagaagattactacacggaatttttagaccttatcttggcggtgcgggtggttcgggatttagatgaggcaattgcccatattaccaagtacggttcgggtcactcggaagcaattgttacccgggattactttaaagcgagaaggtttaccgaggaagtggatgcggcggcggtttatgtcaatgcttctacccgctttaccgatggctttgaatttggttttggagcggagattgggatttccacccagaaactgcacgctcgggggccaatgggcttaaaagagttaaccaccaccaagtacgttatctacggcaccggccagatccggggctaaactccgttcccatatttacgtcccataccgcaaactaagggacggttcttttttttttaggcgtattgacgcaaatataataaggtgtttgacagatgttttgggtcgatttaaaataaatgtgaaaatgaatattttcttcgttaggtgaggctacttcctggatataggctactgcccggaaatgtcgagagacaccaacgggtaaacaggtattaccggcttaaggttttacctaatgtagctgagggtttcctctaagccaggttgagctaaagctttgacgagtggagaaggtttttacaaccttctttttggcggcggccaggaaggtttttttattttttaaaataggtggtgaagcgtatgtccattaacgaaatgtacttttcggagctcttagggaatcctgccattgatcctaccggagagaaattaggtgtactttatgatattggagtaaaggggagtgacacttttcccgaaatttgctttgttgccgttaagaggggtaaaaaaatatatagtgtagaatatagctttgtaaaaattttaaaccgccgcattcttgcttttaaccgtcggttaaaaaatatccctttaaatgagttaaatttggaatgtctttggttaagacaacatattttagacaaacaaattgtcgatattttgggaagtaaagtagtaagggtaaatgatattaaacttgcctattatgagggaacggtccggccggtggcggtagatattgggcttctggggcttttacgccgcctgggagtaggctttgtgggcaataaatttaatttaaaggaagagttaatctcctgggagtacctggagccaatttatcaaggaacgccagaaattttgctgacggtaccccagagtaaaattgcagatttgcacccttcggatatagctgaaattttatcccaattgaacagtaaagaaagaacgaagctaattaattctttagacgatgagactttagctgaagctttaggtgaaatggaagctaactttactgctaatatcttggaaaatcttgatgataaacgagcatcggaaattttagagcaaatggccagtgacgatgtagccgattttttaggagatttgccggaatttaaaaggcagcgtttctttgctcttttaagccaacatgatcaagaaaagattaagaaactcttagaatacgatgaaaaaactgccggtggccttatgaccaaagaatttattacttttaatgaagaattaaccgccgaagaaactattaataaattaagagaaatggcgccggatgcggaaatgatttattacctttatgtgttaaatgaaaaaggacagttaaatggggttttatccctgcgggatttaattgtagccaagccttcggagaaattaaaaaatatcatgcggaaaaagattatttcggtagcggatagggcaagcgccaaagaagttatttcggtaattgctaaatacaacctcttagctttaccggttgtggataaagataatcggcctatcggcataataacagtggatgatgtgatggacttactcttgcccggaggttatcaccatgaaaaagtttaaagtaactaataagtttttgcaaaaaagtttatatgttttaagtataattggcccggggcttattacggtaaatgcgggaaatgatgccggaggtatcgctacttatgccgccgtaggggcgttatacggttaccgcatgctttggggattattgttaattacctttagcttagcagtaatccaggaaatgaacgcccggatggcggtggtcaccggtaaaggtttatcggatcttattcgcgaaaattttggggtaaaagtgacttttttggcaatggtgattttatttgttgctaatcttggggtatgcattggcgattttgcgggaattgctgcaagcttagaactttttggtgtggctaaatttgtttccgtacctttgatggcattttttatctggtatgttattattaagggttcttattcccggctggaaaaaattcttcttttatttactgtcgtatttttttcttatatcataactgcctttgtggttaaaccaaactggtccgaagtttttaaggctaccgttatcccttcgattatacccagaaaggattatatcctgacttttattggcatgatcggtacgacgattaccccttatatgcagttttacctgcagggttccattgcggacaaagggctgagcctgaaagattataaatacgaaaagctcgatgtttattttggggcgttctggggagatttagtttctttttttatcattgttaccactgctgccaccctttataaagctggtataaaaattgaaacagcccaggacgcagcgcttgctttaaaaccgctggccgggcagtatgcttcattactatttggcataggacttttaggagcttctattttggcagcaatagttattcccctttctacggcttatgcggttacagaagcttttgggtttgagcggggtttggataaaagttttggcgaagccccggtgttttacggtatatttacctttatgatttttataagtgctttattaatactgcttccgaagatttcattagtgggaataatgctggctacccagcagttggccggcattttatcaccaattattttaattttaatggtgcttttaaccagtaaaaaagaactaatgggtgagctggttaataatcgcctgcaaagtattattgtctgggttactgttatttttattattattttaacgataactttggttatggcgagcttttttaatttttaattaaaaccaggactttaaatacctctcccattggggggaggattaatttttttatttttaaagtttcctggtagctttctaaaggccgggtaaggtcatcccgttttacaaactccataattcccgctttcattaaaaattctccctggcttaaaaataattcttccttaaaacccaggcttttggcttttttccggagcatcccaaaatcaacgtgagcggtaatgtcctgctcgccgggattttgtagggggtctttttggcggtggcgggaaaaagacgtaagcgtacctgtgctgcgggcagggtggtagagttcagcggtatcaaagccatagtcgattataataaaggcgccgcagttgagtttttgataaatttcttccagccacttacctgcctccaggtttacgttgaaaatctgcccttcaacgggggatatgttggcttcttttaggtataactcgatttcgggggaagaaagccgggatgggtaggtaaaaaatttaccgttatcatcaacccctacgtaaatttcctgaaaaattcccttttggtaaattacccggtggacgggaaacgcgtctactacttcattggcaatgattattcccgaaaaattttggggaaattcaggaagatgctttatctggttttgctggcattcaagattttttctttggacttctcttaaatgagcgcttatttcaagaatgtgatattccgggaaaagcccttgagcagcaaaccaaactaaaatatcttgagccattttcccggttccagcaccaaattctaacagcgttaagggcatgccataagtttgatagaggttgaagatgtattttcccagagtataaccaaagctcttacttaaaattggagcagtataaaaatccccttcttttccaagggtaacatttcgggtataatatccgtagtccggatggtataaagctaattccataaaatcccgaaaggtaagcggcattttttttattttttctattagtacttctttaagcataaaatcctcctttttagcatatacaacgaaaaataaaatttcttaattgtgattgtaccataacgacgaatatagacaaaagaaggcaaaaaactttgcaggaatttttaattaaacgtcgaatacctttgccttatgtggtggggtgatataatgaagcaaatttgggaaaaaatccaaaaagaacgggaaaagcttgtagaaatatatgaacggaaaaaagattttcgggatgaggaagtgtaccgtttaagccaggccatagatgagctggtggttaattatatgaaaaaacaactggaaaatccggaggaccggttatggccggagctaaaataggaatttttggcggaagctttaatccggtgcatctaggccatctggtactggcgcgggaagccttttggcaggccaaacttaaccaggtgatctttattccggcaaaaattcccccccataaaaaagagggagtaataagtgaacagcatcgctttcaaatgttacggttggctttaaaaaaatatccggagttttcagtgagtaatattgaatttttgcgggacaagccttcgtatacttttgataccgtagaggagttaaaattactttatccccatgatgaactttacttcattaccggtgccgatggccttttggaaattaccggatggtacagaggcgaagaacttttaaaaaagattcctataattgcggtttcccgtgcaggggtttccaaagaagtttttttaaatcaggtccaataccttaaaaaccggtatcgggctcaaataatcgtggtagaaatgccggagattggaatttccagttctttaatccggcagagaatcagggaaaagcttccctattcccatttaataccggtagaggtatatgattatattgttgcaaataatttataccggtaattttgtatgaaccgggctggccggtccataataagaatacaaaataaacaggtgaaggtggtatctgatgaccaaaacattgtatgttggaaacttaccctggaaaatccggtcagagcagttacaggaaatagcttcggagtttggggaagttataggagctcgggtaatccttgaaaagagcaccggtcgttccaggggatacggctttattgaagtgcgggatgaagatgcggaaaaatttatgaccggattaaatggcaaagaagttgaagggcgacagttggtagttagcgaagcccgggagcggaatggttaacccccgattttgcgggggttttttccggtttaagggggatgggttgtgaaaagatttttacggattttacaggaaaacctttcggaagaaagaataagtcactctttaggggttgcgcggaccgcttattatcttgcccaaaagcaccttccggaaaaaaaagaaaaagcttttttggcgggaattgtccacgatatagcccgggagtggccggaggaaaggtttattgcctacttactagccaggggatatgagataacctctgaagataaattaaatccggtggtgcttcatgctcccgcgggagcatattttatccgggatatgttggggatttatgatgaagagatttttaacgcagtttcccgccataccctgggggcagtggacatgaccgatttggatatgattatttttttagcggatttaattgaaccggggcgaaactttgcccaaaggcagaagcttttaatcgcctcttttcgagacctaaaacgggggatgcttttagccctggaaaataccttggaatatttaacgaaaaaaaataaaacggttgattcccggacactcatggttttaaattattttcgggaggaagtagcaaaaaaatcgaaaatttagctataatataaaaaggaatttaggggaggtgtctttttggaaaaaactttacctcaacatataaatattgcaatggatgccgctttggataaaaaaggatttaatttaagccttttagatgtttcttctttaacgccaatttgcgattactttttaatagtttccgcaagttcgaccattcaggtcaaagcgattgtcgataacattgaagaaaaactgtcggaaatcggcctaactccttaccgtattgaaggtaaaaatgccgcccgctgggttttaatggattatggggacctagttgtgcatgtgtttgtggaagaggaacgggaattttacgatttggaaagattgtggcggacagccgaaaattaccggcatgatgtggttgacaaagtttaatgatttatatataatttctcatgtgactaacaatgtgaaaaacggtgaagaggagcagtaactgttttgtggcttaaagagagcagccggcgggtgcaaggctgtagcctccaaacagtgaactcgcctcggagttgccagagggataagtacttctggccggtatgttccgttatccaaaacaagtgggcaagaatgtggggctgtagcgcagtgggagcgcgcttccttggcatggaagaggtcgcgggttcgatccccgccagctccaccattattgtattcttgccaagtagggtggtaccgcgggaaaacactcctcccgtcccttaggggatggcgaggagttttttgttatatctacctattggagggagaatatgcaagaaaggtatgattttaaagctattgaagctaagtggcagaaaaaatgggaggaattaaaactttacgaagtggacgatttttcggaaaaaccgaaatattactgtttggaaatgtttccttatccttcggggaaacttcatatggggcacgtccgcaattactccattggggatgtggtagcccggtacaagcggatgcggggctatgctgtgttacaccctatgggctgggatgcttttgggcttccggcggaaaatgcggcgattaaacacggtaatgttcatccggcggattggacctgggataatattgccaatatgagacggcagttaaaggagttaggtatttcttacgactggcggcgggagatagctacctgtcatccggaatactaccggtggacccagtggctctttttacagttttataaaaaggggcttgcctacaagaaaaaagctccggtaaactggtgccccggctgtcagacggttctggctaacgaacaggtgatagacggggagtgcgaacgctgccattcccgggtggagaaaaaggagttagaacagtggttctttaaaattaccgcttatgccgaaagacttctgcaggatattaaaaagcttaccggctggccggaaaaggtaaaaatcatgcaggaaaactggatcggaagatccgaaggggcggaaattacttttaaaataaaggggcatgaggaaacaatatcggtgtttaccacccggcccgacactattttcggagtaacctatatggttttggcgccggaacatcctctggttgaaaaaatttcccgggggactcagtacgaaaaggatgttttggaatttaaacggaaaatgatgtacttgtccgaaattgaaagaaccgccgagaccgcagaaaaagaaggggtttttacgggagcttatgctataaatccctttaccggggaagagattcccatacttttagccaactatgttttagtggagtacggtaccggtgcggttatgggggtgccggcccacgaccagcgggacttcttatttgccaaaaaatacaatttgcccataaaagtggtaataacccctccggggcaagaattgaaagccgaggagttaacggaagcctataccggagaaggaattctggtcaattccggcgagtttaccgggttagccaacaaagaggcaatcaggataattacccaagaagcggaaaagcggggatttggtaaatatcgagtaaattacaggcttcgggactggcttatttcccggcaaaggtactggggtgctcccattccggtgctgtactgtgaaaagtgcggaattgttcccgtacccgaggaccagctgccggtagttttaccgtataatgtagaatttcgtcctaccggggaaagtcccttaaagtacgttcccgagtttttaaatgccacctgtcccgagtgcggtggacctgcaacccgggaaacggacacgatggatacgtttatttgttcgtcctggtattactatcgttatacttcgccccgggataaacaacagccctggagcaaagaaaaggtggaaagatggttgccggtggaccagtatatcggcggggtagaacatgctattttgcaccttttatattcccggtttttcaccaaagtcctctatgacctgggattggttcatgtggacgaaccctttaccaatcttttgacccagggcatggtattaaaagatggggccaagatgagtaaatccaaaggaaatgtggtaagtcccgaagaaatcgtggaaaaatacggggccgataccgcccggttgtttattctttttgcggcgcccccggaacgggatttagagtggagcgaccagggggtagagggaagctttcgctttttaaaccgggtgtggcggctaatttaccagaccaaggaccggatatccgatgaacttcgggaattttcggcaaaagataaagaattaaatcgcctgttacacgccaccattaaaaaggtaaccgaggatattgaagaaaggtttaactttaatacggcaatttcggcaattatggagttagtgaacggtctttaccagtacaaagaaggggaaattaatcccggccttttaaaagaagcgttaaacaaactggtgatacttctggcaccttttgcgcctcatattgccgaggaattatgggaggcattgggcaataaacaaagtgttcacttagaaaaatggccagagtatgatgaagaagctctaattaccgaggaagtggaaatagttattcaggttaacggtaaagtcaaggaccgggtaatggttccgagaaatgcggcggaagatgagttaaaggaaattgccttaaatacgccgaaaataaaagaattgaccgccgataaaaaaattattaaagttattatagtaccggaaaaattaattaatattgtggtagcggggtaacaatggaaaactgggaggttttaaaaaagataccccttttcggggagctttccccggatgatttaaaggaaatcgggaatcttctttattcccgccggctgaaaaaaggacaaattttgttttccgaaggggacccgggggcggcagtatactttttaaaaagcgggcggattaagctctataaagaggaccgggaaggccgggaacacatccttcattatgttgaaccgggagatatttttgccgaagtggtgctattttccaagcgtccttatcctgccaccgccgaggttatagagccgggggaagtcctggtaattcccaacgaggaaatggagaacctcttgaaaaaacgcggagaaattgcgttaaatctcatcaaggtgctgttgtatcgtttagatttagccaatcaaaaaattaaagagttagcgttaaaagatagtttagcccgggtatgtagcgttctcttacgctacggcccggtaattaatctttcccagcaggaaatagccaatttagccggggtttcccgggaaacggccagtcgaataataaatgagtttaaacgtttaggagtacttcgggccgaagggcggagcttagaaattataaattatgacaaattaaaagatttctcttaaatacttttttcacaaaaaaggaattgggcgagtttaagcgaactttgtttaatagaaaaagttaataccccactctacgggtgcccggaagggttaaaagggaagccggacggaatttccgtaaacggcgcgggcccgccactgtactcggggagcctcttttagagatgccactgtccgttaaatcggatgggaaggctaaaagaggcgatgagccgtaagccaggaaacctgcccgtgagagttaatctgtcttaccttcgcggcgaagggagggattgtaaggcttttggttataatccgcttaccgaaccgggaagcggattttttactaaatttaacaaataagggggcgaaaaaatggtgaaaaaaagatgggtggtatttttagctgttgccgtcattctgttggtggcggtagctccattactggcagggcaaagtaagggaataacggtaaaagattctaaaggaaacgtttttacctttaaaagttatcccaaaagaattgtatctcttgccccaagtaatactgaaatcttatttgctctgggattagataagtatattgtaggtgttactaacttttgcgattacccagcagcggccaaaaaaaaggccaaggtgggcgatgcatttaatgttaatgtagaaaaaattgtaagcttaaaacctgacctggtggtggcccaggatagtatttcaccggatgctattaaaaaactgcaaaacttaaaaattaaggtgtttgttttaaaagaaccgaaaaactttaacgatattttaaataacataaagctggttggtaaagctaccggtaaatactctaaagctgtaagcattactaataatatgcaggcaagattaaataaacttacagcaaagttaaaaaaatacaacaaaaaaccgtcggtcttggtagaggttgattatgcgtacggtttatatgttgccggaccaaacaccttcattaatgatctcctcgtaaaagcaggcggtaaaaacgtcataaccagtggtagctgggtaaacctttccgatgaaaagctcttaactttaaatcctgattatattttacttgctgataccgcttatttaaaaccggaccaacatccatacaaacgtgaactctggcagtcactgcgcgcagttaaagaaaagaaagttattgacagcattgatcctaatttaattgtgcgaccgggtccccggaccattgacgggattgaaaaattagctaaagcccttcatcctggtttaaaataggtgagaaaatgaaatcgtggtgggtaaagttatttttaggaggagttattttactcctcctccttatttttgttatattgttggcggcaaacttgggagctgtgaaaattccgataacgaaactctttttagaaccgtataaaacaatcttttttaagataagactcccccggatagctttgggacttacagtgggagcagctctcggcctggcaggtacggtgtaccagggggtattgaaaactcctttagctgacccgtatattttaggagtatcttcaggagctgctgcagctgtagctttactaactctgctaaaatcttttccttattatgctttgcccttaggagcgtttttaggaagtatagtagcgttacttttagtttttttaatttcccgaaaacccgaacctaatagattaatccttgcgggaattattgtaaatagctttttaggagctatcgttacttttgttttagcggtaagccgggaaaatatgcaccagattatttactggttaatgggaggactcagtaataaaggatttaaagaagcgggagtgcttggcctgtaccttttatttgggcttggtttcctttttatttttgcccgggatttaaatgctatgagttttggggatgatactgcagttcagttaggggtggaggttaacaaaaaaagagttctttttttaatgctggcaagttttttaacggcaggagcggtcagcttttccggaaccatagggtttgttggtctggtagttccgcaggtggtagaacttatttttggtaaggattttcgccttttaatacctttatcaaccttagcgggagctatcctcctggtttttgccgatgctttggcccggagcattttagccccggcggagcttccggtaggggttattaccgcttttatcggtgctcccttttttgcctatctttttataaggcggggttatcatgcttaaaggtcttaatttggcctacggttacggcaacatcaccttgtttgaggggataaatattgaagtccacccgggcaagtttactgtaattataggccctaatggtgccgggaaaacaacattgttaaaaattctggcaggtttattaaaaccaaagtacggtacggtacaactaaacgaaaaagaaatatttttgctaccggcaaaggtgcgggcccggatgctggcgtatgtatcccaggaacccgaaactttacgggattattcggtctgggatacggtaatgatgggaaggtacccttatcagggatttttagggttagagactaataaagattttcaagcggtaaaaaaagctatagaaacggtaggtttagccggttacgaggaacgaacccttttgtccctttcgggaggggaaaggcagagggtttatcttgcccgggctttggcccaggaagccgactatatcctcttagatgagcccaccaatcacctggatttattttatcaggtaaaaatactatctcttttaaaagatttagcggctcaaggtaaagggatattagcggttcttcatgatttaaacttggcttccttttttgctgataagctctacttattttcggcagggaaacttattaccggcgaggcgaaaaatgttttaacctttgaaaacatttataaagcttatcaggaaccagcacttgttgtgaatcacccggttttaaacattccgcagatactgccgttaatagttaatagagttagtgacggcaagaaaaaggtgcatatcataggcggtggagggatggctgggagcataatgctccgggaaagccagcagggagcgaaaatctcagcgggggttttaaataaaagcgatagtgactggcagacagcaaaagcactcggggcagaagtggtggaggaagagcctttttcgcccatttccgaggaaagctaccagcggcttttggaggtcataaagaaggcggataagattgtggtagctccggtaccaatagggccgggaaatctaaaaaatatcgaagcccttttagaagtggaaccgaaaaaaatttttatagtaaagccggaagaaatggagaaaagggattactccggaggaagggctacttatattgttaattcccttataaaggccggcgcccaaaggtatcccgaggcgtaaaactgtgataaaagtcatagctctaaaaggaaagcccaggttaaaataagaaaaaacaaaaggggaagaagaagatgcgctggacgaaagaagcattagagtacatgaataacgttcccttttttgtgcgggaaaaagccaagaaaaaggtagaggagtgggcgaagcaaaagggtgtagaggagatcacggtaaatgaagtaatggaagcccgggggaaaatgaccgccagggatgtaagcgacccgaaaccgcaaaaacccaaaattgcggtggtgcgctgtcatattgtttccgaggtttgccctggaattggttgttttaatagctttaataaaagggagcagcagtttgcccgctatgggcctgaggcagaaattatcggctttttcacctgcggtggttgctccgggcgccgcgtttccaggcttattgaaaaacttctcccttatgaattaacgcacgttcatttaagttcctgtatgttgttagacggagattatcccaggtgtcctttcaaagagcaaattaaaaaaactattttggcaaaaggtgtagaggtagttgaaggaacccaccattaaaaccctgcagttgcagggtttttgttttatatttttatattttacttagtatatttttgcttagcataataatataaactaagtagataataaaactccaaaatacctttaaataaagaaaatacgacaattttcgacaaattttatttatattgaaaaaatataaaatatattgtaaaataccttagaaagcttgattttttcagggggaaaattcatgcagcttacaaaacagggggaatatgctttaattgccttgatggatctggcaaaactgcctaaaggccaggtagtaccggtaaaaaccctggcggaaaggctgatgttgccggaggcttttttagcaaaaatcgtgcagtctttggttaaagcaggccttgtctatacagtaaaaggaccgcaggggggtgttgccctcctgaaagatccggaaaagattactgttttggaagtagttgaagcggtggagggaccgatagttttaagtcagtgtattaaccatccggatatttgtgagaaagtggaaatttgcccgttacataagatttggcataaagttcagcaaaaattaattgaggagttttcctctcataatcttttaacgctttccaaagaaggccagttaagtggctttttagcggagtagcttatgaatccctttgatgaccgttccaagctttctttatatggaattatttttttacttttagccttggtttgctatttatggtggaccgggccggaatcacctccgcttaaggaaacagccgagcaggaagttattaccagggaggttaccccaaagggaacggtggttgttcatgtggccggagcggtttataaacccggtgtttatgttttagaagaaggcgcccgggtaaaggatgccatagaaaaagcgcggggaatgttacctttagccgacgacagcagtattaacctggcggctaaggtaagcgatgggcaaaaaatctatattccctttaaaaatgagacaacaacggcttcagcttcgaccaacaaggcgtttggccagcaaaatgctctaaagggctccggtggccaggaagcaaaagtaaatatcaataccgcaaccgccgaagaactggatgaactaccgggagttggccctgccacggcagctaagattattgaataccgggagcaaaatgggccctttgcgactattgaggatctaaaaaaagttaagggtataggggacaaaaagtttgaaacgctaaaagattatattacggttaattagaggggaatatggaaatttatcttgctttcattttttacatactgggaattatcatagccgatcagggttttatcccttttcggctatttctgtatttggccttattgtttatgcttttatatcttgttttaccccgggaacgcaaaagcttagccgttcttttagtagcttttatgcttcttggaggggtaaacctaaatcttcatgtgagtccgggttttcgggaaggggaatatcggggaatttgccgggtggtggaagggtctaccgtaaaaaatgataaaaacagttttaaagtagtggatttaaaaaccaaagaaacctatttagtccgggaaaaagaaatggttttaaggcttccgggagatattttaaaaattaccggaagtttcctaaaaccagttcctccgcaaaatcccggcgagtttaactatccaagttatttaagacggcaaggaatttatggggttttaaacgttcaaaccgcggaaaaaatcggggataacttttcttttcttcggccttttgcagcagtaaaaaattttcttaaagaaaagttaaatacctattctcccgaaactgcggcgttattaaaaggtttgtatttaggggacgatgaggaaatttccccggaggtttacgatagttttgcgaaaaccggggtcgtgcatattttaagtgtcagcggcctgcatttggggttggtggcgggggcaatttattttttgggaaaggggttacggctttcccggcaatggcaaaacctttttacaataattttttgctttttttataccgccctaaccggttttaacccggcaacggtgcgggccttcttaatgctggtgtttttggtcggggcttttttcttggggcgggattatcagccggtttatcacttatttttaagtgcctttttttatcttttaataaaacctcaggagcttttttcggcgggttttctcttatcgtatttagcaaccctggggatatttttaataggtttacctttagcggaaaaattaaagttgtatttaccttcttatttggccgacactattggagttacggttggtgcgcaaattttaaccgagccaattgtattttatcattattccctctttgctaccctttcaattatagccaatcttttagtagttccccttaccggtattattatggcttccggaattttcggtttatttttatctcccttaagacacctaactgaactactaacggtgtttactttaaatatgaacagtcaaatggctttaattcccggggcgacaatagcagtaaaaaagcctttttttacattaatttttcttttttattgctggttatttttaggatatttttggttggtaaaaaaagaaaagatcgatattgttaaattctgtgtaattgcctttttaattttaggaatatttttagtaccaaaagagcacggaaaaactgtttttcttgccgtgggccagggggatgcagcggtaattcatactttgcgcggacgcacgattgtggtggataccggaccaaaaaacgaaaattatgatgcgggaagaaaagttttagcgtatcttcgccaaagtggcacgggggttatagaccttttagtgttgacccatccccataatgaccattacgggggtgcagaaacgcttatccagagtgccacggtaaaggcggtcttaatttctccatatttaggggaagaccaggaatacctggaacttttaaatttactccggttaagaaaaataaaaatttattatgctaaaacttctgccgttattagtttggatgatgtttctttacggatattaggaccggaaagaatctattccggtacccgctcagaccccaataacaacagtgtagtgctagcgggtaaaataggccggaaaacctacttttttggggcggacatcgagagagaagcggaagaagatctggaaaaccaacttctggcttattatgaagtggtaaaaattccccatcatggtagtaactttttttcagaaagctttatggaaaagttaaaatttggttatggagttatttccgttggtcaaaataatctttatggttttcccggggataagcttttagcggctctaaaaggtaagggaaagctttggcgtaccgaccttgagggggctttagttgtcgaaaattattaagttgtattaaaattaaagaaaaaagtaccggggtggaaggatgattgatttaacacctcttttgacttattattatcttgctttactaacccagatgatagagcaaatggagaggttagaggctctttcttcttccgaaatccctaaaagcctgaattttgccgacctggtagcggccaaacaagaagcggcgttatccccttcggaaaacaagatagccgaaatggttcgtgagctttcgcaaaaatatgaagtaccttattcgttagtaatggcggttattaagcaggaatcgaactttaatcccaatgctacatccccccggggagccatgggcctgatgcagttaatgcccggaacggcacggatgttaggggtcgagaatccttatgaccccagagagaacttagaggggggtattaaatatttaaagtctcttttagaccggtttggtgatgtggaacttgctctggcggcctataatgccggaccgggcaatgttagaaaatataacggcattccaccctttgcggaaacaaaggattatgtccaaaaggtgttaaggtggcagaagttttatcaaggagacgagagaaatgatagcttacgaacggtttaaaaatgccttaacccgaggggttttaaaacccctttaccttttttccggagaagagcggtattttaaagagcggctttttggggaaattaaaaaatatttaggaagcaaccacgagtttaactatgaagagctggatggtcatgaagttctccctgaagaagtggtagccagggcagaaacggtatcgttttttgggcaaaggttcattgttgtgaaaaactgtcgctttttttccggaaaacatgacgaggaaccgcttttaaattacctgaaaaacccggcaccccgggcggtggttattttttccacagaacttcctgttgataagaaaaagaaaatctatcaggagtttttaaaaaatggtgaggagattgaattttcccggttagatgaaaaagaagtccaggaactaattaaaacctgggcggaccgggcaggctttaatctcgaacgggaagcgttgatagttttagctcagagttacgggcagaatttagtggagttagaaaaagagtttaaaaaattggttttatataaactttcggaaaagatcattactttaaaagatgttttggaggtttccggccaggatcaagaaatctcggttttttatcttgttgaagaactactctccgggaaaataaaccgacccaagctaaaagaaaggcttaccaatcaggaagaagcggttaaatttaccgggcttgtggcaaaaaacttaaggcaaatctataccgtaaaagttcttcagcaaaaaggtaaaacactgcaggaaattgcgaaaattaccggcattcccgaatggctggtaaaaaaaaccttaagaagtgcggtgcacttaagtcaggaaaaactgaaaaaaggaattactgccctggcggatcttgatgtaaaaataaaatccggtgaaagggagttaaccggattatttgagagattttttctattaatgaaaaaataaaaacccggagtatcagccgggtattttttaggatgctttataaacggaattgaatttccgggtgagccgggatttttttctggaggcggtatttttatgaataacacctttggttaccgctttatctaaagcccgtacagcctgccgtaaaagctctcttgcttcttcggcgggttttactttaagggccatctcaaactttttaattgcagtcttaacagccgaacggatagctttattgcgcatggttcttttccggataattaaaatccgcttctttgctgacttagtatttgccaccaatctcacctcctaacagcaagtattctaccagagatatcaaaaaaatgcaagaataccttcttgtttttttttgccctttcacaccataaattgtataacatgaaaaattataggaaatccttgtagaaggaggtgaaatataaatgggaataattataaaaatcctgatttcggcaatagcgttaattggtgttagcatttttactccgggtttttccgtaaagggcggcgtaattggggctgtggtagctgccttagtaatatctttcttaaactatttggccgaaaaaataataggagagaaaggaaagggctttaccggttttgtggtggcggttttaattcttctccttgcccggtatatagttccccagtacctgcaggttactttaccgggagcgattatagcggcaataatcattggtttggtggatcgctttattccaacgaccctgaggtgaatcataatttttcggagggcttcatatattttttttacaaaaataaaaccggggagtagcgaaaaaatggaataccgggcaaaagcacaacggggaactgctgtaagtttatttttactaatttacgctcttttgttggggataaccgctaccgttgtgcctcctgaaacttccgggttagtatttgaggggataaaaaatagtgcgcttatagaagtattaaaagaaaacctctgggaagaaaaccctcggggatatttgcaaaaaactttgggttttaagcagaaaaacgatgaagaaggaaatttaagtcaggagtatgccctctggcttttaaccggcgccagagttaacgatccgtactctcttatgctggcggggtatccggttttaaatggtggggaagagaagttcggtgacatcgatgagggagaagatttgccggctttgccgggagagccgttggtagggattttttgtacccatgccggtgagagttatgaaggggatggtggacgggagagggctcccaaaggggagaaaggagaggttttagatgtcgcccgggagctttcccaaaagcttgaggaaaaaggaataaaaacaattttaattgaaaaggttcatgataccgattacaatcgttcctacagcgaagccaaaaagactgttcttgatttgttagcaatcaagagcttaaaacttcttgtagatgttcaccgggactccgaggcttctcccaggtaccgtacggtaaacgtcatgggtgaagagttagcaccgattatctttgtaattggtaaaggagaacgtttaccccagccccattggcaggaaaacgagctggtgaccaaaaaaattattgccgaaaccgaaactatctatcccggcctaatccggggaataaggtataagtccggaagatttaatcagcatttatccagtcacctggttttggtggaaatcggcaatgtaagtaactctttggtccaggccaaaaaatcggccgaccttctggccgaaggtattgctcgttatttactgcgttaaagccagtttttctggctttattttttttcctttacaaattaaaaaaaagtgatatattttttaaaggatttaaatttaaagggaagggctattggggttatgagtaccagaaaaaacgttgctaaagctgcagggataatcctagctttgggaattgtttcgcggatcttgggttttgtacgggaacaattgctggcggtaaaatttggggctacagggataagtgatgcttatgtagcggcttttaccataccggatttcctttacaatttactggtgggaggagcgctaagtgccgcctttattccggttttttcttcgtatttagctaagaatgaagaggaagaagcctggaaaatggccagcacggtcataaatttagtaataataattatgcttttttgtattggccttggttttttatttacaccggaactggtaaaacttgtagcacacaaatttaccggagaaagactaagcactaccattgaacttacccggataatgctaccgtcggttttatttacgggattaaacgggtttttaatgggaatgttgaattcctaccagcatttttttactccggccctgggcagtgtaatatataacatagtgataattctttttggctatttcttagccggcaagctgggaattacctcctttgctctcggggttgtggccgggatggttttaaatttcatggtacagcttccaagcttagcccggtacgggttaaaatatcggcctattatcgatatccaccatcccggagtagtaaaaatggctcaattgatgattcctaccctgttgggattggcggtaagccagattaacctaatcgttaaccaaaatcttgcttcgggattgtcggaaggaagcattatggcgctgaggcttgccaatcgtttgatgtatcttcctctggggttatttgcttctgcaataagcatggctatttttccaactatgaccggctttgctgcccggggagaaatggataattttaaaaaaagcgtagctatggggataaaatcaatatggtttattatcctgccagctcaggtgggtctgatggttttaagcgtgccgattgtgcggcttttatttgagatgggagagtttaccccggcaatgaccagggcgacggcctgggcgctggtcttttactgcgttggactttttgcccactcagctttgcaggtggttttacggggattttattccctgcacgacacgattacgccggttactaccagccttttaaccatctttttaaactatctattaaacgtggcctttatccgctacctgggtcatggagggcttgctttaggcttttcgttaacgggcatatttaactttgctgttttgctgtggcttttccgccgcaaagttggctcaatttacgggaaagacattttaatttccggagttaaatcgcttttggcttcgttattaatgggagtaacggcctatttaattgccggtgagctatccggatttgctgtaaccaaacacgggcaattaattcaagttggtgcggcaattgcaggggcagtagtagtatatgcggccactactttgcttttaaaaatggaagaagcgctgtttttcttaaatttaatccggaaaaaagtttagtggaggtttattatgcccaaacgccaggagttaatcaggaatttttgtattattgcccatatcgaccacggaaagtctaccttagcggacaggcttatagagtttaccggtgctttatcggagcgcgagttaaaagagcaggttttggatcagatggaattggagcgggaacggggtataaccattaaagctcaagccgtaaaacttacctataaagccaaggatgggaatacctattacctgaaccttattgatacgccgggccatgtggattttacttatgaagtatcccgcagcttagccgcttgcgaaggggcccttttggtggtggatgcttcgcaaggaatagaagcccagaccctggctaacgtttacctggccatggagcacgatttagagctcattcctgtggtaaataagatagatttgcctaatgccgagccggaaagggtcttaaaggagatagaagacgttattggccttgacaccagtgaggccattttagcttcagccaagaccggtcaggggatagaggaagtattagaagctattgtgaaaaggatcccaccccccagaggggatgaggaaaagcccttaaaagcattaatcttcgactcccattacgacccttacaaaggagttatagcttatattcgtttggttgatggctttataaagccgggaatgaaaataaaaatgatgagcaatgataaggagtttgaagttaccgaggtgggcatttttaagccttaccttaccccggtggaggggctctgggccggggaagtgggatttattgctgcggggataaaaaacgtgcgcgactgccgggtaggagataccattaccagtgctgaaaacccggctaaagaaccgcttcccggttataagcaggtcaaaccgatggttttctgtggcctgtatccggtagaatccaatcagtacgaggacttaagggatgctttggaaaagctaaaattaaacgatgcttcgctaacttttgaaccggaaacgtcggtggccctgggttttggttttaggtgcggctttttggggcttttacacatggaaataattcaggagcgtttagagcgggagtacggcttaaaccttattactaccgctcccaacgttgtttaccgggtggtgcaaactaacggcgaagttctggagattgataatccggcaaaattgcctccggcggggaagattgaccacattgaagagccgtatgtgaaagcaaccatcatggttcccaaggaatttgtgggaaatatcatggatttgtgcattgaacgccggggtgtctttataaatatggaatacctttcggaaaaccgggtgatgctcacttacgatttgcccctggcggaaattatttatgacttttttgaccagttaaaatcccgttctaaaggttatgcctctctggattatgaatttatcggctatcgccccggggatctggtaaagatggatattttaattgccggagagccggtggatgcgctttccatcattgttcatgaggataaagcttactaccgggggcgacagttggttgaaaaactgcgggagttgattccccgccacctttttgaaattcctatccaggcggcaattggctcgcgggtaattgcccgggagacggtcaaggctttaagaaaagatgttttggctaaatgttacggtggcgatgttacccggaagaaaaagcttttggaaaagcagaaagaaggtaaaaagcgaatgaaacaaattggcagggtggaaattccccaggaagcttttatggcggtgttgaaaattgataataacaaataaagctcaggccctttacctgcatatgcctttttgtcttaagaagtgccattactgtgcttttacctcttttcccgcgccggcgggtgaaggggtattttcgtatttaagcttaataaagaaagaattggaatggcgaaaagattttttagcgcctcttaagaccatttatgtgggcgggggaacgccaacttccctttcgctgaacgctttagaaaaactgggggaaattatctcgccgtatatttccgataagcttttggagtttaccgttgaagccaatccgggaacgttaaatagggaaaaaattcgccttttaaaagatttaggagtcaatcgtgtaagccttggggcccaatcttttaatgatgagattcttttaaaaatgggtagagcccatactgctgctcaaacgttggaagcgtacaatttattgagggaagagggcataaacaatttaaacctggacttaattatcggttatcccgaggggcgcgaaagctttataaacactgtaaaaacggccataagcttaaagccggaacatatttctttatacgatttaaaggtagaagaaaatacccgcctttatgaagaagtagcaaagggtgaaataatacttccggaagaggatgaagtagttttatattgggaggaagcgattaatcttttagaggaaaacggttacgaacggtacgaaattgctaactttgctcgaaaccagcagtattcccgtcacaaccttacttactgggaaaataaaccttatcttggcattggcctagctgcccatagcaaggtaggcctgtaccggttctggaatccgaatacgatgctggagtaccgggaaatgcttttaacaggaaaaaattatggcgaggaaaaattaactttagaagaagatgccaaagaagaaataattttaagattaaggttaaaaaccgggctaaatcttcaggagtttcaaaaaaaataccggcgggactttatggcagagtttggcgataaaatccaaaaatttatcgaacttggcctgcttttccttgaagatgataggctttttttaacccgcaaggggagttttgtagccaacactgtattaattgagtttatctaaacttgacaaaaaatgcttgacagtgctatttttaatttgaagttagcactcaacaaaagagagtgctaacaaaaaggggtgaagcggtatgattgatgagcggaaaagaaaaattttaatggcaatagttcaggactacatctctaccgctgaaccggtaggctcaagaactattgccaaaaaatacgacctgggtattagcccggcaaccatcaggaatgaaatggcagatttagaagaaatgggctatttagagcagccccataccagtgccgggagaattccttcggttttgggctaccgctattacgtcgactaccttatggaaaaaccctctttgagccgtgaagaagaagaatttatccggaaagtttatgaagataaaatcaacagtattggcgatttgctggaaaaaacgggcaaagttttgtccagtcttacccgttataccgccgttgtgctttctccggaggcaggaaaagtaccgttaaaacacctgcagttagtgcttttacagccggggaaggtattgttaattatagtattagaagatgggaccttacaccatcgggcttttgaagtgcccggggatattactgctcaggatttagaaaaagtttcagcaattttaaatgctaaactttacggagtaaatcccgaaaagattcgttattcgcttattaaagaaatatactacgaattagcccagcaccagaatttaattaatattactttagaattaatcagtaatttaaaccaagataatcaggagcataagataatcttgggcggactaattaacctttttaaccagccggagtttaaaaatgtggaaaaggtaaaaaccttattaagcatattggaacaggaagagaaaataagggaaatcttttcccagttaaatgttggggttaacgtgaaaatcgggagcgagttaaatttaaaagaaattgaagactgcagcatgattgctgccggctacttttcctacggaaatagcgtgggctttataggagttttaggacctacgcgtatggaatacgctaaaaccgtggcgacggtggagtttttaagtaagtacttgtcggaaattattggtaataaaaacttttaacaggaggatttaaggttgaaaaaagaaaaccaaacccaggaaattgaagaacgctatcaggcccttttttccaatgcagcagcggtaaaagccttaacccaggtggtggccaatagcttgggacccaagggcctggatgcgatgttggtggatagatttggggaagtggtggttaccaacgacggagtaacgattttgactttaatggatgcccagcatccggcagcccgaatggtcgttaatatggcccgggctcaggagagggaagtgggggatggtactactacggctgcagttttagccggagcgctggtttctgaaggagtaaaccagattttaaaaggggttccggtttccaaagttttagcgggaatgaaccgggcgttaaatcacgctcttttcctcataagaaaaaatgcgattaaggtaggaagtattaccgacgacaggctattggcggcggccaaaattgccggacggggtgatgaaagggttgctgctatcctgcgggatgcggcagcaatgttagaagataaacttcaagatcccgggtttaaattagccgatttggtcttggcaaaagttggggccgatactacgcttattccgggagtggttattaataagtcgcccttatgggaggaaggatcgcaaaaacttcaggaagttcgccttttggttctcgatgatggtctttaccccgaagaagtagaagaagaagcccttgcttccgaagccggatttgagcagtatttaaaaaaccagaaaatatttcaggaaaatctcaaaaaactaaaagaattaggggtcaagctaatcttattgacccggggaatcagcgatattgccgaagagttttgttacgaaaatgaaataatggttataacccgcattacccagaaagaattaaaaagggttttagagtttaccggagcccgggcggccaaaagaacttctttaaataagccggtagaagagttgcagaaaatgctgggttatgcccgaacctgcttttatgattcccggctggattttaccattattgaaggaggcgccggaaaagctaccgccacggttttaattggagcggctaccgatgaggtggtggatgaacaggaaagaattgctaaagatgcggccggaagttttgccgccgcttaccgctccggggttttgcccggagggggagctttcttcctctacttaagccgggaagtggaaagcttgaaaaatcgcttgcccggtatggaaagctacggtgttatggctttttcggaagctcttaaagttccctttcgggtgatggcggagaatgccggttttaacgggctggaaaagttgggggacttaatgaccctgcaggtccaaaaaaataactacgctttgggattagattttgaaaccggtgagtttatcgatatgatagccggcggagtggttgatcctgctgaagtggtttaccaggcagtaaaaaatgccagcgaggtagctatttcgttattgaaaattaataccataattaaaatgaaagattacgaagttttaaaggaaggggagcaggaagatggaggaaaaagataaagaggaaaaagtaaccggagaaaatttggaaccggaagataaaaatttggaacaggaagataaagaggaggttgtcgggccccaggaggaacaacaaattgatgaggccaaaaattgggaagaagaatacaataagcttttggatgaacataaccgcttaaaaaatcagtatttaaggctatatgccgatttcgataattaccggaaaagaacccagagagaaaaagaggagcttttaaagtacgagggaatggagtttctaaaaaagctcctgccggtgcttgataattttgaaagggctttaaaggaaaaagacactgatccgcaaaaagtgattgaaggagttgagcttacgcaccggcagttactggaaatattaaaccagcatgaagtaaaagctatagaagctcaaggtcagccgtttaatcccgaactccacgaagctttaatggtggaggtacgggaggatttagaagaaaataccgtaattgaggagctggtaaaagggtatttttataaagataaggttttaagacctgctttggtaaaagtttcgaaaaaacaataacttaaagggggtagagataatgggtagaattgttggtattgaccttggaactacaaactcctgtattgcggtaatggaaggtggagaagtaatcgttattcccaatgctgaaggtggtcgcaccactccttcggtggtggcttttggcaaaaacggggagcggattgttggtcaggtagctaaacgccaggctattaccaatccggaacgcacggtaatttccattaagcggcatatggggaccaattaccgggtaaaaattgacgataaagaatatactccccaggaaatttccgcaatgattttgcaaaagttaaagcaggatgcggaggcttacctgggcgagaaaatcgagaaagccgtaataaccgtaccggcttactttaccgatgctcagcggcaagctactaaagatgccggaagaattgccggccttgaggtgctaagaatcattaacgagcctacggcagccgctttggcttacggccttgataaagaaggggaacaaactatcttagtttacgacctgggcggtggaacctttgacgtttccattttggaaattggtgatggcgtatttgaagttaaagccactgccggtaacaaccgcctcggtggggatgattttgaccagcgaattatcgattggctggtggaaaactttaaaaaagaacacggcattgatttaagaaacgataaaatggccatgcagcggctaaaagaagcggcggagaaagccaaaattgaattatcgggggtactggaaacccagattaatcttccgtttatcgccgctaaccaaaacggaccgttgcatattgatgttaccttaacccgggccaaatttaacgaattaaccgctgacctggtggaagctaccatgggtcccacccggcaggctttagccgatgccggccttaagcccgaagatatcgataaaatcctgttggtgggaggatccacccggataccggcggttcaagaagcaatccgcaagttctttaacaaagagccccataaagggattaaccccgatgaatgcgtagccattggggcggcaattcaagcggcagtactggcgggagaagttaaagacgtagttctattggacgtaacgcccctttccctggggattgaaaccctgggtggagtgtttaccaagttaattgaaagaaacaccacgataccaacttcgaagagccagatttttactactgccgccgacaaccagacttcggtggaaattcacgtcctgcagggcgaacggccgatggctgccgataacgtctctttgggtagatttaccttaaccggtattccaccggctccccgcggagtaccgcaaattgaagtccgctttgatatcgacgtaaacggtattgtccacgtttccgccaaagatctgggtaccggtcgggagcaaagtattaccataaccaataccagcaatctgtcggaagcggagattaagcggatggtggaagaagcggaacggtacgcggaagaagaccggaaacggaaagaagaggtcgaaacccgcaatcaagcggatagcttgatttatcaggcagaaaaaaccttaaaagactttaaggataaagctaatcctgatttagtggcaagagttgagaaagccattgccgagttgcgggaggcaatgaacagtaaagatgtacagctaatgagagcgaaaatggaagagttaaccaagccgctttatgagttaacttccagcatttatcagcagtccgcaaatcaaaatcaaactcaaactggaactaatacccaaggcaacgtgtatgatgccgattacaaggtaaatgacgataaataattccccgcaaaaggcggtgaggtaattgaagcgggattattacgaaattttaggggtggcaagaaatgccacccctgaagaaataaagaaagcttatcgaaaacttgcgcgcaaatatcacccggacgtgaataaagacgacccaaacgctgccgaaaaatttaaggaaattaacgaagcttatgaagttttatccgatccggaaaaaagggcccgctatgaccaatttggccatgcgggagttgacgggaattttgccggccaaggaggttttggtggcggggccggcattaattttgaagatatttttagcggttttggcggttttggcgacttatttgacatggtttttgggagcggcagaaaagcccggcagggtccggtacccggtgacgatatagaggccgttttagagctaactttagaagaagcggtctttgggggagaaaaagaattaagagttaccagaaccgagacctgcggtcactgccacggtaacggggccgaaccgggaacaccaatcatcacctgtcccacctgtcagggacgggggcagatccaccaggaagttaagaccctctttggtcgcatggtaagaagtcaggtctgctctacctgccggggtgaagggaagataccgaaaaccccttgtcgggaatgcggtgggagtggcttggtgcggaagacccggtcgataacggtaaaaattcctcccggcattgaccatggccataggcttagaattgccggagggggtgaagcgggtcgctttggtgggcctccaggagacctttatgtttatattaaaattaaaccgcacaagctgtttaagcgggaagatatccatttaaaattagagaaggaaatttcctttgttcaggcggcattgggagcaaaagtagaaataccaaccatcgatgggggtacggaaattttagaaattcccgaaggaacccagacgggtaccgtatttaccattaaaggaaaaggtgtaccggtggtaaatggctccggacggggaaatctttacgtaacggtcaaagtagttacccccaccaaacttacggaacggcaaaagcagcttttacgggagtttgaggagatatccaagcaaaaagaggaaacctttaaagaaaaatttaataagtttaaaaacaaatttgcgttataattaaataaaaaagacgggtgaggcctgtgaaatatcttgaaattgcggtggaagtggaaagctgtttcactgaaacggtagctgatattttttgggaatttaataccgggggggtaagtattgaagacccccttttgctttggcagtatataaacgctcagatctgggatgcttatgaatttcccgacagtgtcttaaaagcggaaagggcaacggtacgggcttattttcccttaacggaaaatattaacactctgttaagccagatcaatgaaaggcttaaatctctgggtattcctttcaacctttattttcaggaagttgacgaggaaagctgggcaaatagctggaaaaaatattttaaacccgttgaagtaggggagtttttaataaaacctacctgggaaaagctaccttcgggcaaagaagataaaaagataatagaaattgacccggggatggctttcggaacaggaacccacgttaccaccgcattggttttagaggccttaccgaaatacgttagcccgggcaaagtagtggtggatgttggtaccggttcaggaatattggcgatagcttccgctttgctgggagccgagaagatttatgccttggatatagatccggtagcagtaaaagttgcccgggaaaatatttctataaaccgcctggaagataagattacggtgatagaaaatgaccttttacatggttttaaccagaccgttgacgttatcatcgctaatattattgcggcagtaattaaagagttagctttggatgcctacgaaaaattagccaccggtggaatttttattggttcgggaattattgtagaaagagaaaaggaagttatggataaacttttggaagttggttttaaaattattgaaagaaaaaacagtggtggttggtgccttctggttgccagaaaggagtagggtgtaaatgccgtacttttttctaccccctgggcagacccagggggattatgcttatcttaccggtgacgatgctaaacatgtagccaaggttttaagaataaagcccggggaaaaactaacattacaggacgaccaggagtttcgctacttatgccaggtaatagcggtaagaaaagatttagttcaattaaagattttggagaaaaaaaaggttgtaaccagacctccggtcaatgtaactttggtgcagggggtaccgaagggcgataaaatggattttatcgtgcagaaggctacggaactgggggtttaccggataattccggtggaaaccatcaggacggtagtggtttttgatgaacgcaagaaaaaggatcgatgcgaacgctggcagaaaattgcttatgaagcggctaagcaggcgggagtcagccgggttccggaaatttttccggtaatagatttaaaggccctgccggaatttatttccgatgctttaatcttggtaccctacgaaggcgaggagcaaacttctttaaagcaacttttaaataaagaggcggtaaaaaacgttacggtaataataggccccgaaggggggtttgaccccggagagattgagtatttaaaaagttttggggcggtcactgttagcttggggccaagaattttacgtacggaaacggcagctctggccgttctttccatggttttatatcagtggggtgaccttggaggagaattaaggtgaaaaaagtagctttttatacgttaggttgtaaagtaaatcagtacgaaaccgaagcgctaaaaggagcttttttagagaaagggtatgaaatagttgactttagcgattatgctgatatttacgttataaacacctgtactgttacccatttaagtgaccgtaaatcccggcagatgatcagaaaagcggtgcaaaaaaatccccgggcggtggtggcggcggtgggctgttatgctcaggttgctcccgaggaaattttaaaaattcccgaggtaaatcttgttttggggaccgttcataaaaaccgcctggtggagttagtggaaaaagtactaagggaacggacaaaaataaatgcggtggccagttttgaagagctcttggaatttgaagaaatgcctttaaagctcgcaccgggtaaggcccgggcttttgttaagattcaggaagggtgtaatagctattgcgcctactgtattattccctatgcccggggaccccttagaagccgtcccttagaggatgtggtagcggaagtaaaaaaactctgtcagagcggcttttcagaaattgtgcttacgggaatccatacgggagcttacggccaggaaaaacaggacttgcccaaacttgccgatttggtggccgagttatttaaaattcccgaactaaaaaggcttcgtttgagctccattgaaccgcaggattttaccgtggaactactggatgttctggcaaatagtcctaaattctgccgtcatctccacctacccctgcaaagtggtgatgacgatattttaaaggcgatgcgcaggaaatatacttcttatgagtacttaaggttaattgaaactatccgggaacggattcctgatattgctttaacttctgatgttatcgttggttttccgggagaaaccgaggagcagttcttaaacacttacaatttagtaaaaaaggttggttttatggatattcacgtttttaaatactcaccccgggcgggtacgccggcggcgaaaatgcccggtcagataccggaacgggaaaaggagcggcgaagccttttacttttaaatttaaaagaggaactttttaaaaattatgcttctaaatttctcggtaaaattttagaggttattcccgaggaacaggatacggaaggcttttgggaaggacatagcgataattatttaagagtcaagttttcgggcaataatataaagcggggagaaatttatccggttaaaattaccgagatgaaagagggctatgttagcggagaattggtaaatagctaaaatttttcttgccagcaggaattttatagtgtattgtagaattatctccttttgtaaggattgaattgtacctttctcccgaggggaggtgaaggtatgagtgactgtctcttctgcaagattgcccggaaagaaatttcctcggctattgtttatgaagatgagttagtggtggcttttcgtgacatcaatccggtagcaccggtgcatatattgattgttcctaaggtacatgtggaaaatatagcggacttaggagaagaacaccgggagcttgctggacatttgctactaaaagccagggaaattgctgaaaaagaagggattagtgaatctgggtatcgtctggtcagcaactgcagaaaagacggcggtcaagagatttaccacctccatttccacttaattggcggtagaccgttaggtaaatttgcctaattaaggcggtaaagggggtggggaggagggagggatagaaagtggcagaagttagagttggcaaaaatgaaagtttagatagcgctttaagacgttttaaaagatcttgccaaaaagccggtttaatggctgagatgcgcaaaagagaacattacgaaaaacccagcgtgagaaggaagaaaaaagctcaagccaggaataagaaaaagcgttatgcttaaggtgatcttatgttgaaccgcattgaacaggatttaaaagagagtttaaaacaaagggaagcgggcaagatacggcttaatgttttaagaatggtaaaagcggcaattaaaaatgctgaaattgaaaaaggaagaagccttaccgatgatgagattattggagtcatccaaaaggaaattaaggcccgcaaagaagtcctacccagttatgaaaaagccggacggaccgaagaagttgctaaaattcaggaagaaataaaaattcttgaaagctaccttccagcccagttaagcgaaacggagttagaggaaataattaaagtgacgatgggagaagtcggggcttctaaaccttcggatatggggaaattaatgccggcggtacttgccaaggtaaagggacgggctgacggtaaggtagttgcggagttagcgaaaaagcttttggccaactaacatgaaaacccttcctgctgcatattgatttagcagggagggtttttttatgcctaaaaaatggacaatatccccgggagaaatttttgccgatttacccagggtggtttttctgggtaatgagatggtaattgtggaaggacataaaggaatccaatcttattccccggagataataaaaattatcaggtttaatgaaaaaataaccatcgaaggtaagaatttagaaatttttttaataacctccgaagaactgcaaattaccgggcaagttgaacgggtacacttcgagagggggtaaacttcttgctgaaatggttgtttggtgaaattcattttaaatttcagggcagtgaggttgaacgttttttaaatttggcctttagccggcaggttgatttaagggaagtaaaatataccagagatggcctgacctttaaaaccagtttaaaaaattttcgtcaggtgaaaaccatagggaaaaaggtgggaggaaaaacaaaagttattgctaaagagggagcttggttttggtggaagaaagttctaaaaaggccagggattattgccgggctttttttacttttagggataatttattctcttaccggttttatctggtttattgaaattgatggtttttccggtagacaaagagaaattttagatattttaaaagcccggaaggttaaaccgtttgtcaggaaaaaagcagttgatgaaaaaatgctaaaaagggaaatcttggcccaaatgcccgagatctcctgggtggggattgaaaaaaagggagttaggcttatcattactggtaaaatgcggcaggagtaccggcagaaatacaaaaaggcggacattgtggccaaaagggatggaattattaaagagatactggtgtttcgggggagcttaagggttaaaccggggcagaaagttaccgcgggggaggtacttatttccggggttgatgaacggggaaagaccattgtggctgaaggaacggtaaaggcggttacctggtataaaaaaaaggtgcaggtacccttaagagaagaacgcttagttcccaccggacaagagagtagtttagttaagctttttttcgggaaaaaagaaataacgttaaaaaagcccccaaaaagctttgcgctggctatcatggtggaaaagcgttataaactttcattaggtaggaaattcgccgttcctatcgaactttataaagtgacttacaaagaagttaaaagaaaggttagaaagctaacccttgaggaaggagcgcaaaaggcgtataatttagcattagaagaacttaaaaaagaagtagatatgaagcagataacctatatggacaaaagtgttcggagtttgggggatgcagtggaagtagtggtgaaagctcaggcgttagaagatatcggtcaaatcttagggatacaggaggattagccttggctaaaaaagaacaacggatggtagtagcagataaagagttttttcgggctttgtttggcaagtacgatgaaaacttaaagcttattgaagagcttttgcccgttaccattaatttaagagaaggagaaattttaatagccggggaagaagacgcggtaaataaagcagtggggttagtcgaagatctttataattattatcttgccggaaatcccatcaccacccgggaaattcgttatgctttttccgcagaaaaaagaggtgttttggggcttttaggggatgaaacggtttatataactcctcggggtaaaaaaattaaacccaaaagcttaagacagaaaatgtatttagaagccattaaaaagtatgatatagtctttgccattggaccggcaggtacggggaaaacttacctggcggtggtaatggcagtcttggctttaaagcaaaaagaagttgcccggataattttaaccagaccggcggttgaggcgggggaaaagttggggtttttgccgggggatttacaggaaaaagttaatccttatttacggccactttacgatagtttgtacgatattttggggttggagactacccagaaatacctcgaaaaacaaataattgaagtggcgcctttagcgtatatgcgggggcgcaccctggatgatgcatttattatcttagatgaagcccaaaatacgacaccggagcaaatgaaaatgtttttaactcgtttgggctttggctcaaaagcggtaataaccggggacaccacccaggtagatttaccccgcggacaggaatccggtctggtggaggcggaacagatcttaaagccaattaagggtataaacttttcttattttacccgggaagacgtagtaaggcatcccttagtccaggaaattattgagcagtacgaaaaagcccggcagatcaaggacagggagggaacgggtcattcttaaacttaaagcaaagcaaataatggaaaggttaaaaaacaaccaaaaactcctccggggattggtgttttttggtttttttgtagcctttctcctcttaatgttcctggaatttatcccgcatcgggtaaatctccaggtgggtcaggtagcaccggaaactattaaggctccgcgaagtatagtttttgaagacaaggccaaaaccgaagaagcgcgggagaaggcccggagccaggtaccaaaggtttatctaattaatcccgaaaccaatgcggctattttaggggaagtaaataacttttttttaaatatagaaaaaatcttaaagcaaaacttgcctccaaagcaaaaggaaaagcagattattaacgaattacccttttccttgcctgcaggggtggcttacgatttggccagaataaaccttgaacgctggaaagcaacccaacgggcggcaacggaaattttgggtgaactgttaaaaaaggagattacgccagaaaattttacggaaattaaaggaacccttaccgagaaggttaaccgttataacttaagttacccggaaaaagaggttttaattttaagtttaaattattttttaagacccaatgcggtatatgatccggaagccacggaaaaacttcgagaccgtgctgcccaggcggtacccaaagtgtgggtttcaattaagcaaaatcagaaaattatcggagaaggggaaattgttactcccgagcatttagccaaattggaagctctggggttacttaaaccaagaccttcatttcgcaatttaattggagcggtatttcttgtattttttaccatgttaactcctcttttttacctgtacttacagcgacgggaaatttttgaaaatttaaacttactgattttattggggataatttccttttttatcttagcattagctaaaagtattttagcaatcaatgtgggagcttttccggaaatgaccccgctggtgggctatgctgtacctttaggtgcagcaacgatgttaattgccattttaattgactttaatctgtcccttttgatgacggcgcttttagctttattaattggttttggtaccgaacttagccttaagctatccatagtatcttttttttctggacttgccggaggttttggggtttctcatttaagccagcgcaaggatttagcccgggctggagtaaatataggtattgtagctttagtagcaattcttgctttggaacttatagataagacgcctataggtacggcttttttagctgcattgatttttggtccaataaatgggattttagctgccatttttaccaacggctttttaccctatttagaaacgacttttaaaattacttcagcggtaactttattggaattagcaactccttcccatccccttttaaaaaagcttttaatggaagcaccgggaacgtaccatcacagtcttttggtggggaatttagcggaagcggcggcggataaagtaaatgccaatagcttactggcccgggtgggggcctattaccatgacataggtaaattaaaacgaccgtacttttttgtggaaaatcaatttggtagcggtaacccccacgaaaaacttaatcccaatttaagtaccttaattgttacctcccatgtgaaggatggggtggagctggcccgggagtataaattaccccaaatcgttatcgatattatcgagcagcaccatggaaccagcatcataaagttttttttccaaaaggctattgatatcaacggaccggaggtaaatgccgaggattttcgctatcccggtcccaagcccaaaaccaaagaagcagctttagtaatgctggccgattcggtagaagcggcggtgcgttcgttaaaatctcctactcccggtcgtatagagggattggtccgaaaagtaattaaggacaagcttttagatggacagctggatgagtcaaacctaacttttcaggatttgcataacattgctcaagcctttgataaagtattatcgggaattttccataaccgggtggaatatccggatataaacgtggaagctctcagaaaggagaaaaaatcttgacggaaattaccaatcttcaggataaagtggacgtggatgagactttgttaaatataattacccaggctgtgagtttaacattaaacgaggaaggacgcgcaggggtagtaagcattgcgctggtggataacaattacattcagtctttaaaccgggaataccgccaaaaggatgttccaacggatgttttatcttttcccctggcagatgataaagatgatgaagtcttaggggatgtggtgatatctttagaaaaggccgcggaacaagcaaaagaatacggtcatagtttttttagggaagtggcgtttttaacggtgcatggggttttacatttacttgggcatgaccattatgaagaagaagaaacccgtattatgcgggaaaaagaagaaaaaattttaagtgctctgggattggagcgttaatatgcggcgaagcttgaaagaaagctttagctatgctttttggggcttaatttacagtttacgcacccagagaaacatgaaaattcactttttagcgggtattggagttttaaccctttctttatttttgccttttaacggctatgactatttatttgtcttttttgccgtagctctggtgataataacggaaatgattaatacggctatagaagcgaccgtagatttatttaccaaagattatcaccggcttgcaaaaatcgctaaagacgtagcagcaggagcggtgcttctggcagcgataaacagtatcggggtcttttttttggtgattataccaaaaatcaagggtttttcttatttaaacttctatcgtattaggctttatccccttcacattttacttttgctaatagggcttttatttctcctttatactttcataagctatggcaggtcgcgaggagggaagggacatttttaagaaactgggtaactattttttaaccggtcttgcggtaattacgcctgcagccataaccatttatattttatttgctttgttttccttttttgaccgaccccttcggggattttttgcccaaatttttggtattgatattccaggccttggggtgttaacagtagctctgctggtaccaatagttgggatgttggctacgaattttataggaagaaaaatcctgaaaaaatttgagcagttattcataaagataccggttacccgttccctttataagacttctaagcaattaattgaaacttttttacatccggaaagggatgcatttaaaagcgtggtgttagcaaggtatcccaaggacggttcttacgctctgggatttatcaccggttcggggtttgacgaaataaacgaaaaaacccgggaaaagctcttaccggtctttttacctacaacccccaatccaacttcgggctggcttttatatttacctgaaaaggatataatacccttaaatctttcggtagaagatgcgctaaaaattattgtatccggtgggatagtccaaccagaaaggggggaagaaaaagatgagttataaatcgggctttgtttccatcgttggccgacccaatgttggaaaatccactcttttaaaccaagtggtggggacgaaaattgcaataatgtccgataaaccccagactacccggaataaaatccgggcagtattgacttcggaaaaaggccagattatttttatcgatactcccggcgtacaaaaacccagaaataaacttggggagtttatgttaaagcaggctttaaccagtttggacgaagtagatgttcttttatacgtggtcgaagccaattcaccgataggtccgcaggaaaattatctcttaaagactttagctgaagtaaaaactccgataatcttagtggtaaataaaattgatgtggtaaagatgattgaggcccaaactcttgccaggcaaattgaaagcagattaaaggttgccaaaacttattacatatcggccttaaacggaacgggagtttcggaactggtggagggaatttttgaattattacccgaggggccgccgtattatccggaagggcaggttaccgattatccggaacgatttatcattgcggagtacattcgggagcaaatactgcatttgacccgggaagaaattccgcactcggtggcagtcgtggtggaggaaataaaaccccgggaaaacagcaataccgtttatgtttccgcagtaatttacgtggaaagggagagtcaaaaaggaatcatcattggcaaaaatgggcaaatgttaaaagagattgggcaaagggctcgactggaaattgagcggctactgggtagtaatatttaccttgatttatgggtaaaggtaaaggaagactggcggaacaaagatgtctggattcgcaattttggttttacggagtttgaataaccctttgcaatagagcgggcttaggcccgctttatttgtgccggtgaggtgtgatactataaaaattttttatagtgggcctgttataaaacaaaaacgtgaaatatggaacaatcttgaattccgatgaatactgaattctaacatacccaaaggaggtagtgacctttataaaaccgttgtttgacccggcaattgtgaaatttgtaacatttagaatatattgaaaatttaaatttatatggtaaactaatagtcaagaggtcagaccatcatacggccgtatgattaggttattgacaaatttttttcaggaggggtatttggtgacctggacgcaaaactacgacccgtttaacaacattgcactgtcggctttggtggcagcgattccgatttttttcctgttctgggcgctggccatcaaaaagatgaaaggttatattgcgggccttttaacgttgcttttggccattattgtggtgattttcgagtacaagatgcccgtaaatcttgctttaatggctgcggtaaacggcgcattatatggtcttttccctattggctggattgttattactgcagtttacctctataaccttaccgtaaaagcgggacagtttgaaattattaaggattccattgcttctattaccgaagaccggaggcttcaagctctgttgattgcttttgcctttggagcgtttttagagggggccgctggctttggtaccccggtggcgattacggcagcaatgctcgttggtcttggttttaaccccttgtatgctgcaggaatttgcttgattgccaacactgctcccgttgcttttggaggaataggtatccccattattgtggccggacaggtaacgggaattgatgctatggcgattagtaaaatggtaggccgtcagttgccgcttttatcggtagccattcctgcctggttggtctttatcatgtccgggtggaagggtcttcttgaggtcttaccagcagtgttggttaccggtatttcctttgccggtgctcagtggttttctgcaaactacctttcgccgatgctcccagacataatctcttcccttgtttcaattatcgctttggtcttattcttaaaggtttggaagccgaaaaatatctggcgatttgccaatgaacctccggcaacattacaggtgaagaagcattccgcaggggctattttaaaagcctggtcgccgtttattgtattaacgattttggtgggcgactgggggttaaatcaggtaaaaaatgtgttagaccttgttacccttaagtttcatgttcccggccttgatggtttaatttataagcccggtgcggacaaagccatggaagcagtctttaaatttaactggttgtcagcagccgggacggcaatccttattgctgcaataattacgattttaattttacgaattagctttaaagatgcggtttcggtatttgttgatactcttaaaagcttaaaatatccgctaattaacatcgcagcggtattgggttttgcttatgtcgctaacttctcgggtatgagccaaacgctgggtttatcgctaaccgttacaggaaaagcgtttgcctttctttcaccaatgcttggttggctcggggtatttataaccggttcggatacatcggctaatgctcttttcgctaaattgcaggctgcttcagcggaaaagctgggtattgatccggtcttaactgttgcagctaactcttccggtggagttaccggtaagatgatttcaccgcaaagcattgcggtagctaccgcttcggtgggcttggtgggcaaagaagcggagcttttccggtttaccgtgctgcacagcttcttatttgctgtggtggtaggcatcattacttatctccaggcgtactacctgaaaagctggattccggtttacaaaatgattgaaagtgctggagctgcagctcaagctcaggtagaaaccggtccaggacttaccattctcgggattaccgcagtggtaattttagccctttggggcttagttgcagcccttaataaaaaataaattaaaataaaactaagcggggggagctattccccccggatagttttgaggaggttttttaaagtggaagcactggcgaagctacaaaaaattcttggttccgggaagataaaaacgcaaccggaggagctttttgtttacggttatgacgctaccgcggggttaaaaaaccaaatgcctttagcggtggtatttcctgaaagcaccgaggaggtagtcgagattgttaaatgggccaacgaatataaaattcctctttatccgcggggttcagggacaaatttaagcggtggaactgtgccgacggcaaaaggggtagtggtagagttaaatcgtctcaataaaatcttagagattgacctggataaccttacggctaccgtggagccgggggtaatcatcaacgatttaaatgaagcggtgaaaccctacggcttgatttatccgccggacccgggaacggttactactgctactatgggcggttcggtggccgagtgttccggtgggcttcggggcctaaaatacggtgtaaccaagcattatatcatgggcgtcgaagcggtaattggtactggtgaactgttgaaatttggcggcaagaccgtgaaaaatgttaccggctatgatctgcctgcgttaatggtgggaagcgaaggtaccttagggattattacgaaaattatcgtaaaacttattcccgcaccggtagccaaaaaaagcttcttagctgtattcaacagtattgatgatgctgggaacgccattgctgaaattattaaaaaccgggttattcctgcaactttagaaattatggaccaaacaaccatccggacggtagaaaaatttaaaaacattggccttccggtagatgcccaggcgattttactggtggaaaccgatggttatcccgaacaggtggaaatggaagctaaaattattcggcaggtcctggaaaaaaatcggggagaagtatctgaagccaaaaatgatgaagagcgggaaaaactctgggaagcacggagggcggcattaccggctttagcccaggtaagtcccaccaccgttttggaagatgctacagttccccggagtcaagttccggctatgttaaagaggttaaaggaaattagtgaaaaatataatcttactattggtacttttggtcacgcaggtgatggaaatcttcatcctacaatcctaaccgacgaaactaaccgggaagaatggcagcgagtggaaaaagctgtagaagaaatctttaaagcggcgttagaacttggaggaacgctttccggggaacacggcattggcatggcgaaaaaccgttttctcctctgggaaatgggggaagcgggggttaatcttttaaaacgcttaaaacttgcttttgaccccaataatatcttaaaccccgggaaaatggcgtaggggggaaggtttgtgaccgagattaaacaggagtttttaaaatgtatgcgttgcggtaactgccaggcggtttgccccatatataaggaaacaaaaatggaagcggaagtggcccggggcaagattcagctcatcaaaggggttaccgaaggggtattaaaacctaccgaatacctggcggaaaaaattgctacctgccttacctgtcttgcctgccaggaaaactgccccagcggggttaattatgagaaaattctcttatatggcagggactatttggccaaagaaaatggcttaccgccggtgaaaaaagcaatctttaaagttttacgcaaaccccgactttttaattttggcctgaaaatggcttcccgttttcaggggcttgccctgaaaaaggttaaaggtcggccgggaaggaaactcaggtttgggctcctcgaagaccatgaaaaccggttgttacccgaattttccaaggaaactctggtggaaaaggccaggtctaaacaaacttctgggaaagaaaagcttttgtatttccccggctgtatgatcaataacgtttatgttaacgttggggaagcggtaattgctgttttgcagcacaacggagcccaggtggtagtaccggaaaagcaaagctgctgtgggactcccgcccgggtgcatggggatatagagtcggccaagagcttaggacgttatgtaattgacacctatcttgcgatggatgccgattacgttataaccagctgttctacctgcggggtaactttacgacagggatatgttgaactttttgccgatgagccggaataccttgaaaaagccaaaaagcttgcccaaaagacccgggacatcaatgaatatctggtggaaaaaggctttataagacctaaaaaactaaatttaaaagtaacttaccatgatccctgccatttaaaccggaagcttaaagtaaataaacaaccccgggaaatattaaaagtagttttaggggaaaattttagggaaatgaaaaagcctgctgtctgttgcggcggggccggttctttttccctgacccattacccactctcgaaagctatcggtaagaaaaaagcgttagatatcattgaaaccggcgcagaagtagtggcaacttcctgcccgggctgcatgctccagttaaatgatgctttagctaaagaaggttcgaatatcaaggtcttacatgtggcagaacttctggcggaaggatataaagaaaattaattcaccccttagaaggatttaacggaaaaagggagaaaatataaaggcaaaaattacttttgccggaggtttcgcatgaattttcagcagataaaaaccaaaaaaatttacgaagaaataatcgagcaaattaggttgctaattgcccggggtgaattaaagccaggggataaacttccgtcagaaagagaacttgccgaaagccttggggtcagtagagcttcggttagagaggcattaagtgcgttagaagtattaggggtattagaagtaagaccgggggagggtacttttgtccgggaagtggccgcggataagtcctttcattccctaactctgttgttactgttaggtacaactttggaagttttagaagtaagaaagattttagaatccggagcagtagtactggctacagaaagagctaccgatgaagatataaaacgcttagaagatgccgtagtaaaaatggaaaaagatttaaagcagggtgatttaggggatgaggctgattttatgtttcattacggattggctcttgctacccataattcccttttggtacgtcttatgaattccattgccgacaccatgcgccagtctttaaaaataaaccgtgagcggctttttagaactccgggcatgcctgaaattttttataagtaccacaaagaaattttagaggcgattaaagctcgcgataaaattagagcgcaaaaagttttagaggaacatttaacggtggctgaagaaaaattgttagaagagtaatggattgaaaatagtttgattttaaaaaagggaaaatataaaatctaaggtcagaccatcaggacataataccgaaggtggtgattggatgttaaaggaaaagtttattacggaacttactgcggtgggtggcgaggttatttgcggtaaaacctatgaacagttgattgacagtttggcgggagtactggccggtcttggtgttcggaaagtgatgtactatccccacccgcaagttaaaaggcttttagaaaagataagggaaaaagtggcggtagaacttcttactgaagattaccgtaaaccggaagaggttgaagtaggacttaccggtgcggatttaggtgtagccgagtccggttcgctggtgctggtagcggaggatccaaaacttcgaaaaatgactactttaccgccggtgcacattgcagttttggaggaaagccagattgtggaaaaatatgaagatgtatttgaacattatgctgggaagttaccgggatacttaaactttatcaccggaccttccagaacggccgatattgaaagggttttgaccatcggggttcatggaccgggccgacttatagtatttataaaagagggtgaggaataatggcgaataaagagaaaattaaaaaagcccttggtaatcctaccttacggcgtgctctaaccaattttggaaataattatgttttggctcgggaaaaagtttttgccggccttgattttgaggaactacgccgggagatcaaggcggccagaaccgaggttagaaaaaagcttgatttttacgtggaacaattcaggataaatgccgaaaaaaatggtgccagggtaataattgtccactcggccgctgaagcaaaaaaagcaatagttgatattttaaaggccaaaaacgccaaaacagtggtaaaatcaaaatccatggcatctgaagaaattcacctgaatgaagagcttgtaaaacacggcattgaagtagtggaaaccgacctcggggagtggattttacagcttgacgggcaaaagccctcccacatggtaatgccggcaatccaccttacccgtgaagaagtggctgctattttttccagggcactggaccgggaagtagctccggatattgcccaaatggttaagcttgcccgacaggaattaagggataagtttttaaaagccgatgtcgggattaccggtggaaatattgcggtggcagaaaccggttcgatttttctctttaccaatgaagggaatgcccggttaacaactaccttgcccagagtacggattagcttggtgggggttgaaaaaattgtaccaacgttaaaggatgccatcccaatcatgcgggctcttccccgaaacgctactgctcagaaaattaccagctacgtgaccgtgatgactgcgggagccggtcaggaacattatgtaattttaatggataatggacgcattgagctaaaagacgacccggtgttcgcagaacttttccagtgtatccgctgcgccggttgtttaaatgtgtgtcccgtctaccagcaagtagggggccatgtctttgggcatgtttataccggacctatcggtacccttttgaccgctttctttcacggattggatgcagccaaagaccctcaggccctctgcggcagttgccttagatgtgctaccgtttgccctgcgggcataaatttaccggaattgttgttaaaattacgtcaaagggttgttgaaagttatggacaaccgtttgtccaaaaatttatctttgaacgaattctggccaatcccaagcttttcaactctcttttagaccttggtcgaaaatttcaggggttaatcgcggaaaacggcgagattaaatctttaccctttggtttggataatcttacttctttcagggtgtttccagctcttgccaaggagcgactttataaaaaatatcgggtgcgtcccaagaaaaaaggtaccaggggcaaagtgctgttttacagcggttgcttaattgaacacatgtatcccgatattggtgaagatgttttcttggttttagagaaaaacggttatgaagtggttttaccggaagatctgggatgttgcggggctccagcatattactccggagacttacaggctgccgtgaggatggctaaaaacaacattgaggcgtttttaaagcacgagtatgattatatagtcactgcctgtcctacctgcagcgaaaccctaatgcattatgaaaaatatttagaggatgacgaagagtaccgggagaaagccagggaagtatcgaggaaggtaatcgattttaccgattttgcttataagtatttggcggtgggtgaaggaaaactggcggggagctatacccttcatgactcctgtcatgcccgccggggcctgggtcaggtaaaagagccccgggagctaattgttaaaaccggggcaaacctggtggagatggccaattccgaccagtgctgcggttttggcggttccttctccataaagtatccggaaatctccgaaaaagtgtttcagaataaataccaaagcatcatggaaaccggtgcagaaaaagtagcggttacctgtccggggtgtttaatgcaaattgccggcggcctgaaaaaacagggagctccggtaaaggtagagcacttagctaccatcctggctaaaacctttagggacggttctgaaaaccaccactttctacgatagatagaaagtggtggctggtagaaccgtcccttccggttacttttttgcttcttcccggagagcccgccgtaaaactttacctacggtagttttggggagttcggttctaaattccacgtactttggaactttgtacttggcgagtttttcctgacagtgtttaataatttcttcagaagtggcggtttcattttcttttaaaacaatgaaggctttgaccacctctccccggtactcatcgggaacacctattactaccgcttctttaaccttaggatgttcgtataaaacttcctccacttcccgcggataaatgttgtaaccgccggagattattaaatcttttttccgatccacaatataaagatagccatcttcatccatgcgacctaaatcgcctgttaaaagccagccttcttttaagaccagggcggtttcttctgggcgattccagtaacctttcataacctgaggaccttttacggcaacttcgcctacttcgccaatggctactggatttaatgtgtccggttcaactaccatacacagggtatcggaaaggggcagtcccaccgaaccgggcttttccagtgaatgaacaggattgcagtgggtaacgggagatgattcggtcaagccatatccttccacaatacggccgccggtaatttcttcaaactttttcttaacttccactggaagcggggctgagccggaaatacacagtctaattgaggtaatgtcataatcttttattctgggatggttgataatggcaacgtagatagttggggcacctgggaagagagtgggccggtattttactatggtttttagcatttcatcgacgttaaaacgaggcataataagcagggtggcgccggttaaaacggccaggtttaaagcaaccgataaaccgtaaacgtgaaagaaaggcattactgccagaatgatatcttggctgcttcttacgggatcccaggcatttacctgcatagcattggcaattaaattacggtgggtgagcattacccctttagaaatgccagttgttcctccggtatactggagtaccgctaaatcttcttcgggattaatggtaattttcgcaaggggctggggtggtgattttaaaagttcctggaaaccaaggataaatgattctttcgggatttcaatccaccgtttttctttttttactttgacaggatacaaaagttttaaaagaggtggcataaattctgaaagtcgggttaccactattttttctaacgaagttttagctttaatgtttaacaccctggggagaattaaatccagagttatcacaattttggagcctgagtcagtaagctggtggtgaagttcccgttcggtatacatgggattgttccagacaaccactgcgcctgcttttaaagcgccataaaaggctatcacggcctggggggaattgggtaaaatcaaggctacccggtctccctttttaattcccaggttttgcagattggcggcaaggttatcggtgagctcttttaacttttggtatttaattcttgcaccgaaaaagattgtggcgtcggtgtcgggaaattcgttggcagttttatctaacttttcacccaaagaaatagggggataatccaggtgatatttcacgttttttggataataaggccaggatgggggattatttaaatcaatcatgaaaaaccctccttaaaatgttttcttaagtttattatatttttgaattggattcaggcaataaaaaattttaaaaattcaaaaaattattgctaatagttttttaaataaacaatgatataattatgacagcatattgttcagaagagggatggatattgaaattttatttggatgaagggattgtgttaaagggtagtgacttcggtgatggccaccgaatgttgacaattataacgaaagagctgggaaaaattaaagcggtggcttacggtgcaaaaaaggtaaaaagcaaaaagcggggagcgttactggaattcagtcggaccaacatttatttgcggcaaagtaacgattattttatcgttgagcaagcggaaggcatagagtattttcccaatctttatggaaataaagatttgttacatgcggcggggcaaattgcgtggctgacggatcgcttttggcctctggggcaacttaaccctaaactatacaattgggttttatatagtttacggttactaaattcgggagtttggcccaaaattgtgttaagaaattttgaattaaaacttttggcttttaccggctttagacctataaccactcactgtgccgtttgccgcaaaccttaccggggtgaagtatggtattttggagctggggaaggaggaattgtctgtccttcctgtaggcccatagaggggatttattttgaaatatttccggaagtggtaaaagggatgaacgccttacttcttgcttcaccggaaaagttaccggaacttttattggatgagcgggtagtggatagagttaaaaccatcttggaatattttttgggttatcaattgggtgagccaataagacttctttaacttgacttttttcttaggctttggtaaattatttcacaacaaattaataatggattggcagtgaaccggaggagtagctgtgatttcccttaaagagagccgggggctggtgtgaaccggtagggataaacggtgaaggcgccggggagccggcaggaggaaaccccaaggggagtaaagcctgcagagttttgaggtgggccttttttggccaaccagggtggaaccgcggaaggatgcccctttcgtccctggcagcttgccgggacaaaggggctttaaatttattaaggtgtttgtttttattagtttttccaatttccaacatccaacttctaatatctaatatgggggtgttttttatgcttacttttcaggagattattttaaagctaaacgaatactgggggcagcaaggttgcattattgctcagccttacgataccgaaaaaggggccggaactatgaatcctcatacctttttgcgggctttgggaccggaaccctggcgggtggcttatgtagagccgtcgcgaagaccaaccgacggacggtacggagaaaaccccaaccgcttgcaacattattaccagtatcaggtgattttaaagcccaaccccgataatgtggtggagctttatatggatagcttaagatacctgggaattaacctcgaagagcacgattttcgcctggtggaggataactgggagtccccaactttaggagcctggggtcttggctgggaagtatggcttgatggtatggagattacccagtttacctattttcagcaatgcggcggtattgaccttccggtagtatcggcggaaataacctatgggttagagcggatcgctatgtaccttcagaaaaaagatagcgtttatgacattgtctgggtcgatggaataacttacggggacgttcacttaatgggggaaattgaaaactccaaatataactttgagctggccgatgtggataagcttttttcctggtttaaagattttgaggcggaggcaaaacgtctaattgaagcgggagtggttctgccggcttacgattttgtcctaaaatgctcccacacctttaaccttttagacgcccggggagcaatttcggtaaccgaaagaacggcgtatatcgggagaatcagaaacttggctcgcctggttgcgcagaagtacattgagcagcgggagagtctcggttttccgcttttaaaaaaataatttaggggggagaaaaaatggactacttactggaaattggtgttgaagaaataccggcgcgctttattcccgggattattgaggaggtcaaaaataaaggggaagaattcttaaaggaatttggggtgcagtatgaagcgttaatttccgaggcaacaccccggaggattgttttttacgttaagggagttttaccgaagaccgaagaaaaaattcaggaagtaaaggggcccgctaagaaggcttcttatgatagcgaaggaaatccgaccagggctcttttaggttttgccagaagccaggggatagaacctaacgaagtaatcgaaaaagaggtaaatggggttatttacgtttttgcccggaaaaaaaccgggggaaatccggtagacgaattgttgcctgaaattgcccggaagttaattaaaaacctgtctttccccaaacccatgcgctggggagatatagattttaagtttattcgcccgattcgctggcttgtttccctgctggatgaaaaagtgataccccttgaaatagccggaattaaggcggacaggatatccaggggtcaccgcttcttggggcaaaaggaagttgttttagatagagcagccgattactttgttgcaatgagagagaattatgttattgtttccctgaatgaaagaattgagatgatcagggctcagttacatagggcaagcgccgaagaaggagttgtggtagatcaggatgaggaacttttactggaaaacgccaatttggtggagtatcctaccgtggtaattggagaaattaatagagaatttttagaactacctaaagaagtaataattacgccaatgaaggaacaccagcgctattttcccctgtttaaaaatgatggaagtttgtaccacaaatttttagctgttagaaacggaggcagggaaaatttagcggaaattgccgagggttatgccaaggttttaaaggccaggctttacgatgcccggtttttctaccgggaagatttgaaaaaaccgcttgccgcttataatgaaaaacttacccggatagtatttcaggagaagttaggaacggtatgggataaagttttacgcttaaaggaacttgtggtggctattggcagggaacttaattgtgatgatgaggtaaaaagttacgccgtccgggcagcggagctttctaaagcagatcttgctaccaatatggtttatgagtttcccgagctccaggggattatgggtcgggattatgctttaaagtccggggaaagaaaggaagtagccgaggctatttttgagcattaccttccaagattttcaggggatattgtggcaacctctgaagtcggaattttactgtcctgtgccgaaaaaatagataaccttacggcattttttgccttaaaacaaattccaaccggttcggcggacccctttggcttacggcggcaagctttaggacttcttcgcacgttaattgaaaacaaacgcttcttttctttaaagaaggcttttgatgctgcttttaatttgttacccgccgaggttcgggaaaaagcgaatttcgccgaagtttatgaagaactcttggagtttatttaccaaagatttaagggttttttactggaagagggattttcttacgataccattgatgcggtgctggctaccggaaaagatgacttttatgacctttacttaagagttcgggctttagaaaatctcagaaaccatccgagtttcacagctcttactacgacctttacgcgggcgtacaacctggcccgtaaaggacagggaagggaagtagctgaaagtttattatatgagccggcggaaaaagagctttttgctgagtttcgcgagatttccctaaatgttaaggagcttttaagggaaaaagcttacttaaaagccatggaagaagtggcggcattagcaaaccctttagaccggttctttaacgaagtgctggtgatggctgaagacgaaaagataagggaaaatcgccttggattacttggagcaattgccggacttgttctagaaattgccgatttgagcaaaattgttggttaattttttgcaaaaaattattaaattaggaggtattttttaagtaaatatagtataatatatcctgtaagctaattaaataatatagcacatttccttaaggtaggtgaattatatcgaacttacaaaacgtcaggaaaaaatccttgaaatagtgcgcaatcacggtcctattaccggggaggagattgctcaaaaactgaacatcagtcgtgcagcgctaaggccggatttagcgattttaaccatggctggattactgggagcaagaccccgggtaggttattactataccgggagggaaccccgggatgtaattgccggggttttaggaaatattcgggtgcaggaagttcagtcccgccctatagtcgtgcgggaaacatctacggtatatgatgctatcgtcacgatgtttattgaagatgtggggacaatttttgttgtttccgaggaaggttttttggaagggctggcttcacgcaaggacatgctcaaagcaactatgggcggtaaagatattaacaagcttcctgtaggtgtggtaatgacgcggatgccaaacatcatagtaacttatcccgatgagtcggtgttaagggcagcggagaaattaattcaccaccaggtagattcccttccggtagtagaaacggtgctgcatgaaggtcgggaaaaataccgggtggtgggtaggtttaccaaaaccaacattacaaggctttttgtcagcctggccggaaagtaaaaggaggtattggcaattaatctgaagttagagcaaattccagtggtttatattctttctgattcaatcggggaaacgggggaagtggtggcgaaagcggctgccagtcaatttgattcgggccgggttgatattcggcgggtgccgtacttaagttcggttcgggaagtggaagaggcgttacaggaagcggaaagtgcaggggccttggtggtttacactctggtgcgcccggacttaaaagagtacctggaaaagcgagcccatgaactttcccttccccatgtggatatcatgggaccgatgttggagggtttaaagcaaatcaccaagcaaaatcctaaataccagcccggattaattcgcaaaatggatgaagcttactttagcaaggtagaagcgattgaatttgccgttaaatacgatgacggcaaagaacctcggggattgctgcgggcggatttggtggtaattggggtttcgcgaacttctaaaactcccctttgcatgtatttggcccataaggggatcaaagcggcaaacgtgccgttagtaccggaggctactcccccggaagaattgtttaaaattccccctcataaagttgtgggacttaccataaaaccttcaattttatttgagatcaggaaggaaaggctaaaaacattgggactatcccaaacggccgattatgctaacatggaaagaattttgatggagctggattatgctctgggtattatgaaaaaaatcggctgtgccgtaattgatgtgagtaataaagcggtggaggaaacggcagccagggtgttagaaatttacaggaaaggggtagggaggtaatgaccaaatacgtttacttatttcatgaaggccgcgctgacatgaaagatttattggggggaaaaggggccaatttagcggaaatgaccaatatcggtcttccggtacctccgggaatgaccattactaccgaagcctgtcgggagtattaccggctgggaggtaagttcccggaaggtttaatggaagaggtcaaggaaaagcttgtttatattgaagaaaaaaccggtaaaaaatttggcgacccccaaaaccctcttttagtttcggtgcggtcgggagctaaattctcgatgccgggaatgatggatactatcttaaacctcggtttaaacgaggaaacggtggaaggtttggcgcaaaacactcaaaatccccggtttgcttatgatgcttaccggcggtttattcagatgtttggggatgtggttttagaaattcccaaacacgagtttgaacatattttagaccggcaaaaagaaaaggaaggggtaacctttgaccaggaactttccgcagaagctttaaaggaagttattacccgatataaagaattggtagaaagaaaaactggaaagcctttcccttctgatcccatggttcagcttaccatggctattgaagcggtatttaagtcctggaataacgaccgggccattgtctaccggaatttaaataaaattccccatgatttgggtactgcggttaacatccagtcaatggtctttggtaatatgggcaacgactccggtaccggtgtggcctttacccggaacccttccaccggggaaaaggttttatacggtgaatatctgaccaacgctcaaggagaagatgtggttgccggcattcgtactccgagtcccatttccaagttaaaagaagaaatgccggaagtttacgaacaatttgtcagtattgctaaactcttagaaagtcactacaaaaacatgcaggacattgaatttaccattgagcggggtaaactttatatcctgcaaaccagaaacggcaagcggacggcccaggctgcagttaagattgcccatgacatggtcgaagaagggttaattaccaaaaaagaagcgattttaatggtggagccgggacaattagaccagcttcttcaccggcaaattgatccttcggccaaggtggaggtaattgccaaggggttacccgcttctcccggggctgcctcggggattgtagtttttgatgccgatgaagcggagaaactgggcaaagaagggaaaaaggttttactggtgcggaccgaaaccactcccgatgatatccacggcattgtggccgcccagggagttttaaccagccggggtggtatgaccagccatgcggcggtggttgcccggggcatgggtaagccgtgtgtttgcggttgtgaagccatcaaaattgattatgagaaaaaattgtttaccgtagacaatattaccgtaaaagaaggagactacttatccattgacggttctaccggacgggtaattctcggaactgtcccgatgaaagatccagaactatctccggaatttattaagcttctggaatgggccgatgagttaaagcggcttgaggttcgggccaatgccgataccccggaagacgcccagaaagcccgggaatttggagccaaaggtatcggcctttgccggacggaacatatgtttatgggccccgagcggctgcctcacgtacaaagaatgattttagccgaaaccaaagaagagcgggaagaggctctatctcaccttcttcccatgcaggaagaggatttctatggcattttaaaagctatggaaggctatccggtatgtatccggctcctggacccgccccttcatgaatttttgccaagtttagaagaactgttggtggaaactaccgagctcagggtgcggggagataatccagaattacttgccgaaaaagaagctcttttaaagaaagtaaaatctttacacgaatttaacccgatgctcggacaccggggctgccgtttggggattacttatccggaagtttacgaaatgcagattcgggccatctttaacgctgctgctcgcttaaccaaagaagggtataaagtatatcctgaggtggaaattcccttaaccattgatgttaacgaaatgaaattctttaaagaaagaattgatgccattgcccgggaggtaatggaaagggaaggggttaccttccactacaccaccggcaccatgattgaattaccaagggcagcgctactggccgatgaactggccgaagttgccgaattctttagctttggtactaacgacctaacccagactacccttggttttagccgggacgacgccgaagggaagtttttaacccactacttagatatgaagattttaaaggaaaatccctttatcgtcttggaccgcaaaggtgttgggaaattaatgaaaattgccgtagaaggcggccggaaaacccgtccggatttactggtcggtatctgcggtgagcacggcggcgaaccaagctccgtagaattctgccaccagattgggcttgactttgtaagctgttcaccttaccgggtgccgattgcccgcctggcagcagctcaggcggcggtggcggaaggagaaattgttggaactaaataaggaaatttaaaaataaaggggctaccgcaaaaaaataaatgggtagccccttatttaatgttttggaacttttttgttctaatcctctctaatctaatatcaaaggatgattttccgtataaagcctcaggggtagttttgaaagccaaggctaattcttctaaagctttttccgtggtggttaagccaattaattttatggcgtaatcatcggctctatattctccaagctcttcatattttatccagataaatattaataagaaaataagcactaaaccggctgtatgtaaaaaatttccaattaccgtatatcccgtggcctggtagtaactacttaaagtaaacataataagtaatccccagggtacgagtactggcgaaataatcatcccaaacattttaaatttgcgatctaaaagatgaccggcttcatgggcaattaaatattcccggtagttatcattttttacgtattcggaatcgataaaaatgcggccttgggggtcggcaaggccaaggataactcctttagaacttaaaaatgataccagaggacttacaaaaacgggaaatccataggccttttttagtggcttggaaaaaaagcgaacggtaataaatgaatatttttttgaagttcctatatagggtaatatcattttgccaatgataagccaactaaaatacttaaaaagatcttcgatgacttctaaaggtaagtaaggtattagtaactttttaacattaagaaaaataagggacatcaaaaggggtgttgtaaataaagcaaagataccaataaaaaggaccagtagggtgattatgaatattttcttatttgggggttcggcgtcttcgaggattaaagttgaaccatcagcggttttggaaacttgttttaaacccggtaaataagcgatatttctgataactttttttgatcttgctccgttaaataaagtcaacagacattgccaagtggtaagagggtatttatcaattaaaacctttgcagaatagattttagttgcctttattttgggaagtcccatccccaccaggtttactgctaaaccgcccaaaatagtaactaagcttttagcccaaagaccctggacatagccatcggtagcttcagctaaactaccggctaaagcaaaagacaaccaaaaagtaaaaagtgcagcacttacgacccaggtcgcgatttccgcatataagatcaaaacttttcaccctttcacaagtgttggtaatagttaaagaatacggaaagaaaaagctgaaaattttttaaaatttagtataaatcattacttcgtttacattttaatttaatggtacatttttttgtcaagaagaatttgttttttgctgtataaaattccgcggttttgcaaaattttttcccgggcaccgatgaggtgtttttctttgccagttttgaccgcaaaaaataattaacaaatatctgtgatgccataattaccctcttgacagcttgctttcatactgttatataattatataacagcatgaaacaatgacggaggttttgaaaatggatactgggcaaagggcgaaacctgttttaaagattatttcggcaattttgttagggttaatggcctgggttgtaccgtatctgccaattaaacttctgctggtgcttttagcaatccttttaattggccttgggcttccaagaagcaggatatcttttataattttaagctcaattgtagtagtttttagcttttttacaaatccgaattttattgggcaagcggccaactggcctgcatggcttagcgattttggtagctggaaaagttatacaaatagctttgatagtgcccagatgaaaaactttgacattgaaaagtatttttccaagacccgggttaaccctgacaagagagtgcgcttgacggccaagaccgtagagattgatactgactgcggtgtggaaatttcactggtggagggagattacatcgaatacccggcagagcttcggttaagccagaaaggtgatatagctgtaatttctggcgggcaaagaggggatgtaacctatgtaatccgtttgggaaaagataatttgaaaaacttaaaaatctctgccgccggggtaaagttaaaaggggaagggaactttgaagaggtttttattgactgcgccggggcgtatctttcttcggaccttaacgtaaagaacttaaacatcaatgcggcggggcttatgctgaatggtaatttcgcaggggataaccttgaggttgatgggatgggaatggaactaaggggaacgtatcggtttaacaatatgaaaatagatggcatgggggcggaggtaaacatgaaggtagctttgaaagagctcacggtggattccttagccattaacggccggattgagataactgcaaaaccaaacgatgaagctaaaattaaacttaattccctggcggggaatattactttaaaaaatttagacggagtggttcttgagcattctggttttacaaaaattaacagagagtgatggtgaagatgttaagaaaggttgataaacacagcggtatcccggcatatatccaaattggcaatatgatcaaagcagagataattctgggcaatctcccccagggggcccagctcccaccggtgagggatttgcaatatatctttgatgtaaacatcaataccgtgctaaaagccttagacaaacttaaaaacgaaggctttatcgaggccgaacagggagtggggtattttgtaaaaaaggatatcagcgttgaggaggagataattaaaacagtaaaggattgcattcaaaaaataaaggctttaggaatagatttttataccattatgctgatttttgaggaggtatggaaaaatgaaagctcccctgatgcctgattttgtcaataaaatggaactttttctgcaaatagagctaaaagaaaagatgggaaggctatttatctttttggttttgctgtttgtgcccggtttttccgttaaaactatagccatatttttcttaagcgcctcaatgctgccggcggatatcaaaaaccggcgggatgaagctttatattttctacccttttcccgcaaagagctctacctctataacttgggatttttacttttgctggttttagtttcctcgattataacccaggccctttggccaacaaccattgccgaaaaaggaatgttcatcataaaaagcattaactttactttggccatgttcggggtggtcatgctttgcgtttcccagggcttagataatatcggttggccgtttattatcgtcttgctggatgccctcttaggaagtattggcagggcgtcaattaacccttataactggattagctttaccaatcagggcaatatcccctttgcttttgtatttgcggcgataatttgctttgctggctattggatatatctgaaaaatggtggtgagctctaaatggttttagaagtaaaaaacttaagcaagcagattagaggcaagcagattttaagcaatgtctcgtttagcttggaaaaaggtgaggttttagcgttaattggaccaaacggtgcgggcaagaccacaaccataaaatgcattatcaatgcccttaaaaaagatgaaggcgaagttattttattcggaaagccttttgccaatgaagtaaagaccagaatagctgttgtccctgaagaccgcaaggtttttcgcaattttaccgcggcggattaccgaagtctttggcagggcctttatcctgcctggaatgatgcgttttttaaggattttgtagtaagatataactttaatttaaaccagaaagtggagagctattctatagggcaaagaaccctgttcctgcttggtcttgctctatccagtggagctgaacttctcttgctggatgagccaacccagcatttggaccctaccattagaaatgaggttattcatctcatcaaccaatatgcccggcttggcaattcccttttggtgtcgtcccatgagatctttgaattagaagaatatgccactacctttgccattatcaagaacggaaaggttttgtacaccgattccattgacgacgccaagcaaaagcaccggataataaggcggggggagagctttaaagagggtgaggtcatagggatgattcacgatgagatccttttaaaaacctccgatgatataggtatgtatcccaagttgaatcatattgtagtgggatatttgcagggaaagagtgccgatttaaatttggcagaagatttaaaagaaaattaaaatttccggtactatcgtttctgctttcaatacagaaacaagaccacctgataacactgatacagttagtatcagtgtgctacaatttgctttataaagttattttttgtgtttgcttaacattttgaaaccccccttatctcctattttcaggaatacatttccaattattactctattgttgttttgtcaagacaatttttaaaattttttgtatataggccggagaagcgtttacagtatttttcaagctaaaacaagcattgaaaaaggtgagttgctggaatcccattaaaaaagaagtactttatattattaaacgtttgtgtttgcaattatcaaactggtgaaaagaaaattaagttaaataggttttacaaaaaacgccaaagcatttttaagaattaatttttcttgcattggcaggatttttcttttctttagggagaaaaaaaggattttttacttttgcggcaaataataaatatacttattttattgacagtgggggataaagatgcgtttattttttgcagtggattttcccgaggaattaaaagaaaaaattcatcaggatattacacctttatttaaatacaacggggttaagtgggtagcaaaagagaactaccacttaactttagcttttttgggggaaaaagaggaaaaggagcttttgcaaattgaccgggcggcaaagagcgtacctcaagtcaaagagtcattaatcaaagtattagattttggggcttttcccaatttaaaaaggcctaaagttttatttttaaaaatcgaaagtcccgggcttttaactttagccgagaatttacgtcaaaatttaaaagaaaataatatttcttttgacgaaaagccgtttgtgccccatttaaccataggcagggtaaaaggggaaataaaaaatttagctttaccaaagtttaaccccaaagaattttcttttaaaaacttttacttaataaaaagcattttaacccctgaaggaccgatttacgaaaaaataaaaagctacgaaatattacaaaatgcttaagaatttgttaaaattaaattttatgaaggaaaaagccaattaaaaagcgtattaggaaggtataaaggaggcatataaatgaaggttgttgttttaaatggaagtcctaataaaaatggcaactgtacttatcttgcgggggtaataaaaaatcttgccagtgagtataatgcagaaactgtaattatcaatgttgacgagattatgcgccgccaaaaaatcccttactgcatccattgctcggcaccttgttcgggggtttgctacaagggaacggaattagaagctgcctatcttcagcttggttccgctgatgcagtaatcatgctctcaccggtttacttcggcactgtatcggcgcaattaaaagctttttgggataaaacccgaagacttagggacagaaagcttcttgttaatgtagtgggagcggcggccaccgttggcggttcgcgcttcgggggccaggagaccactatatctaccctccacgacatgatgctggttcaaggtatgaccgttgtaggcgatggtttgtttaccgccgatgccggacaccagggggcgtgctttacccgtccggccgaagaggagcaaaacggtgttaaaaggcttgagatattagtaaaaagggtgttggaggtagctaaagctaccgaaagtttaagggaaaagcgggaggttactttattttaacggagcgataatttatgttaatccgggagaccattgaagagcgggagcttagagaattatctccctatgcggccaagagccgttttaccaggggtagacttaaacccgaagaggaatgtccgatccgtaccgcctatcagcgggaccgggaccggattgtccattccaaggcctttcggcggttaaaacataaaacccaggtgtttattgccccggaaggggaccactaccggactcgccttacccatactttggaggtggcccagatagccaggaccattgcccgggctttgtttttaaacgaggatttaacggaagctatagcttttggccatgacctggggcatactccttttggccatgccggggaagaccagctgaacagtttgttacccggaggtttcaaacataatgcccagagcttacgggtagtggatgttttggaaaagggagaaggacttaatttaacctgggaagttcgggaagggatcttaaagcacacctggagtgaggagccgccggaaaccctggaaggacaaatcgtacggcttgccgaccggattgcttacatcaatcacgatattgatgatgccatccgggcgggggttttaaaggaagaagaactgccacgggattgcttaaaaattcttggctttcgccaccgggaccggattaacaccatggtaactgacgtaattaaaaatagcttggataagccgcaaattacgatgagtcaagatgtggaatgggcgatgttagaacttagaaattttttgtttagaacggtttatattggaagcgaaccgaaaaaagaagagaaaaaagccaaatttcttataaaaatgctttatgaacattatttagaaaatgtatatcaattacccgaggaatttcaaaatatcgttaaaaacgaaggacccgaaagggctgtagcggactatattgccgggatgaccgaccgttttgccttaaaagtatataaagaattgtttatacctcatcctttgacctaaaaacttatttgtcgaagcagcaggaaaaagcgaaaaaaaagagaataactattattaagagagcggtgaaaaccgtgtcctttcaagaggttgtagaaaaaattaggaaccgggtcgatttagttgatttagttagcgaatataccaggctgaaaaagtcgggaaggaactatgtaggattatgtccctttcataatgaaaaaaccccttccttttcggtttcaccggaaaaaaacctgtattactgctttggttgccaaaaaggcggcgatatttttagttttatcatggaaaaagaaaggttgaattttaaagaagccgtcttttatttggcgaaaaaatataacattgaacttccggaaacgggaaaagcgtataataaaaacgaacatctgtaccgaatgttacttttagcggcaaaattttaccatgaaattttaaaaaccgaagcggccgggaaagcccgggattacctgcaaagcaggggtattaccgaggaaacggttaaagattttatgttaggctttgctccatccgccaaagctttgccggcttttttaagcagtaaaggttataatccgggggaactggttaaaataggaattgtgacaaaaagttatagcggaaacttacatgaccgttttgctggaaggcttatctttcccatattcgaccgggagggccgggtggtaggttttgggggaagagccctgggcgaggaaaagcccaagtattttaattcaccccaatcggtgatttttgacaagggtaagcttttttacggttttaaacaagctcgaaccacaatcagggaaaaaagacaggccattttagttgaaggatattttgacgtgatttctttacatcaggcaggagttaaaaatgctattgcgtgtttgggtacggcatttaccgaagaacatttaaattttttaaaaaactacggttatattgaggaaataatcttagcttacgatagcgaccaggcgggagaaaaagcagcctatagagcactggaaatgctggttcgggccagtgctgatttaagcattaaaatcattcgtcttggagaatttaaagatcccgatgagcttattaaaaatcggggagcaactgcttttttagaagaaatagaaaaagccaaaactcctgcggaatttttattagaattagagcttaaagaaaagagcagtttaaatcttaacgaacaaagggcgctgttaaaaaagcttatcccttatctggttttagaatacgaaaaaactccggctttgtttgccgaaagaataggcggcattgccagcaagcttaaaatgagcgaaggggcattagtggacgaaattcgccgagagatttataaaaatgaagaaaaatctttaaataattcaagttttggagaaaatataactaatgaacacaaaaattatggccttttaaaagttgaaagtgagttattgggtttgttattagaatatcctgagtatcaaaaagaatttttaaatgacttttttttctatgagtttcagggaaaaaaccaggaagtctttaattacctaaaggaaaataagttccctgaccgggaagatccattatatagttacatgacctatttaaggattaactgcccggaaggggatccgaagaccctttatgaagggtatgttcgctatcttgaagaacattataaaaagcagcaagttcaaaggttaacattggaaatatctttagcggaaaaagaaggaaactgggaaaaactccagttattattaaacaaactgcaggaacttacccaaaaaaactaacgaagaaaggggggaatgcggcatgaaggaaataatgcaaaatgaaaagcttatggaaattgttgaaaaaggtaaaaagcgcggcgttttaacctataatgatttacttgacagcttacaaaacgtcgatataaattcggaacaaatcgatgaactgtacgaatacttggctaaccagggaatagaagtggtaccggaaataccggagttggagcttgattctattaatagcttagatgacgacgttgattttaagccttccgacattgacgaggtcgatttagatttaaccattccggaagggattgctatcgatgatccggtccggatgtatttaaaagaaatcggccgcgttcccttgctaacgccggaagaagaaatagagcttgccaaaaggaaggaagaaggcgatgaagaagctaaaaggaaacttgccgaagccaacttgcgccttgtggtaagcattgcaaaacggtatgtgggcaggggcatgttgtttttggatttaattcaggaaggcaatcttggtttattaaaagcggtggaaaagtttgattatcgtaaaggttacaagttttccacgtatgctacctggtggataagacaggccataacccgggctatagctgaccaggcccggaccattagaattccggtacacatggtggaaacgataaacaaattaattcgcgtctcgagaaatcttctccaggaacttgggcgggaacctaccccggaagaaatagccaaggaaatgggtatttctgaggataaagtaagggagattatgaaaattgcccaagaaccggtgtctttggaaacaccgattggagaggaagaagattctcacctcggagattttgtcgaagatcccgatgccaaagctcccgtagaagaagcttcttacactttactgcgggaacagttagatgaggttttaaaaactttaaccgaaagggagcaaaaggtcctaagacttcgctttggcctggatgacggtcgtgcccggaccttagaagaggtcgggcagatctttggtgttacccgggagcggattcgccaaattgaagccaaggctttacgaaaacttcgccatccaagccggagtaaaaagctgaaagattttctggaatagaagtaaaaaataccacaaaaatcttttaaaaaacttcttgaccaaattaaaaatatctcatataataaatcatgtcgcggtaacaaatgaaattcgggcccatagctcagcggtagagctgccggctcataaccggtaggtcccaggttcaaatcctggtgggcccaccatgttaaggccggaaggctcgaagttaagagtatgtggccccatggtcaagaggcctaagacaccgccctttcaaggcggtaacccgggttcgaatcccggtggggtcaccaggggcggttagctcagctgggagagcacctgccttacaagcagggggtcggcagttcgatcctgtcaccgcccaccaaagaatataaacctcaaacctgtaaggtttggggttttttgtttttactaccttttttggggaagatgctgtataattattgaaaatataattaaacatatttaaaaagttactcaggaggaaaaatggagttaacggaaaggttaaaagcgttagcaaaacacgtaattaccggtgaacctgcggctgatattggtacggaccatgcaaaattaccaatttatttagtaatccacaatatctgtccaaaagtaattgctaccgatttaaatgaaatgccactgaatcacgctcagagtgaagttagagaatacgggcttttggaaaaaattgagttaagacagggagacgggttatctcctttaaaaccgggggaagttaaaagtgtggtaattgcgggtatgggtgggaatactattgcgcggattatcgaaggtcgaccggaaattgcccgggaagttcgccttatcctgcaaccgatgacggatagttatgctttacgcttaaaactggtgtcaagaggttaccggattattgccgaggaactggtggaagaaaaaagcagactttacgaagttattgttgctgaggccggtaaaatggagaatttagataaagttgaaattggcttaggaccggttttgcttaagaatagggatgaacttacaagaaaatatttaacagggcaaaaagaaaaataccggaaaatcctgattaatttacaaaaggcgcaagtgaaagatttagaaaaggttagggaaattagtgagattttaaattatcttaaggaggtgttaaaaagttggcccatccgcaggaaatagcggcggttatagaagaaaaatttccacggaaattggcaatggagtgggataatcccggctggcagatttattttgaaaaagaagtacataaggtcttactggctttggatatcaccgcagctaccgttgattttgcattaaacgaaaaggttgatttaataattactcaccatcccctcttttttaaaccgcttaagtccctgacttttgagcgaaaggaaactctgcccctgttaaaacttctggaaaagcaaatttcggtgtatgccattcacaccaatttagatgtggctttcgggggaataaacgattatttagcagagcttttagaacttcaggaagttaagcccctgggggaggaaatttttgagaaactttataaactttccgtttttgttccggaatcccactgggagacggttagagaagcgatgggagctgcaggagcgggttttatcggcaattattctcactgtacttttaacacccggggtattgggacttttttaccccttgaaggtacaaatccgtatatcggtgcggtgggaaagctggaaagggtagaagaagttaagatcgaaacaattgttccggaaagacttttagcaaaagtggtaaaggctatgttaaaagtccatccctatgaagaggtggcgtacgatatctatcccttggagaacaaaaattatctgggaggaatgggaagaatcgggttaaccggtaaaaaaagctttaaagagtttttagctttagtggcggagaaattagggatagaaaatttaagatacgggggtgatttaaattcggttccgaaaaaagtggcggtggtaacgggagccggcggtagctattggccaaaagctaagtttgcgggggcggatatttttctaagcggggatataaaataccacgaagcggtttcaatgatagaagccggtttaaattttatcgatgccgggcactgggaaacggaaagaatatttactgaacttttgcttccccttttaagaaaaattgaaggcttaagtattgttgtggagatgggggagccggtatttaaattttttaaaagcagcagggggtaatattttgcagtatattagggaattatatatgtttatgcttttagaagaagaagagcggaaattagcaaatgatgagcggatattggttaatcgggaaagttttaatatggcccggaaaacctgggaaagcacccgaaaaatattttatgaaattaaagacgagttagcaaaaacggaagaagaaatcaagaaattagaagaggaattactggaattgactgacaaaataaatgagtttgagcaaaagctttaccgggaaggtacaaatttaaagcaaattgaacagtatcagtttaagcttgaattattaaaaaacgagaaatccgataaagaagagcggttactggaaattattgaccgggaagaagaattaaaagaagaattgaaaaaacttaaagataaactcaccaagggtaaagaacggcttttgaaatggcaggaagagataaagctggcagaagaagaatatcgaagaaatttagaggctcttcggcaaaagttagcgcgggagcaagaaaaacttaaagaaaatccctattatgcaaaatataaggagttaaaagaaaagtatttaaatccggtagcggtggtagagaaagaaacgtgttatgggtgttttatgagtttaccctttgaactgaccaaaaaattaaagctcgggcagggagaaggaagtatttgcccaaattgtaaacgtttgttatattatcccgaataatgaaaatttacagataaataaaacaaaaaacgacgaaaaaattaagaaatatcagggtttttatggatttgaggtcataaaaattttttattattattgcaatttacggagatattactttataatgaaggtaacttcctctctatttatccttcaaattttaaggctataagccctcttgaatagggcttatagccttttttttcaagcgagtaagcctgtaagccgagttctgtcgaggatgaccatctatctgagacctctgtcaccagaggccttaagcgaccaacccggggacagagcgggccactctatagtccccctatttggtcttgctccggatggggtttgcctagccggacagttacctgcccgctggtgagctcttacctcacctttccacccttaccctactggaagttggaggttggaagttagaaattagaaaaaaccttatttccaattggcatataagcgatttatttttttagcaagtaattcatactccttataaaaatattggtaagtgttttcatctaaataatttaaatccttagcaaagtccagtaatactaacacttcattacaagagccaaggctatttaaaataaaacttttaaaagttaaaattgaacgtttacgaccaaagccttccgcaatatttaaaggaattgaaattacggctctgcgaaattgacttgcaagctcgtactgctcatatttgggaaaagttgttatgattttatatatttcaagagcaagattataagaagtttggtaaacttctaaatctttaaaggagtaaatcatttaatttctcctttccaacttctaacctctcacctccaacttccaataaggcggtttgtttctgtggcactttccttggagtcgcctccaccgggcgttacccggcatcctgccctatggagctcggactttcctcagggatttctccccgcggtcatccggcttactcgcttttattcagttttgccactaaataattataattttttcctgatacctctgcaagcaacaaataatggtatcttacatttcgggttcgatataaacggcagttcctgttgcaactaccatgagcattgactgcccaacactttcatagtctaaacttatgccaattacggcgtttgctccaagtcgtttggctctctcactcatctcatttaaaactatatttcttgcttcttccagctgttgctcataagctcccgaccgaccgccaataatatcgctaatggatgcaagtaaatcccggataaagtttgttcccatgattgcttctccggttacaatacccagatattttgtaactttaaaaccatccaatcttccgcttgtagctaaaagcattaaaggacacctcccgggtattttttttttattttaacaaaaaataagctgtaataatagggaaaataagttaccttattagtgtgtcgagtaatgtcgaaaaaactcattatttgtaaccatttcttaacattaccttaatatattagtaacaattatcaattattatgaaaacgaaaggacaagtcgggaggacaaaaagaggtccccccctccccactcccaatcccctcctcccgataaatgtccctgaatttaaaaaacagctcccgctttagttcttgcaagggaacttaggcggtataagctaaggttttaaaagaacaggaagctctaatttaagataacgatgggtagcggttaaggcatatatggaagcaaatattgagcttttgatgctggcagaaaaagggcagcaaacaagcagggtatgtctgaaatctaaagaaagggttttaaaagtttttaaaaaaacaaataagagcttttggaggaaaaagacaagcaaaaagcggggctgttctttaaatccctccaccggtggccgaaaagccacctttttttattattttttttaaataaagaaatggtataattaattctaaaaacggaggttttgggagtgggggataacgaacgaataaagggattggttttggcgattttggctacttctttgtggggtataaacggtaccgttacccgctacttattgattaacaatttagatccggtggttttggtacagataagacttaccgtaagcgctcttttgctgtttattttgctttttattttaaaaatcaatgtgaaaattagtagagatgatataatctccttacttatcttagggatttttggcttatcgctggtgcaaatgacgtatttttataccataagcttgactaatgtagcaacagcggtctttttacagtatctgtcaccggtatttgtagccctttacggtgtcttttttaaagcagaagaaattaccggaagcaaacttaccgctattggtatgtcgctcttaggaagttttctgatagtaacccagaatggtgagatacaactaccttttatgggattactttcgggtttgctatcggctttatcccaaagcttttatattatttacggaaaaaaagttttaaaccgctttagtcctataacggtattggcatacggctggctttttggagcagttttttggtggcttttaattcccccaaacaaagctttaatgcaccaggtttttaccttaagagatgtttttggaatatcgtatgtaattatttttgcaaccgttattccctttttattgtattttgaaagcctgaagtatttaaactccactaccatgagtgtggtaagtctggttgaaccggtggtagcggtaatagtggcttatcttgttttaggggaaaagttaacgccactttccacccttggtgctgttttaattttgtttgccatttataaaattaccagaagttaaaggaggattttgatgaaagttgctttaatagcccacgacgataaaaaggatgatcttcttgcttttgtaaaaactcaccgggagttttttgcccgccatgaactttttgccaccggaacgacagggaaaattatttcagaaaatacggggctgacggtccaccgttttttgtccgggccccttgggggagatcaacaaattggagctatggtagcggcgggagagattaaactggtaattttctttcgcgatcccttaacggctcaacctcatgagccggatataacagctcttttacgggtatgtgacgttcataatgtgccaattgccaccaactggagcagtgccgaattgtttttacgagccttaaattaaaagagggatggtaatgggtttgatttttaaagatgtaggggttattgacctggacggaagcgttacgctccaggaaaaccttttactaaaattcaaacccaaaattatcagtttacccccggaaagtaacttaaaaattgtgacaagtctcgaaaattaccaggcggtctgtcaaaaactcagcaataccgtttatggcgtgaatttttgcggcctgggggaatttcaccaccttgcctattacttaattaaaagagttccggttcaggaagtagcggtagtggtttttgacaaccatccagatttactgcctacttttcccggatatatttcttgcggttcctggcttttaaatgttgctgagttaaaaaaggttgtgcaaataatagtagtaggagttacagaaatttcgggtttaaaaagcgctccgcctacctcggttagagaaaaaattatcctttttcttccccaaactcagaagaagaaaattaaaaaagcgacaattccggtaagatactacgatgaaaacaatctcttgacggaaatccataaaagcttaaaagttaaggatatttatataagtatagacaaagatgtccttcaccctcttgatgcggttaccacctgggagcagggagaattaagattaaaccagttactttctgcgttagcgatgttgaaagaaaaatataaaatttggggcattgacatttgtggagaatacggaagcgaacttcttaaaattcagcggataggggagaggtgggctacatcgcaaaacgaaagggcaaaccttgaaatattagagattttactgggagaataaaaataaagaacccctttacaggggtatttaatggggtaggttatggcatctgattaataatatacactgaaaatgttaataatactctgtggtaaaagttaaaataaagttaaaaaaggttatgcaaaaagaaaaatcagaagaataaagggtgataaacaaatgtattttgaaaattttcagcttagaagttatgattataactttgtgaaagagtttattgaaacgaggaaaaaagatagtcaggttattatgttaccgcaaaggggagaatggataacaattttatttgaagattcagcaataggggaaaaaataataatggagttaactaatgaactgcaaacaaaagcgttttttcttgaatcggatggtgataaaagctggagctttatcctgtattctgacggcaaagtggtggatgaatattacaacgatccgattgccggttttgagccggaagattacgaccgggaacagttaaaggaaatttatgaagctattcttacccctcacagtacttttgcagattttttggagtttttacaagggaaaaataaattaagtaaaaaaactatggaaaaatttgcttccttttttggcttaaaggatgtggaagtctcctatgaacaattttatgaccgggtagaggagttacagggagcaattattttttagcttaccagtccgggcgtaaaactttcgctccttcgaggtaaaggtgctgaaccttctggttttcgggtagataagtaaggatgagaacacggattactttctctaagcttcccggtacgtccatttcctgagcacaaagcaggggtatctctgtaagaccggctttgcgtgccgcagtagctggaaattgggcgtttaaatcgggagtggcagtaaaaaaaatggagataattttttccttttgaagactatttttcgacattatttcggccaacaatttttttgtttggcgttcaatagcctctggcgaattttccggaacggttattgccccgcgaatgccttttactacttccaaggtttccacctccttaacgtaaaaccggcctatacccttctttttctaaaagggaaaaagctttttgccgttcttcaaaggtagcaaaggaaagctttaagactcctccgtcgccctcccgggcttttaatatttctatatctttaatgtttatgttaaagcgggctaatagcccggttactttagcgagcattcccgggcgatcgggaatattggcggtaaggtcataaaggggtaaaagatagcccttgccattttggtttaaatttgtccggaattcctggccttcttttaaaaaagcgctgatctcgtttttatttcccgccataagtaaatttttaagagtaagaagctccccaataaataaatcgatacttttggccacttcttcacggttgtataataagatttcgctccatagttcggggcttgaggccgcgatgcgcgtgaggtcccgaaagcctccggcagcaagtttcaataacaattcgttgtcttcttccttttggcacatccggcataacgaataagcaatggcatgaggcaaatggcttaattgggcggttatccggtcgtgggttgtaacatcgctgacaattaccagagctcctattttctccaaaagccctttgagcttggtgaccgtatcctcgggcgcgtccggaccgggaattaaaaaatagtagctgttttcaaaaaggaaacggtgaccggcctgataacctcctctttccattcccgttaaaggatgaccgccgataaaatttttagcattatttaatttttcccgggcagtttgcataatttctcctttaatgctaacggtatcggtaattatggtctcgggctttaaaaaatttaaagccggtatgagctgcaatgttgtttcaggcggagttgccaaaaaaacgacatcgcaggaagtcaggagatttaaatcggaatggttattaacaattactttttccctgtaagcaagttcaacatactgcgaatttgtatcgataccgtaaacctggtaaccgaggtagctaaaagcccgagcaaggctgccgcctattaggccaagccctacgatgccgattttcatttccatcatttaaacccctccagaacctgttgtaaagtatttaactcggcataaagcgtggaaaactcggaaaaattaagagactgagggccatccgataaagctttttccggttctggatgaacttctatcatcaggccatcggcgccaagggctaaagcagcccgggataagggtaaaattaattcccttttgcccgtggcgtggctggggtccacgattaccgggaggtgtgataattgcttcaccaaagcaaccgcacttaaatcaagggtgttacgggtagcagtttcgaaagttctgattccccgttcgcataagataaccttttgatttccgccggacaggaggtattcggcagctaaaagccactcttcaatagtggcggataaacctctttttaaaattacgggattttctacctgggagagctcttttaaaagggcaaagttttgcatgtttcgagcgcctacctggaggatgtcgattctttcggcaacaaattctacatctttggcttctaacacttccgttacggtaatgagaccgtattcctgcccgatttcctgtaaaatgattacgccttcctcacccagtccctgaaacgagtaaggagaagttcggggtttaaaggtacctccgcgtaaaaacttaattcccttatcttttaagaattgagctactgcttttaaactttctctactctctacagcacagggacccgcgatgatggtaaaattaccggaacctatcgtttcccccttaatattaatttccgttttttcccgaaattctttgctggcaagtttatagggctttaaaattgggactaaagtatctactccgggcattaactcaaggtttaaatcggctaagttcctcttatcgccgataatgccaataatggttctttccaccccttcggaaaggtggggggtaaacccggatgctaagagtttctttctaacggcctcaatttgctcgcgggtagcggattttttaaaaaccacaatcataaataaaaaacctccctttcgtaattttgcagggaggaagggtgaaaaggaaaaaaactccctaagggagtataaaaaattattctcccttcctaccatcctgctatgtcctgcaatctaacctacccatccatcctactaaactgcaaaaaacaataccaatttttctggtattataaaacattttttcttgaataacaatagggggtaacaaatttttttaagaaattaattttaaaattgctcaatcgtagcgtaaaattaataaaatattatcaaataatgcgaaaaaaggggtttatcgttaaaaaaacaagaaatagcgaaaatatacacaagaatttacgaaataaccttttgctcttgactgttaaataaagtattctaaaagagacgatttatagcttaaaataagggggttttttgttgcatgaatccaagaaaggtggaggaagttaaaaagaaacagggatcttcttcaagggaggtggagtgggtaccaacaatttgcaacttttgttctaccgtctgcaacctcaaagtaggggtaaaagaggttaacgggaaaaaagttgcggtaaaaattgagggaaatgaaaatagccctctaaaccggggtaaagcctgtgcccggggacaggccggttttcaccagacctacgacaaggccaggcttactacacctctaattcgggttccaggaagtaaacggggtgaatggaattttaagcccgccacctgggaagaagtttacagctacattatgcaaaaaatgcaggaacaccagattatgccctgggaaattaccatgatgggtggatggacttcctgtgttttttacatgcctttagctttgggctttgccattgctaacggtatccccaacatcgtagctgctcctatgcagcagtgtgtagccagcggtcatttgggcaccgatatggtcaccggtaactttaacgttcacgatgaagttttagcggattttgaaaatgccagatatattatcttttctatgaccaattccggagttgctgctgcttccaccagccgcctggttcgattggcggaggctaaaaaacgcggggcaaaaattgtcgttttggatcccaggctttcagaactggcggctaaagctgatgaatggcttcctatcaaacccggaactgacagcgcctttttcctggctatgattcacgttatcctgcggcgcggactttttgaacgggaatatgtggtaaagcataccaacatgccgtttttaatggttgaacatcaggggatgtttgtacctttaatggagcaaaacgagcagggataccccaaagccttttttgtttatgatgaaatttccggggaaatccggaaaattcctggttactttaaccacaattataccgatgttgatggcaagggaattcggccggttttaaccttaccggaaggtgtaacctttaacggccagaaattgaaaactgtttttgaacttttaatagaacagtcagctccttatactccagagtgggcttctgaagaaaccggaatacctgccgaaaccattgagagaattgcggtggagtttggtacgattagaccggcaatgatggatcccggctggcacggtgcacgctatgaaaacgttattaatacccggcgacttcaggcgatgctgcaggcgttagtaggcggtatcgataccgttggcggatggctaatgtctgccgaataccgggaaaaaatcatgctggcgatggagaaaatgaaagccggggatgaaggtccggtactgtaccttccgggaatccaatttcccttaaaagcttcaggaatcctttttgatcctaattcctggtatcatggccatccccattatgctattgccaaggttatgcaggataaagccgaaggcaaggaaactatcgttttccccgctttttccgattacggtttaaaagaggcggtagaagggaaattaatgtttaacggtgaaccgtaccgcattaaagcaattatcttaaatgcatccaaccctattcgccattactatcctgaaagccgctggcaggaaattctgactaatcccaatttggcccttgtggtggctattgacgtgctgccctcagatacgaccttatatgctgatgttattttacctaacttaaactacatcgagcgggatgagccgtttatttacggggccggaccatcaccggatctcgcttacaccacccggtttaaagcggtagatggaccggaacaggctaaaggtactaccgatattttatttgaatttgctataggctttggtaatttggaaaaattcatggctaccgttgcggcgttggctggttttgaccatgaagatatcaagcaggaagtgggcaaggctttggaaggaaaacaaacctttacccgggccatgcgcaacgtttcttttaaacattatgccaagatgctaaaaactactccggaaaaactcgaaaaggaaatgcgggaaaaaggggttattttggtagaaaccaaggagcatttaatggaggatggaacccttttaaaacacctgccggttcccaccatgtccgggcggctggagttctactcctacttaatggccggtttcgtccaaatgtacggttatcagaaaaactgggacccgggacttgtttatattccgccggaaacaaaagatgtaaaacttgcggccaacgagtttcattttatttacggtaaagtaccaacggtgtcatatgcttctaccaactccaataacccccttttaatggctttgtcgaaagtaaaaggcgggaagtttttaggggtctgggttaaccggaaaaaaggtaagagtttaaatttaaaagatggtgatgtggtggtactggaaaacgcccaaaatccggagtattctgcgaaagcggtagtgtttttaacggaaatgattaggccggataccgtatttatttcgtcaagctttggtaccaaaaaccccctgttagaaaacgcagcgggaatgggtatacctttaaataatttagttccgtataaagtagaaccttttgtgaccggttttaagtctcaggaatttaccgttaggataataaagtaaggaggagaacaatggcacgctacggaatggtaattgaccttcgaacctgcgtcggctgtcaggcctgcagtgctgcctgtgccaccgaaaatcagacgccatactggtccgataagtggcgcacccgggtgctggatatcgaaaaaggtgaatatcccaataccggccggcattttgtaccaacaatttgtatgcactgcgaagaaccggcttgtttaaccatctgtccatctcaggcaactttccgggatgaaaacggcagcattctggtaaattatgatacctgtcttggttgtaaagcctgcatggcggcctgcccctatggggccaggtatgtttacgataagaacgatgttgccaaaaaccgggaaattcacggggaactttcacaacataaagtggtgcatattgacaagtgtactttttgctttgaccgggtagaaagaggcctggaaccggcttgcgtgtcaacctgtccggctcatgctaggattttcggggacttagatgacccgcatagtgaagttgccagactggtggcatcaggaattgccaagcctttaagaccggatttaaataccaaacccaaggtcttttacatttactaaggggggatggccgatgtcggtggaaaatagtctgccttttgaacgtcaggaagcttatgaatggcctttagcggtatacttgttgctgggaggtattggcggggcgtttatttctctttcgtttattttgcattacctttttagctggtcgccagttggcaattacggcatgcttattgggatgggactttttgccttggcgggtttgacccttctttttcttgacttagagcggccgctgaatgcgatatattctttaaataatattaaaacctccgggatttcctgggacgtagtcttaattgctttaagttttggcggtgcattgttatacgttttgccgttttacgtttctataccggtcttggaaagcttacggcttttgtttggcggtataggagctttagccggattcttatttccggtgatttccggcgggttaatttctgctccggtatcggtgccgctatggcatactcctcttttgcctgtgctgtttttaataaatagttttggagttgcttttgcagcgataccggctttgtttgccccgggttcagagattttagcgtttatttttaacttagcagtgtttatggcaaatctggtgatttcgggaggtttcattgctttttacgagcatgcccataacggcccggtagaagcctggtacggttttcaggaaatgtggaagaaatttaattttcaagtgggctttttagttgtgggtttactttttccgttaattcttagcggttatatgttctttaccggaaactttttgtcctggggatttggggcccttgcggttgctcaactaattggcggctttgctttaagaaactgcctgttaaaacacggttaccatacttatccctggccgtattaaattttataaaaaaagaggaattttcaaattaatagcgaatataaaaccaagaaaatttcataaacgccttttggtgccccatcaggggagaatagggaagtcaggtgcaagtcctgcgcggtcccgccgctgtaaccggagagccgataaaaccactgctttttgcgggaaggttttatcaaagggcaatgacccggaagccagaagacctgccaaaaggtggagctttagcggtacggcgataccgctttaagcgtgggtgatggtaaagcccacagcagtagaactgctgtgggctttttaaattataaaagggggagatgaactatgttaacggaagttttaaaccagattggggatctttacccggagcctatggtaaaagcacaaaagcacttagacagcctgattaaaccgccgggaagccttggagtcctggaggaaatggcggtaaaattagccgggattaccggagagcttgcgccgaatttaagcaggaaaacggtggtagttatagccggcgaccacggaataaccgaacatggggtgagcgttgctcccgtggaagtaacagcccagatgacccgctgttttcttgaaggtatagcgggaattaacgttttatcccggcataccggggtagaagttaaggttgtagatatgggagtcagggcggagcttaacttacccgggcttatcgttaaaaaagtacgttccggtacgtctgactttacccaaggcccggccatgacccgggaggaagccctacaagccataatggccggggtagatgttgcccaggatttaatcgctcaaggaagcaaggttttaattaccggggatatgggcatcggcaatactacaccttcggcagcgattttagcggttttaatggatattccagtagagcaggcggtaggtcggggaacggggattaaagctgaaatcttacaaaagaaaatagaggtaatcaaaaaagggttaaggattaatcagccggataaaaacgatgcggttgatgtccttgctaaagttggcggttttgaaattggtggccttgccggcctaatattaggggcagcagcccggagggtgccggtagttatagatgggtttatttcttccgcggcggcaatgttagccgtttctctaaattcaaagactaaaaacttcctttttccttcccacttatccgacgaaccgggccataagctgatgatggaatacctggggttaaccccttatcttcatctaaagatgcgccttggggaaggaaccgggggagtttttggagcctttttcctggaagccgctaccaaagtcatgcgggaaatgggaagttttgcatcgagcgaagtttcagccttactggaagaaagaatggcttaaaagcaattattaaagaaaaaagagggtgtaagtttggcaccctcttttacttatttaaaagatttcttaccgcctcccggccgcttttaatgcaatcgggaactccgattccccggtaggagctaccggctaaagcaagtcccggcatttcaaaaaccaactcctcgattttggcaagtctctctaaatgaccaaccttatactgggccatccccctgggccagcggaaaatttcgtaaaaaaggggtttagctgtaacgccgaggatatcttttatttccgctaaaaccagttcgaccatctctttttccggtaaaaagacatcgttctggttggtagctccccctaaaaaaccccggactaaaagatagctatcatcgggtacccggtagctccactttacagaactataagttaaggccattaaatgtcgtttttctatcctgggaactacaaagccaaaggtatttactttaaaaggccagtcttcttttctataggctaaagtgattgtagcggaagaggcaaagccggtttgggctaaaagttcggccagatctttatttatctcttccaaaagttcagccgcattataagcgggcactgccaggataacgtgcttactttcaattatttccccatcagttaaataggtccggtattttcccttttgataggtaaccttaacggcttttttgccggtaaaaagtttgtagtcgggaagatttttaacaatattctcggcaagttctcccatacccttttgaaagctcataaagtaagtggtattcgacttagttttaggtctatttgaggaagcttttttcgccgccagcattccccggataaggcttccatatttcttttccatctctacaaagcgaggaaaacttgccttaacgctcatttcttcgggggttcccgcgtgaatcccaccaattaaaggttcggcaattttttctaaagcttcccggccaagacgccgggttacaaagctgtaaaggctttcatcttcatcatctcttttccggggaataaacaggtccatacccatgcggattttccccggccaggaaatcaatgggcttaaagcaaaggggattattctggtaggtaccatcatcattagtccttccggtagctcgtgaagccttccgccggagaggatataagtacctttaaattcatcattggtaccgataattttatcttcaaatttaagttcccgggcaatttgaaatacctgtggcttttccgagagaaagcagtcaggaccaccttcgattataaaaccctcgcgttctattgttttaactttaccaccgaaataatcgttttcttcgattaagataaaatcctgaccttcgcggaataattcataggcagcagcaagtccggctatacccccacctattactaaaaaatccggcaattttacccctccattttttgtaccagctggtgtaaagctttaattaataaaggatggtcatttaaagctggaagccttacgatattaacagtggaaaacttttctttaagctcgatatctaaatcgtacagcgtttcaatatggtcggctacaaagccgatgggattaattataatgttttccacaccctggttttgccaggaaataattacatcatctacttccggttttaaccattcttcgcccgattttcccttgctttgaaaggcatacctccagggaaaaggaaaggtccgggcgattgcttccaccgtctttaaaaactcggcaaaataggggtcgccctgctctatagcttttttgggcaaattgtgggcggtaaagatgattccggtgttttttggagaaaaaggttgtagagccgttgttagaagctgacggtgagcttcgatgaaatacggttcttcagccagtccacctttaaaataaaatttaatttccgggaatttttcttctaaattttttattgttttttgataggctccggtggaaacctgggaattaaaagcggacatcggcagaaaataaatagtttttgcccctttttggactaaattaaaaacaacctcagggatttccggccgccagtactggtaagcaaaatccactaaaaactcggaacccagtaaagtttttaaagccctggcctgctggctggttatttccgttagcggggattttccgccgattttttcgtagcgactcctgacagctgcaatcagtgctggcggaggcgttctgcccatgattctttccataaaaggtccaatgttttccaaacaatcgggacagccaaaggccaccagaactacggctttcatcttttaagcctccaaaagttgttcataacttaaactgctcaattcgtggactacttctactaagtattgggcgttttccacgggggtttccttatggatgccatggcccaggttaaaaatgtgtcccgggcgtttcccggctttaattaaaatttcctttactttctggcgaattacttctttaggagcaaaaagggctacggggtcgagattaccctgaacgccccggtcaaaaccaacggtttgccaggcccggtcaaggcttaccctccagtcaaggcctatgacatcgccgccggcagcagctactaattctaacatactaccggcattattggcaaagtgaatgaccggaactccggtttcttttaaattgtcaaaaacatatttgctgtgaggtaaaacatacttttcgtagtcttccggggaaagggttcctacccaggagtcaaaaacctggaccgcctgggctcctgccgcaatttgtgcctttaaataccggactgtggattcggcaatttttcctaaaagctcatgccaggcctccggagcttcccacattaaccttttacactgaatataatttttggagccgcctccttctataatataactggccaaagtgaaaggggctccggaaaagccaataagcggtactttgccggcaagctcccggcgtaaaatttttatagcctccaaaacatacggtacatcttcttcaggagtaataacccgaacttttttcacatcaactatggttctaaccggattttcaattaccggaccttcgtctctggcaaaacgaaaaccaatgcccattccttctaaagggaggaggatgtcagcaaataagatggctgcatcaactccaagctttcttaccggttgcagggttacttctacagccagttcgggagttttacacatttccaaaaaagaatacttatttcgtatttccatgtattctgccatgtaacgtcctgcctgacgcataagccacaccggcgtatagggagtattttcccgacggcaagcttttaagaaagtatcgttcattttgtttctcctttctgctaccaatttcacaaattaatatatatattcaatattttcttgctgattcctttattgaaaaaagaatttttttaaataaaaagcctgtgcccttgcaggttttttaaaataaagttaaaattatactgtatacaaaatacaaaacgaggagcggtggcaatgagaataaaagatgtcctttttgttaaaggaagttccgggttttattttgatgaccagaaagcaataaagagcggtgctgtcaccgatggctttacctataaagggaagcctttaacccctggtttttcccgggtgcgccagggaggagaggcggtctcgataatgcttttcttggaaaacggcgaaatagccgttggcgattgcgtggcggtacaatattcaggggtagatggccgggatccggtctttttagcggataattttatagaagtccttgaggaagagattaagcccagattggtagggtataacctcgttcgctttagggaagcagcccgctattttactaatcttaccgataaacggggtaagagataccacactgctttgcgttacggtttaactcaggccctcttagatgcggtggctaagataaaccgtaccaccatggccgaagtaattgcggaagagtatgggctcgaccttactttaaatccggtgccgctatttgcccagtcgggggacgaccggtatatcaatgccgataaaatgatcttaaaacgggttgatgttctgccccatggtttatttaaccatcctgccaaaaccggggaggaagggaaaaatttaaccgaatacgcattgtggttaaaacaaagaataaaaaccctgggtgaccacgattacctgccggtgtttcactttgacgtttacggtaccctgggaacggtatttaatgataatttagaccggatagccgattacttagcaagactggaagaaaaggttgctccccatcctttacaaatagaagggccggtggaccttggctcaaaagaaaggcagattgaaggactaaaatacttgcaggaaaaacttattactttgggaagtaaggtgattattgtagccgatgagtggtgtaataatctatctgacattaaagaatttgttgatgctggtgccggtgggatggtgcaaattaaatctcccgatttaggtggggtaaacgatattatcgaagcggttttatatgccaaggaaaagggtaccggtgcctatttgggcggtagctgtaacgaaaccgatgtatcggccaaaattaccgttcatgtgggacttgctacaggcccggctcaactcctggttaaaccggggatgggagttgatgaaggattaaccattatgcgtaatgaaatgatgcggacgctggcgattttacagagaaacaaggtcacatttcagaaaaaagttggttagccggaaggaaaaccttccggtttttttattactttttgcaataatttcaagagataaaataacaaaatggaattttacaaataaaataaattaatataacataaaaacgggaggaaagggtctggtggcccccgtggactgcaaatccactggcccgaagtaaaccttcgggagtgaggtgtgaacccacttcctccctccagataaaaattaaaaggaggagagctatggacaatcgggagttgtggaaggtactaaatgttgatttagaaaagcacgatgaatttttagccccggtgccggcggtttatcgtgagctttttttaaatcgtcccaatcgtcccagggcaatggcttactttgacgcggtagtgggggatattcacggtatccgggtacatgaactttataacttaaaacaagaaggcaaaaaggtttttgctactttttgcgtttatgtaccggaagaaataataaacgctaccggcagtgcttgcatcggtctttgcggtggtgctcagtatactgtaccggcgggggaaacggtgttaccgcgtaatctctgccctttgattaagtcggcgatgggttttaaaattgaaaggatttgtccttattttcaggtggccgactacgtggttggggaaactacctgtgatggcaagaaaaaggcctgggagattttaaatgaatatattccagtttatgtaatggagttacctcagaaaaaagaagaacgggatcggaaattctgggaagaggaaattaaagattttgcgcaatttgtggaagaaaaaacgggagttaaactaaatgcagaaaatttaagggcgggcattgaaaaaataaacaaaaaaagaaaagctttaaaaaggctttccgatttaagaaaacacaacccggctcccatccatggccttgacgtactgttaattaaccagctggccttttttgatgaccccgagcgttttgccacaaaggttaatgaactctgcgacgaattggaagaaagggtggctaaaggcgaaggggtagtttccaaagatgctccacgaatcttaattaccggtactccccagcccataccccactggaaaatccatgctttaattgaaggcgccggcggtgttgtagtgggtgaggaaacctgcattggggaacgatattttaaagatttagtagaaccggcggcggatgtggaaggtatgcttaaaaatattgcggccaggtctttaaaggtaaattgtgcctgttttacccctaataccggcaggcttgaggatatcttatctatggtgcaaaaacttcaggtagatggggttatccattattctctgcagttctgccagccctatggagtggaaagttacttagtcggacgggaattggagagaagaaatattcctttcttaaagcttgaaagtgatttttctgaagaagaccaggggcaattaaaaacgcggattgaagcctttttggagatgataaagtagtgtttgcaggattagatttgggctcaaccaactcaaaattggtgattattaaagaagatggaagttatacttttaaggttgtccctaccaggtatgaaccggtgaaagccggggagttattactgaaaaataccggtgagatcaggaacttagttgttaccggatacggacgggtagcttttaaccggggaaaagtcgtaacggaaataacctgtcaggccaggggttgccatgaattatttccggaagtggattatatcttagatttaggcggtcaggatgctaaaattattaaaaaagatggtcaaggaagggtagttaattttttaatgaatgataaatgcgctgccggtacggggagatttcttgaaataattttaacggcaatcggtgatgattaccgggatgaggatttgattaatgaagaaaatgccgtgcctatcaattccatgtgcacggtttttgccgaatcggaagtcatttctctccttgcccggggaacttccaagagagcagtaattgcaggattatttaaaacaaccgccaaaagattggctaaatttgcagaaagccttggtaagcctcgtaagttgatttttaccggaggaggagcaaaatatccggctttaagactgtttttgcaaaaggaaatgggtgtcgaggtggttgtacccccagaaccatcggtgaccgctgccctgggtgcggctttaattgccagagaaaccgggagttaaccttcccggtttctttttaaattaaaattttcacaaatgcagaaattgttgaattaatgcgaattttgttataaaatgtatacagaaaacttaatagggcggatgaaggcagcaggagagacccggtttttcgggcgccgaaggagtaagcctttaaagtgttgcttggctttaaaggtgaaactctcaggcaaaaggactgttgccggacgaaactctggagagtcccttaaagggcacccacggggagtttaatctctcaggtcaaaggacagaggctaaagcagtttgttttagctatctgtcttttttgtttttcttgggatgaaaaaagtgttgctgttaaaactattaaaaaggggtgatgggatggagaacttgaaaaggacgccgctttatgaggaacatattaagcttggtgcgaaaatggttccctttggcggatgggagatgccggtccagtataccggtattttagaagaacatatggccgttcggaccgatgtaggcatgtttgatgtttcccacatgggggaaatagaaattaccggaaagcaagcggaacggtttgttaattaccttatcaccaatgatgtttcccgccttaattccggcgacgtaatttacactactatgtgctatcccgatggaggtaccgttgacgaccttttggcttataagtattcgaccgaacggtatttgttggtggtaaacgcagccaataaagataaagatttagctcatattctccaatacaggtgggacgatgttactgttaccgatttatccgacgaaaccgccgaaattgctttgcagggtccaagagcccaggagattttgcagaagttaaccgcttttgatttaaatcaaattaaatattttggttttgccgaaattgaggttgcaggcgttccctgtcttgttagccgcaccggatataccggtgaagatggctttgaaatttattttgctccaaatttggctacaaaaatctggaatgaactcttaaatcttggtgtcaagccggcaggtcttggtgcccgggatacgttaagatttgaagcctgtcttcctttatacggccatgaactttccgccgaaatcacacccttagaagccggactgggctgggccgttaagtttaataaggaagattttataggaaaagaagctttacttgcccaaaaaaatgccgggcttaaaagaaaaattgttggtttggaaatgatcggagcaggaattccacgccaaggctacgaaatagtatttaaccaaaggggagtaggttttgtcacctccggtacctttgcaccgttcctcaagaaaaacctggcaatggctatggtggatcttgaggcggcggaaattggtaccgaggtggacgtaatcattcgggggaagggcgtgcgtgcccgcgtaatttcaagaccattttataaaagggggaaataagcatgagtgtggtacctaaggatttaaagtacagccgtgagcatgagtggattaaggtagatggcaatatcggtattatcggtattaccgattttgcccaaaaatctttgggagatatcgtatttattgagcttcccggtgtgggggatgaaatttccgccggagatagctttggagttgtagagtcggtaaaagctgcttccgacttatatgctcccgtttccggaaaagttgtggaagttaatgaagaagttattgaatcgccgcaactggtaaatgaagatccctatggtaaggggtggatgattaaagtggaaattagtaacgaagcggagttagacgaactgctctcccccgaagattacgaaaaacttctggaagaggaaggagagtaatttgaaatatactccccataccccggacgaagtccgggaaatgttaagtagccttggcttaagtagcatcgaggaattgttttcggacatcccggaagaggttaaacttaaaaggcccttaaatctcccttccgggatgtcggaattggaagtaaagaaacacctggcaaacttagcggctaaaaacggttcggcggataagtataccgttttcttgggagcaggggtatacgaccattatgtcccggcggtggtcaaccacattttgctgcgctcggagttctataccgcttatactccttaccaggcggaaatgagccagggagttttacagtcgatctttgaatatcagaccatgatttgcgaactaaccggtcttgacatcaccaatgcctcgatgtatgatggcggttcggctttggctgaagccgctctgatggcggtaagccaaacccggagagataaagttttggtgttagccaccgttcatcccgagtaccgaagtgtggtaaaaacctacacctggggcccggaaattgaggtagtagaagtgccctataaaagcggtaccgttgacctggaaaaattagaagaactaatagacgataaaactgccgcggtcctggtgcaacatccaaacttctttggccaattagaaccggttgaggaaatcagccggttgattcatgcccaaaaaggccttttggtggtggcagtagaccccatttccctgggtattttaaaaccgcccgcggaatacggcgctgatattgctgtgggtgatgggcaggctctgggtaatggccttgcttttggtggtccgcaccttggcttttttgccgcccggaaggatttagcccgccggatgccgggacgcctcgtaggtttaactaccgataaagagggtaatcgcggctttgttttaaccttgcaggcgcgggagcagcatattcggcgggaaaaggcaacttccaatatctgcagtaaccaggctttaaatgccttagccgcaaccgtttatctggctactgttggcaagaagggattaaaagaaattgctctgcaaagcttacaaaaagcccattatgcttttgaacgtttaattggtgaaggttacgaacctttatttagcggaccgttctttaaagagtttgtggtaaaagttaaaaatgaagaagaaattacccaaaaacttctaaaacatcatattttggcggggccgggtatcagccgtttttatccggagttagcacccgctttaatgattgcggttacggaaaaacgcacccgggaagaaattgacaatctggtggaagtactgggaggtgaccggtaatgggaagctatcctctgatttttgaattatctaaagaaggaagaaccggctttgagcttcctgagttggatgttcccgctaaagatatcaataatctcattcctgaagaaatgcaaaggaaaaccgaaccggacctcccggaagtggctgaagtagatgtggttcgtcattatgtgggcttatcccggcggaattttggcgtggataacggcttttatcctctgggaagctgtacgatgaagtataaccccaagattaacgaagacacttcaaggcttgccggttttgctgaacttcatccctatgtgccggaggaacttgctcaaggggctttagagctgctgtacgatgcggaacagtaccttaaagaaattaccggcatggatcgttttactttccagccggcggcgggagcccacggagaatttaccggattgatgataataaaagcctacttggagaaaaagggcgagaagcggacaaaagttatcgttcccgattctgcccacggtaccaacccggcaaccgctgccatgtgcggttttaatgtgatttccattaagtccaatgaacggggactggtagacccggaggaactggcaaaagttttggataaagaggttgcagcattaatgcttaccaaccccaataccctgggactttttgaagaagaaattgtaaaaattgccaaaatggtccatgatgtcggcgggctactgtactatgatggagctaacttaaatgccattatgggggtaacccgcccgggagatatgggctttgatgtcatgcacattaaccttcataaaactttttccactccccacggcggcggtggacccggttccggaccggtaggggttaaagcccatttagccgagttcctgccggtaccggtggtggagaaagacggagatcggtactactttaattacaacctgcccaattccatcggcaaagtaaggaccttctacggcaacttcctggtagtggttaaagcttatacttacttaaaagctttaggtggcgaaggccttaccgatgtcagccaaaaagctgttttaaacgctaactatttaagagaaaagcttaaaaaatacttctatctgccctatgaccggctctgcaagcacgagtttgtcctgtccggtaagtggcagaaggaaaaaggggttcggactttagatattgctaaacgtctgttggactatggagttcacccaccgaccatttacttcccgcttattgttgatgaagcgttgatgattgagcccacggaaaccgagtccaaggaaactttagaccggtttattgaggtaatgattgcaataagccgggaagtagaggaaaatcccgaacttctccatgaagctccccacgtcaccccggtgaagcggctggatgaggtgggtgcagcgagaaatccaattttgaggtggagtaaagattggcaaaaataactttcgtttatccccataaaaccaaaccggttaccgttaccggcccccactgtgccttaaactgtgcccactgtgggggccattatttaaaaagtatgctgccggttgaaaagataccagatttacctgaagttaaaagccttttaattagcggaggctgtaccagagacggtaaagtcccgtggttaaaacatgccgaatttttagccgagcaaaaaggaaacttgaaatacaattttcatgtgggattaatcgatgacgaccgggaaattgaccttttggcccaaatagccgatgcggtgtcctttgattttgtgatagatgacgaaacaattgctaaagtttatcacttaaataaaaccggggaagattatttaaacacctaccggaaacttaagacgaaagttccggtgctgccgcatataactgttggccttctcggtggagaaattaaaggggaatttgaggcaataaaagctcttttagaatttaacccaccggccattgtgtttattatctttcgccctacgcctgatactgacttttctgaccgtcagccgccggaaattgccaatgttgtggaagtttttgaatatacccgaaaactttttccgaaaaccccgttatatttaggttgcatgcgccccgggggtaagtaccggaaagaaattgatttaaaagcgttggagctgggctttgcgcggattgtgcagccccatccggaggtagtgaaaaaagcccgggaattgggatatgaaattgaggaagcgggagagtgctgcgtgttatgagggcatcgattgggaccctggcggcgttaaagcttaaaaaagtcaaggtagaggctcttcccactactgcatattttatgctcggtgaaaagtgccagcatgattgtgccttttgttcccaggcgcgctccagtcacgccactcctgagcttttatcccgggtaacctggccaaaaatagaggaggaggcggtttttaaagcgctgggggaggaaccttctgaaatacgccgggcttgttttcaagtcgtgcgcactaaagaaagttttgcggaaattttggagaaggccaaaaagttaaaagaaaaagcggcaatacctctttgtgtttcgtacaatgttcgggatgccattgaggctcaacagatatttgcggccggggctgaccatataagtcttcctttagacggtgcggttaaaagggtttatgaaaaagttaaaggcaaaaattatgagaagttttacaataagcttctggacttagccgagaagtttccggggaaaataggtacccatttaattgcgggccttggggagaccgaagaggaaatgctgaaagtaatggacgatcttctaaaacaccagattaccatagctttatttgctttcactcccgtacccgggacccggttagaaaaagaaagtccaccggatataaaaagttaccgccggattcaagcgggtttttatcttttaaaaaagaatttaaaaagtatttctgaatttacctttaaaaatggacgggtagtaagctttggcttgacgcgggaggaaatcctggaaatttttcaggatggcgaagcttttcgcaccagcggttgtcctgactgtaaccgtccttattacaacgaacggccgggaggaacaatatataattatcctcgcccgttgactcctgaagaaagagagcggtgtttggaagaacttttaaccgaactggaggtgtaatatggaaacctggcgctttatcgatcactgctccttttccggagcagaaaatatggcgattgatgaagcattattacaggaagctataaataatcacggggcgccggttttgcgcttttatacctggacccgcccgactttaagcctgggttattttcaaaaagctcaggaagaggtggatttttccgaatgtgaaaaattgggggttgaagtggtacgccggcctaccggtgggcgggcggtactccacgaatttgaactgacttactcgattgttggcagcatccagcatcccaagctttctggaacggttttggagtcgtatttaaaaataagcaaaggtcttttactgggtctcaaaaacctgggaattgaaggggaaattgccgaagggaaaaaaacatccgatttatcggcaatttgcttcgaagccccttcctggtacgagctgacggttatggggcgaaaagttatcggaagtgctcaggttaggcggggagattaccttttgcaacacggggctattgttataaaaatggatgtggataaactttttcgggtactaaaatttaagtctttagagcaaaaagaacgaatacgggcaagttttcacagaaaggcgggagctattcatgatttttcatcccgggaattttcgctggcggaaataaaagaagcgtttttggcggggttttccgaagggtttgaagttaattttatacgaagtgaactctccctaaaagagcgtgaactcagtaggcaattactgagggaaaaatacaatacccgggagtggttgtttcgcttttaaaaagccctggcatgagcccgggctttttaagtttgatccaaacttgtcagtaccggatcaaacatcttaatttggcaggtagtaccgttccagtggcgacaagcttcacagcttttagtactggttttaccggtttttgcagaaaattttgggcagtttaatcctaccaagttgagctggtcggaactggcaaaattggtcatttttccacctcccgtttttctcctttattttttgaagtaaaagttttaaatatgcatttagttaatagaaaacggggaatactaagaaaaaatttgccgggggtggaatgatgcgggaaaacgtaggtacttgggatgcatttttacgcagttccatgggagcaatgcttctggggttaggtatcgtaaataaatcaaaaagtttaatttgtgtaggagctatggagctggctaccgggatcacccgctggtgtccggtgtttgagctttttggaataaatacggccgaagaagatttttattttgaagaggatgaagaagaaatttctattccgtcgcctagttaaacgcctaaataagggacggttctgtaatttgcgttttaacgcctaatgtaagaaccgtccctttttagtgctataacgcaaatagtggaacggactttaaaattattccattatccttttttcaccggaaatcgcctgcaacggcttgatatcctgggtaacttccaagacccccataaactctcccttttcatccctaacagcaatataacggatcaaaacatattttccttgatagtgaatccagaaatcttcaaaatctttgcgcccggattttaaatcgtccactaacttttctacaatatggacgctggccgggggatggcagttttcaacccttcggccaataatggttttgggtcggacgaaaacccggtccttactttcggaaaagtattttacgatgccatctttgtccacaaaagttatgtctaccggcaggtggttaaagattaaacctatttctttttgggttaaaagaccggtactaaactttatataaccttcctttgttatttcctggttctttactgaaatttcccgctttggtttccacccggtttgcggttcaattaaacaataacctatttcatcgctttgttcgtaaattgcccaccattcgtcttcggttaaagtttcaagacacatgggaaataagattttttcttccttaaaaatcatttcttcaatttttgccaaaacagcttcggttttttggattagctctgcttttttgtctggatcgtaatgtaatgctagaaggcgggcttcctttaacgctgcccggatttcatcatcaactccccacataactttgggtggccccatgatgttgtgcttttctaaaaaaggaaagagaagattttccttacggctgtaatgtttatctaaatctaaaagtaggtttaattttgcggtaagttctaatgagatgtttttttcttcgccggcggtggttgctttaaattttgctaaaatttcccttatttcctcaatgagcttttccaccgcacggttttcttctttaaaggtataaaccggatggccgggctgggtttccggggcaggttgttcttctaaggattctttaaagactgcggcgtgaacgtcgcaaagccgttgaacttcttcaacaggtaagccttcctgtatcagcatttgttcaattaaggttatttcggtaggagcaacatcttttataatctcatcaaaacgctcttttacttcttctaccgttttgccccggtgtaaatctaaaataatttccttaatggctttttttctaaactcccggttgttaataagttcactcataaaaacccctcctttttaattctgtctttagtttatcccagatttttctacttaacagtgatatatttaacaatttttgcataaatttttacaggattttttaggaggtgagagtttgaaagttcgctatgtacctttaaggccaaacaaaaacttgggaatagcggggaaaatttttcttttaattggtgtcatttatttactatttttagttttttcctggggatatgttaaggtagataaaattttgctggacaaaagcttttccgaaattatgaaggaagaaaaggccaataaaccaaaaataatggccaagcagcgaaaacttttagaagaaaggtataatcttaccccaaaaactacaaccgaagtaaccatgagcgggggaaaaccgcttccagtaggacctactgccagactgaaaaatggtcttacttttgaagatttagccagtatgtctcccgaagaaattaaagaaaaaggtgtctttccctatttaccgttaccccacccccaccctcagaacggcgggatggtttttccaccggtgcagactaagattcacccggagttagtgcgctttgacgtagatttcgatttacccgatgcctttttaccggaatttcctccgcctctatatcttaccacccatcccgaattgggggatgtatccaaaggaaaagaaattaccttggataactattacgaactttttaaagatattttaactccggtgcaattagaaggcctcaggcttcttttaaccaagtttccccagcagcagtttaacgctactgatgaccggaaaagtgaaaaaccaagccttggagtgtcgtgctttgattgtcacgtcaacggccataccaccggacaattccatttaaatccggataatcgccctcaagaaacccgttttcgaattgatacggtgagtttaaggggcacccatatacaacaattatttggttctaaacgctccattcgttcggtagaagatttttgtgaatttgagcagcggtcagcttattttgacggtgatcatactttggcggccaaaaaaggaataaacccgctctcccgggagcaggtaatgcatatggcccagtttatcaatatcattgattttccgccggcacccaaattaaatcgttatggcaggcttgacccggccaaagctaccgaaaaggaacttttaggagaaaaaatcttttttggcaaaggtaaatgcggctactgccatccggcaccgtactataccgaccagttaatgcacgatttaaaggtggagcgcttttaccagggtcggccggaagggcccatcaaaacttttaccttaagaggacttaaagattcaccgccttattttcacgatggccgcctgttaaccattgaagatacggtagaattttttaatcttgtcctggaattaaaacttacccgggaagaaaaggaagcgctcgttgcgttcctacgccagctttaaaactaaacgccaaattttgggacggttctttttttaggcgtataaacgcaaatataagaaccgttccttttttgctttatctttttgcggaagtggtgtattttaggggtagggggtgtaaaaaggtggagatagtgctgcggccgattggctacgtgcgtaacagctttaattccaaagaaaaaatggattacgatgaggatatttcggaaattgtagtctatgaggaatttgttccggggctttacaggattgaagacgaagagtacataactattattttttattttcatttaagcaatgaagaaaaactcattactgttagaagagacggcaaggaaaccggggtttttgcctcgagaagtcccaatcgtcccaatcatttagggattgccaccggaaggcttttaaaacgggaaggaaatgtcttaactgtaaagggaattgactgcttaaaccaaacacctgttttagacattaagcctaaaagccggaaatttgacggggtggatggttaaatggtggagtttgtttttctcggagattctttaacttacggttttccctatggacctaccgcttcctgggtaaatcttagtgcagaaaaacttggagtaagttttcttaatctcggagtttgcggtgatactttagaggatatgaaggaaagatttaaaagagagcggattttaggtaatacccttgtacttttagggggtaccaatgatatatacgttaatcgtccgacctcagaaatcttacaggatgcacgggagataataactgtggcgaaagaaagaaatttttctgccatcgtattagcttctcctctgccggttctggaagaagagtgggctgatgaaagattaaagatacttggaagaaaataccgggaaatagccggtgaattgggggtaaaatatttagatttttacgaaccgtttaaaaagcttttaaaaaataatccgggagttttaatagatggtcttcatccctcccgggagggttaccggtttatggctcaaatctttttgagctttttgggtattgaaaatgatttttagtctaaattactcaaaaaaaagcaaaaattaaaaataagttaaaaaagctaataaatccttgctaacagtcactttttcctgcaaaaataatatataataataaaaaagtttgcgggagtgtttggttttgaacgataaaaaagtttcctgggcaaaactttcgattatctccaatactcttctggtgctttttaagattgtcgttggcctttttaccggttcggtaagtattattgccgagggcttacattcgggagtggatttattggcttccatcattacctttttttccgtaaaagttgccagtcgaccggcggatgttcgtcacccttacggccatggtaaagtggaaaatattgccggaacaattgaagggcttttaatttttttaggagcggtattaataataaaagaagctttacccaagttttggcatccggaaatgcccgaaagccttggctggggcatgggagtcatggcagtttcagctttggttaatttttttatttcccaaactttattaaaaattgccaaagaaaccgattctccagccttagaagcggatggctggcacttaaggaccgatgtttatacctctgcgggtgtgttgttaggtctacttttaatcaaacttacgggcataacttactttgaccccattttggctttgattgtggccggtatgattttaaaagcagcttatgagattacctttgaaggctttgccaacatggttgacacggcattgccggaaaaggagattgctttaattaaagattccattgccaattacggcgaaaagtttctggagtttcacaagttacgggctcggaaaagcggctcggagcggtttattgatttgcatttggtggtaccggagaagctgtcggtaaaagaagttcatgacctttgcaataaaattgagcgggagatagaagaaaagctacccaattcgcacgtcttaattcatgccgagccctgccagaaagaacagcgccaatgtgaaaattgtccttattgttccgaaaaaaaaagctaaccgctcaaaggttagcttttttttcatctttggcttttggccagtactggtctaaaaactcggcggtaagcattcctgccaagatgaaaaaggcaccaattccttgcttggccactaaactttcaccgccaaagaggacggcaaaaagcaaggcaaagaccggctctaaggtaaagattagggctacgtgagaagcgctggtaaactgctgggctttggattgaactaaaaaagcaaggacggtagcaaaaatagcggtaaaaacaattgcatagaaaacttcgttagggtagggtttaaaaggctcttccagccacaaagccgcgggcaggcttaaaactcctacggtagcaatttgcccgagagttaacgaagttgcggaaaaattaggagaaaaacgctccaccgaaacaatttgcatactgaaaaataatgctccggctaaagttaaaaggtctcctgtgttaaagccggctttaaagtcaaaggacattataaataatcccaaaaaagataatccggtaccgaatatgacccctggggttaccggttttttatttaaaatactgcttaaaaccggtaccataaccacggccaggccggtaataaaaccgctattggctgcggaagtgtattttaagccgatggtttgtaagatatagccaagccagagaaaaaagccggcaatactgccgaaaaaaactccttttggcgagaagccttctttttgtaaaagtaatggtaaaaggaaaaaagtgctaaggaggaagcgaaaagatagaaaggaaaaaggttcaatattggccaaaatatttttaataatgacaaaagttgttccccagaaagcggtgactacgattaaacttatatcggccaagagttgtttggtttttagctccataatttccctccatttttttaagtacctttatattatacaaaacaattaatcgtttggagaagaacggagaaataatcagaaaattttaacattgactaattgtactaaacaatttataattattcaaaggttgattctttaatatactaaagggtattaaaggaggaattttttaatgaaaaaatttggagctttgttcttggttgtcgttttaaccttggggcttatcctgacagcctgtggcaataagcaggcggagcaaacaaacagcgcccaaaaccaggagcagaagcaggagcaaaaacaaaaaattgtagtggcttccgatacttcttacgctccttttgaatttcaggatccttctaccggaaaatatgtaggttttgatatggacttaattcaggcaattggcgaagcggttggctttgaagtggaaattaaaagtatgaactttgatggagttttaacttcggtgcaaagtggtacggttgatgcggctatttccgccatttcgattaccgataagcgcaaagaagtcatgaattttagcgaaccgtattacgattcgggtttggccattgtggtaaaaggtgacaacaacaccattaaaggtattgatgatttaaaagggaaaagggtagcggtgcaaattgccactaccggtgccgattatgccaacgagttaaaagctaaaggaattgtgaaagaggtaaaaacctttaatactcttcccgatgctttaatggaacttagaaacaacggtgttgatgcggtaattaacgactggccggttaatgcctactatattaagcaaagcttttccgatttaaaaatggtgggggataagttaaccggagaatcgtatggtatcgctgtgcccaagtccaagccggaaattttagccaaaattaacgaaggcttaaagaaagtgaaagaatcgggtaagtacgccgaaatttacgaaaagtggtttggagaaaaaccaaagaactaattgaggtggcttaagtggaactaaaatggtcggtagtaattgaatctttacctttattagcagaaggtgctttagtaacgcttaaaataacggttattgcagttacgttggggagtataatcggtttatttgcggggcttatgcgcattgcgcgtaacccccttttaaaatttatagctcgggtttatgtggattttatccgggggacacctttattagtgcaaatatttattatttattacggttttccccagctatgggcagcacttaccggtggccagcctcatgctatttcaccctgggcagcggctattgcctccaccagtattaacagcggggcgtatgtggcggagattttccgggcgggaatccaatcgatagaccggggacagatggaagcagcccgctctttagggatgacttacggacaggcaatgcggtacgttattttaccccaggcgtttaagcgggtaataccgccactgggtaacgaatttatagctatgcttaaagatacctccctgttatcggtgattggttttgaagagcttgcgcgccgcggagctttaataattggttataatgcccgggcttttgaagtgtggtttgctgtggcaattttatacctgattatgaccctcctaatttctcagttggtgagctataccgaaaggaggcttaaaaccggtgatcaccattaaaaaccttcacaaaaaatttggcaagcttcacgttttaaaaggcgtaaccactcacattaaagaacgggaagtagtggtgatcatagggccttccggttcggggaaaagtaccctgttaaggtgcattaaccttttagaaactcccacttccggcgaagtgtgggtggatggttttaaccttactgacccaaagaccgatattaataaagttcggacggaagtggggatggtgtttcagcggtttaacctttttccccataaaacagctttagaaaacatcaccctggctcccattaaggtgcggggcatgaaaaaagatgaagcggaagcgattgcttatgaccttttgaaaaaagtggggctttccgacaaagcccatgcgtatcccgaccagctgtccggcggtcagcagcagcgggttgccattgcccgggctttggccatgaagcctaaagttatgctgtttgacgaaccgacttctgctttggacccggagatggttggcgaagttttagaggtaatgttagaacttgcccatgaagggatgacgatggtggtggtaactcacgaaatgggttttgccaaggaagtaggccaccgggtagtgtttatggatgagggggtaattgtggaagagggaaaacccgaggagattttccagaacccccagcaacagaggaccaaagactttttaagtaaaatcttacatgtttaaaaccccgccgaggcggggttttttattttcaatggaagaagttgtgttataatagggcaaatagggcaaaaagtgctgggagggtaaagtttatggaagtgaccttaaaaaatgggcaaaaggtgaaaatccgcaaagtcagtttggaagatgccgaagagcttttagcattttataaaagagcaacaaacgaaactacttttttggcttatggaccgggagaatttaactttactgtggaacaggaaagagaattcattaatggacatcttcaaaataaaaaagccttactggcagtagccgactgccggggaaggattattggaagtgtaagctttaagccgggtttgggtacgcagttttctcattttggcgaaatggggatagcagtgttacaagagttctggggactgggagttggctgggctttaatttcttatttaaaaaaatgggctaaggacaatggtgttaggaaaattaatttaaatgtgcgggtggacaacaaaagagctatttccttatatgaaaaagcaggctttacttacgaagggcggattagccgtcattatttaattaacggtgttttttatgattcgtacattatgggaatagaaatagattaaaggtggaggagtttatgttatactatttagccattagtttgactattttttcaaatattatttaccatgttacgcaaaagttgattccccctaaagccaatccttttttagttttaacttcaacttatcttacggcagcttttttatcgttgttgctttcgccagtatttaaaggtaaagaaaagtttgtttttgaactttcaaagttaaactgggtaggattcgctctggggatagctatttttggattagaactgggatttttactggcataccgggccggctggaagataagtaccgctgctttgttctccaatgcagcggtaagcctttttttaatccccattgggattttgttttttggagaaaaattaaccgtaacaaaagttttgggaattatcttttgtttaatagggctctggcttcttggttaaaatttttccttggcgtaaatatatgaaaatgttataattaaaattaaagaatattatagaagggtgatggtttgtggatatttacgaattagctgcaaagctttctcctttttttgccagaaaggaggaaattgccggcaccgttctttttattcagggagaatcgcttgggcgaggggatgaggaactcggaaaaattctgatgaaaaattttcttacaaccctggcggggaatgatgaacttcccgaagctttattgtttgttaactccggggtaaagttagtggtggaaggctctccggtattaggacctttaaaaattcttgaagaaaaaggagtttatctcggggcttgcgggacctgccttgattattttaagttaaaagataaggtagtggccggcgaagtgaccaatatgggaaatattgtgaattatttaacaaaaagcttaaaagtcgtaagcctttaagaatttttaaaaaaccaagaaaaagtgatgtaaatgaatttaatggggtaaattaaaagaaaatcaaaatttgaccggttgaccagccggtcaaatttttttatattattatttgactgactggtcagtataaatcttaaaagggggtgtgcaggtgattcagtttaaagatgttaaatttagtaaggatccccgctttaatcctctcactttttccgtagaacagccggggattgtaggaatttgcggaccagcaaagaccggtaagactgcctgccttttagcaatgattggtggcgtgagaccggttgcaggatcaataacggttttaggtttaaatccggtgaaaaaacagcgggaaataagacaaaaggtggggctttcttttgtagaaggggtttatgagccgtacttttccctctcagtttttgataactttaaatttcaaggagctttgttagggaaaaaagtcacacccgtcgaggtggatagacttttggagaagattgaagcaaattttacaaaagaaagtataattgccgatttaaatcctttacagagaattaaagttggtttagccctggctttacttggggaaccaccggtggtcttaattgatgaacccttcaggaacctcacctgccttgaacgaaaacatattgaaaaaattcttgtaaatttaaagcaagaagggaagttagttatttataccactttaaaagaagaagagcttggtattgccgatacagtagtggacgttgtgcaaggaggtgtaagcaatgaatttcttgaaaattgcgcgggtcgagctaaaacagcttcttagtacccgtcaagcccgagtagcgttaattgtgataattttaatgccgttactatacagctttgtttatttgtcagcgttttgggacccttatggcaatctaaaaaatttgccggtagcggtagttaatttagaccggggttataacgacggaaaggaaaaaatcaatgccgggaaagagcttgtagacgagctaaaaagcaataatgcggtaaaatggtactttgttgaggaaaaggaagcttaccgggggttactgggggataaatattatttaatagtaaaaatacccgaggatttttccgagaagttatataaaatgaaatcgtcggatccccaaaaaaccgggattaaggtaatttataacgagggtaaaaactatctggcagcccagttaaacagccgggtggttttagaattaaaacaaaaaatagaagggaaaatagttaaagaagcaatgactactcttcttgagaaaatggacgactctttaaaagatgtggaaaaagctgctgatggcagcgaaaagcttgaagggggtatcaaacaggcgtacaacggaagtacggagttagcaaagggcgggcaaaaattagcagcaggggccaaaaaacttgcagcaggcacggagcagctttatcagggaagcaaccggttaaaaagtggaaccatggaatttagccgcaatatgtcggtgtttgccgccaaaatggaggatgttagacgcggaagtgaaaaaatttatgaagggctaaaactacttcccggagatgagttaggaggtcagtttgctgaactaaacggtggggttaaaaccgttgctgacggagcttatgggatttacagcggaagtcttactttagaaagaggagtagccaatcttgctgcgggtagtagcggttatatagcgggtgttaattcttttttgtcaggggtagaaagcttttggagtcaagtgtcttccggcttaaaacaattagcttccggttataatcagcttttagacggcttaaacaaattgaaagatagcttgcaaacgggaactacattggtagccggagtagatcaatcccaaaaagctgcccaaaaccagattgaacaagccttaaataccttagaaaattacaaagctaaccatccggacccggaaatagataaggctataaattctctaaatgcagctaaagagaatttaacaatgattaatcaatataataccggactttcggctttggttagcaaaggcaatgaaggaatttcagagctaagttcatcccttacaacattaaatcttggactcacgaacttaataaaccagggagaagagggttataaaagtaagttaaaaccgggaatggtggctttagaaaagggtagtcaggacttaaccgcaggatttagccaattgcaagatggcgttggtaccctggtttacggcagcaagaagctttcggaaggtacagatcgtttagcattgaagacccgggaaataccggctaaaatggaagagctgggtagaggactatcggctttaaaagatggttacaatcaactgtataacgggataaatcttctggcagaaggaagtagtaagcttaataatgcggcattggcccttagtaacggaactgcttccttgaatagcggaatcttgcctgtaaaaaatggagctttggagttagaaaagggagcgttaaggttatcgactggtcaggcggaactaaatgacggtttatttaagctttataaaggttcccaggagcttacttcagggcttaaggccggggtagaggaaggaaagaaagagctaactccttccttaaaagaaaaaagggctaaaataatttccgatccggtggaagttaaagaggagaaaaaatattatgttcccaactacggaaccgcttttactccctatttccttccgctttccctctggattggtgctttggtgctgtttttcctggtaaatttaaaagaccaccgtttaaccttatcttcggttcgttcgtgggagatattaatcggtaaatttttagcggtagctttaattggggtgcttcaagctgtaatttctggtataattttagaaaaagggcttgaccttcaggttgcatctcaatggaaattctttggatttgctattttaatgtccctaactttcttagcgattatcggtttaatggtttccctttttggcatggcaggaaggtttttggcggtagttttattgattttgcaattagcttcttgcggtggtgcttttccctttgaactattaccaaaattcttccgggaaattagcgtttatttgccgatgacttacggagtttatggcttaagggaagccatttccggtggctccgggatgagctttaaccacagtgttttcatgatggctttgtttggggtaattgccttaatactaaattattttgtcacgccaaggcatgtaaggctttccgatttatcgcctaacgaaggtaacgtaatttagctgtttggaggataagatgaatccaaagattcgggcgattttaaaagctgcggctaaagtgatggcccaaaagggctttgaaaaagctaccatggatgaaattgctaaaattagtaaggtagccaaggggactttatattactatttcaaaagtaaagaggaactttttttaaagcttaccctttctattcttgaagaattagaggaaagaactaaaaaggttttagagttaaaagtttcggcggcggagaaacttagagctttaataaaggtccaggtggaatttttcttagagtttcacgaggaggtagtattagttttaggggatttctttggaagtacccttccccgggaaagttttcgggtaaagattaatgattattaccggcttataaaccaactaatagcggaagggataaaagccaacgaatttcgggaagttaacctggaaatttttgttccggctttttttggaatgacttcctttgctactattcgcggtattttaagagagaaagggtttttaaaagagcagcttatcaataatttaacggagatagttttaaacggtttaaaaaaataaccgggttatcccggttatttttttgtaaaggttttgagaaaaaagagaaaaatttttgcaccttgtatacattttgttattttattgacaaaagcggttggtgttttataaaattatcagcaaaacattttacagaaaaagcagtgaatgggagcggtgcaaaaggaaggccccagagagccgggggtagctgcgaacccggtgccggagttttgcacagatcgcccaggagctttccggtcgaaaggttagtaggccggaacggtttttgaccgttatgccaatgaagcggccgggttaccatgcccggcaagcagggtggtaccgcgggcaaaacccccgtccctggacgttcaggggcgggggttgtttttatatatttttggcataaaaatttataatttttaataaaattgcggaggtgtgggaaatggggcttcttatttacctggatggaaagtttgtaccggaggaggaagcgaaagtttcggtatttgaccacggtcttttatatggtgatggggtatttgaaggtatcagagcgtacaacaaccgggtatttaagctaaaagaacatatcgaccggctttacgagtcggccaaggctattcttttagaaatacctctaaccaaggaagaaatgaccgaagttgttctggaaaccatgcgtaaaaacaacttacgggaaggatatattcggttggtggttacccgggggaaaggtgacctgggcttagaccccagaaaatgtccaaaagctacggttttttgcatcggttcttccattaccctttatcccgagcgtttttacgaggaaggccttgaagtgattaccgtgccaacccggcgcaacttaaacgaagcttccagcccccgaattaagtcgttaaattacttaaacaacatcctggccaaaattgaagccaatttacacggggtcttagaagcaattcttctaaatcaggagggttatgtggcggaagctaccggggacaatgtttttatcgttaaaaacggtcgcttaattacaccaccttcttatgccggaattttagaaggtattacccgtaatacggttatggatttggccagaaaaagaggcattcccgtggaagaaaagctgtttacccgctatgacatctttaatgccgatgagtgtttcttgaccggtactgcggcggaagtaataccggtagtaaaagttgatggaagaactatcggtgaaggtgtacccggtcctatgaccaagacgttaatcaaagatttccgggaatacgttactaccgacggtccatttattttcagcgagtagagggggagaaagatgccaagtcacctcattaagtcaggcattagcaaagcaccgcatcgaagtttacttaaggctttgggaattaccgataatgagctaaaacgcccgtttatcggcgttgttcacagtttttcggaaattgttcccgggcacgttcatttaagaacggtggttgaagcggtaaaagccggagtgagaactgccggcggggttccctttgagctcccggtaatcggtgtttgcgatggtatagccatgaaccacgagggaatgaagtattcgcttgccagccgggaacttattgccgattcggtggaagtaatggttaaagctcaccagtttgatgcccttgtctttgttcccaactgcgacaaaattgttcccggaatgttaattgcggcaatgcgtttaaatcttccggctatttttgtcagcggtgggccgatgttagcgggaagagtaaggggaaaaagcgtttccctcagcaatgtttttgaaggggtaggggctgttgctgccggccttatgagtgaagaggaacttttagagtatgaaaattacgcctgccccggctgtggctcgtgtgccgggatgtttaccgccaactcgatgaactgtttaaccgaggccatagggatggcccttcccggaaacggcactattccggcggtgtatgccgaaaggttaaggcttgctaaactttccggggaaaaggtaatggaactactttcccaaaatatccgtccccgggatatctttacccgggagagtttgttaaatggtttggcggtagatatggctttagggtgctcgaccaatacggttttacatttggcggcggtagcttatgaggcgggagtggagttcgatttaaacctggttaacgaggtaagtgaaagaacgccaaacctctgccgtttaagcccggcgggaccgcaccacatggaagacctgtattttgccgggggaattccggcggtaatgaaggagctttcaaagaaaggtttgatcagagaagacctccttaccgtttcgggaaaaacggtgggggaaaacctgaaaaatgctgtcaataaaaatcccgaagttatccgacccattgataatccttactcggagacggggggcttagcaattttgtttggaaccctggcaccccggggagcggtggtgaaaaaatcggcggttttaccggaaatgttaacccataccggtccggcccgggtttttgatagcgaagaagatgctaccactgccattttaaccgggcaaataaagaaaggcgatgtggtggttatccgctatgaaggccccaaaggtggtcctggcatgcgggagatgttaacaccaacttcggcccttgccgggatgggcttggataaagatgtggcattgattaccgatggccggttttcgggagcaacccggggagcagcaatcgggcatgtttctcccgaaggttatgaaggtggaccgatagctttggttcgggaaggagacttaataaaaatagatattccggggcaaagattagatcttttagtatcagaagaagaacttaaccaaagaaaagcccggttacaaattcccgagcctaagattaaagaaggttaccttgctcgttatcaaaaattagtgagctctgctaatttaggtgcggtgtttttaaagtaggggtgagcgaaatggagttaaccggagcgcaaattttaattaaagtattagaggatttaggagtggatactgtatttggctatcccggtggagcggtactgcccatttacgatgccctttatgattcaaaaattacccattacttgacccggcacgaacagggagcggcccatgctgccgatggctatgcccgcgcttcggggaaggtaggggtatgttttgcaacttccggcccaggagccactaacctggtaaccggtcttgccactgcctatatggattcggttccggtggttgccattaccggacaggtggcaacctcgcttttgggacgggattcctttcaggaagcggatattaccggcataaccatgccgattaccaaacataattatttggtaaaagatccgggggaactggcccagacggtggtggaagcattttacattgcccggacgggacgaccggggccggttttaattgatattcccaaggatgtttcggcggcccgggcgcgctatgaatttcccgaaaaagttgagcttccagggtacaaaccggttttaactcccggcgaggaagaggttaataaggctatagcgttaattaattcctccgagcgtccgttaatttttagcggaggcgggactgttaacgccggggccgagcaattattgctggcttttgccgagaaaatcaatgcaccggtggttgcaagtttaatgggtttaggaggatttcccggagaccatcccttattcttgggaatgctgggtatgcacgggaccaagccggccaattatgcggtcagcgaatgtgatgtcctgatagccgtgggagtgcgctttgacgaccgggtaaccggagatgttaaaagctttgcccctaatgccaagattgttcacatagatattgacccggcggaaatcaataagaatgtgctggtggaagtgcctttggtgggggatgtaaagaacagcttagagcttttaattaaaggggtaaaggaaaaaaagccggagaaatggcttaagtatgtttttggtttaaaggaaaaatatcctttaacttataaccgggagtgtggcttaaaaccccaaaaagttatcgaaactctttataagataaccggaggcgaagcaattatcgttaccgatgtgggacagcatcagatgtgggctgcccagttttacaaatttaataagccgaggagatttatttcctccggtgggttaggaacgatggggtttggtttaccggcaggaattggggctcaggtggcaagaccggagcagcaggtaatagtggtatcgggcgatggtagtatccagatgaatagccaggaactaatgaccgttgcggcctataatatccccgttaaggttattatcttaaacaacggttacctggggatggtgcggcagtggcaggaacttttccatcagcgccgttattcgcatacggaacttaaaaatcccgactttgttaagttagccgatgcttacgggataaggggtttgcgcattaaaaaagaagaaaacttggaagaaaaacttttggaggcaataaattatgccggaccggtagtggtagatgtttgggtagaccgggaggaaaatgtttttcccatggtgccaccgggaggcgcaattcacaaaatgatcggttaaaggggggatttgatgcggcataccctggcagtattggtggaaaacaatcctggggttttagcaagggtggcggggctttttagccgccggggctataacattgatagccttgcggtgggcaggacggaaaatccggatatttcccggatgaccattgtggtggaaggggatgaccgggttttagagcaggtagtaaagcaactgagaaagttagttgatgtaatcaaagttcaggacattacctccgaacagtatgtgagccgggagcttttgcttttaaaagttcatgcggattccaatacccggggggaaattatgcaaatagtagaaatcttccgggcccggattgtggatattgggcccaaaaccctgaccattgaagctaccggtgatgaagataaaatcgaagctattgaaaatgcattaaggccttttggtattaaagagctggtacgcaccggaaaaattgccctgctgcggggctccagaacttcaaatataaatggagtaaaggaggaggaataaaaatgaaaaaagtttattatgatcaggacgctaatttagagcttttacgggagaaaaaaattgcgattattggctacggtagccaggggcatgctcaggcccagaacttaaaagatagcggcttaaatgtggtggtaggtcttcataaaaaaagtaaaagccgggaaaaagccgaagctgatggttttacggtaatgaaagtggatgaagcggcccagtgggctgatatcattcaaattttggttcccgaccaaattcagggagaattataccgggataaaatcgaggaacatttaaaaccgggtaaggccttaatgttttcccacggttttaacattcattacggacaaatagtgccgccgccggatgtcgatgtcttcttagttgcccctaaaagtcccggtcacctggtaaggcggatgtatttagaaggcaaaggggtgccgggtttaattgccgtctatcaggatgctaccggaaaagccaaggatttagctttggcctatgctaaaggtattggctgcacccgggcgggagtttttgaaactacttttaaagaagaaacggaaacggatctttttggtgaacaggcggtgttatgcggtggggtaacccacttaattaaagccggttttgaaactttagtagaagcgggctatgctccggaaatggcttattttgaatgtctccatgaaatgaagttaattgtcgatttaatttatgaaggtggcttttcgttaatgcggtattccatatccgatactgccgagtatggtgactacatggtaggtccccggattattaccgaagagaccaaaaaagagatgaaaaaggtcttggaagaaattcaaaacggaacttttgccaaaaactggatattagagaacatggccggtcgtccggtttataacgccatcaagcgtcgggaacaggaacatttaattgaaaaggtgggggcagaattacggcagatgatgccatggctgaaaaagtaggggggatgtcttttggagataactggtgctcaggctttggtaaaagcgttagaactggagggggtaactactatcttcggttaccctggaggagcggttgtacccctttatgatgccttaagccgatccaaaattcagcatgttttggtgcgccatgagccgggagcaattcatgctgctaatggttatgcccgggcttcggggaaagttggggtatgtgttgccacctcgggcccgggggcaaccaacctggttacggggattgctacggcatatatggattcggtaccggtggtggtgattaccgggcaagtaccgacaacgatggtgggcaccgatgcgtttcaggaagtggatattaccggaattaccatgcccatcaccaaacataactttttggtaaaaaatcctgcagatattccggcggtggtgaaaaaggctttttatatcgctgccacgggacgaccggggccggtactgattgatttacccaaagatgtagcagcgcggaccatagattttcagtatcctgaaaaagtagaaattcgcggttacaagcctaatttaaaagggcatccgcaaaaaattgccgaagcggtaaagctcataagggaagcgaaaaggccggtaattattgccggaggcggtgtgcttgcggccaatgccagtcaggagctttatgaatttgcggtaagagctgagattccggtaactaatacgctaatgggacttacttcctttccccaggatagtccgcttttcctgggcatgcttggcctgcatggaaccaggtatgccaatttagcggtgaccgaatgtgatgttttaattggactgggagtgcgttttgccgaccgggtaacgggagagttatccggctttgctcccaaagcaaaaattatccatatcgatgtagatccggcggaaatcggcaagaacgtgcgggcggatgttcccattgttggtgatgtcaaaaacgttttgcaggagatgttaaagcaaattgagccgcagaatcgtcaggaatggctttcccaaattaacacctggaagcaagagtttcccttaaagtatgaaaaagatgattttatcaaaccccaggagactattaagcttttgggggaaaagaccaccgccgacactataatcgctaccgatgtgggacagcatcagatgtggacagcgcaattttatccctttaaaaaaccccgtactttcttaaccagcgggggtcttggctgcatgggttatggtttgccggcagctataggtgcggcggtagcttttcgggataaacaggtaattttaattaccggcgatggcagtttccaaatgaatatgggggagttggctactgcccgggaacagaatttgtcgttgaagattattttgtttgttaataaaaaattaggtatggtaaagcagttgcaggaatattatgccaataaaaattactttggggttgacttgggctttgttccggattttgtagctttagctaaggcttatggaattcccggacggaagattaccagaccagaagaggttgacggggctttagatgaaatgcttgcccataagggaatgtatcttttggagattgaaatcagtcctgaagaaaaagttttacccatggttttatccggggctcctataggagaagcggtggactggtaatcttgaagtttgaagttggaaattagaggttagaataaaacgaaaaaacatttaaagtgtggtgaggtaaatggaaagggttaggatttttgatacgacgttaagggatggggaacagtcgccaggagttagtttaaatgctatggagaaattgcaaatcgcccggcagttacaaaagctgggcgttgatgttatagaggcaggttttcctataacttctcccggagataaggaagccgtttccttaattgcccgggaagtaaaaggggtggtagtggctgccctggcccgggcttcggctttggatatagaaacggcctgggacgccattaaagatgcggaaagtccccggattcatacttttattgccacttccgatattcatttgaaatataagctgaaaatggaccgggaaacggtagtggaacgggcggtagcagcggtcaaacttgctaaaaaatttaccgccgatgtggagttttcggcggaagatgcttcaagaagtgacctggactttttgtgccgggtggtggaagcggcggtaaaagcgggagctactaccataaacattcccgataccgttggctatgccgaaccggaagagtttggggagtttatttgcaaaattttagaaaaagttccggtaatggaccgggcggtgttaagcgttcactgtcatgatgatttgggccttgcggtggccaatagtttagctgccatcaaaaacggcgcccggcaggtggaatgtaccattaacggaattggtgaacgggctggaaactgttccttagaggagattgtaatggctctttatacccgcaaagatgtattgcctttttataccggcattaaaaccgaggagatttaccggaccagtaagctcgttagcaatttaaccgggatgccggtacagcccaacaaagcgattgtagggaaaaatgccttttcccacgaatcggggattcaccaggatggggttttaaaggaaagaactacttatgaaataatgaatcccaggctggtgggtattcccgaatcccgtctggtactgggtaaacattcgggaagacatgcgttaaaggagaggttattagagcttggttatgaattaaccgaagagcagttgaatgaggcttttgttaaatttaaagctttagccgataagaaaaaagaagttaccgatcaggatttagaagcaatgatggaagaagaaataagaaaagttcccgaaacttacaccctggattatttccatatttctaccggttcaacgattattcccacggccacggtgggcttaatcaaggaaggggaaaaattagaagacgccgccaccggcgatggaccggtggatgccatttataaagctatcaataaaataaccggtttaactccggttttagagcaatattcaattaatgccgtaacttctggcgaagatgccctgggagaagtagtggtaaaactaaaaaatggcctcgggaaaattgtcaccggtcgcggagtttccaccgatattttagaagcatcggccaaggcttatttaaatggtatcaataaattactttttgattaccaggcgaaaggggagaagcagtaatggggatgacgatgaccgagaaaattcttgcctatcatgccggaaaagagcttgttgaaccgggagaattaatttcctgcaaggtagatgcggttttagccaacgacataaccggaccggtagcgataagcgagtttaaaaaaattggagtggactcggtttttgaccgggacagggtttatttggtgcccgaccattttacccccaataaagacattaaaagtgccgaacaggccaaaattttgcgggattttgctaaagagcaaaacctaacctattattttgaagtgggtaaaatgggaattgagcatgtgcttctgccggaagaagggttggtattgccgggagaggtgattatcggtgccgattcccatacctgtacttacggggggctgggggcttttgctaccggggtaggttcaactgaccttgcggcggcgatggccctcggggaaacctggtttaaagttccggaaagcattaagttttacctttacggggaaaagcttttaccttacgtttccgccaaagatatcattctgtttataatcgggcagattggtgttgacggggcgttatataaagcgatggagttcgccggttcggctttaaagcttatttcggttgaaggacggttaaccatggccaatatggctatagaagcgggagcaaaaaacggcatctttccggtggatgagcttaccctggaatatgtaaaaggccgggcaaaacgggagtttaaggtttttgccagcgatcccgatgccagatacgaagcggtttacgaaattaacgtggaagaaatcgaaccgcaggtagctcttccccatcttccggaaaatgccgtgccggtaaaggaggtatccggcaaggacattgatcaggtggtaattggttcgtgcaccaacggccgaattgaggatttacgggtggcggcggcgatcttaaaaggtaaaaaagtaaaggattatgtgcggtgcattattattcccggatcccagtcggtttaccggcaggcccttaaggaaggacttatagatattttccttgaagcgggggcggcggtttccactcctacctgtggcccctgcctgggcggccacatggggattttagccaagggagagagagcggttgctactaccaaccgcaattttgtgggcaggatggggcatgtagaatcggaagtttacctggcgggaccggcggtagcagcagcttcagccattgccggaaaaatcgttcatcccgaggaggtgcggtaaatgcgtgcttttaaatttggcgatgacattgataccgatgtaattattccggcaaggtatcttaatacttctgatcctttggaattagccaaacactgcatggaggatgcggatccggagttttccaaaaaagctcgccccggggatgtgatcgttgccgggaaaaactttggctgcggtagttcccgggagcatgctcctattgcgatcaaagctctggggatcgaagcggtaattgccaaatcctttgcccggattttttaccggaatagttttaatattgggttaaaaattttggaatgtccggaagcggcggaaaaaattcgcgatggagatgaactttccatcaattacgataccggagaaataaaaaatcttactaccggcgaaagctactttgccaaacccataccggagtttatgcagaatattattgccaaaggaggacttattaactatgtccgggagaagctgcaagggaccgtttaaaattttggtgctgccgggggatggtattggaccggagataattaaggaagcggtgaaggttttaaaagcgttaggggagaaaaagggcattacttttaattttcagtacggtttaatcgggggagcggccatcgacgaaaggggagtgccccttcccgaagaaacggtggaacttggaaaacaatgtgatgctattttgttaggggctgtaggggggcccaagtgggataatttgccgccggaaattcggcccgaattgggagggcttttaaaaattcgcaaagtatttgacctgtatgccaacctgcggccggtaatgttttttccggagctgaaaaatgcttcccctttaaagccggacataattgagggtgtggatattttaatggtccgggagttaacgggaggtctttattttggcgagaagaagcggttcactaccgagcaaggggaacaagcggtaattgataccttgatttataccgaaaaagaagtggaaagggtagtaagacttggttttgagttagcgcaaaaacgaagaggtaaacttactttggtggataaagccaatgttttagaaagctcccgtttttggcgggagataaccggggagattaaaaaagagtatccggatgttgagctttcctacatgtatgttgataactgtgcaatgcagcttataaggaatccccggcagtttgatgtaatcgttaccgaaaacatgtttggggatattttaaccgatgaaggctcggttttggccggttccattggccttttaccctcggccagcttaaacggaaagtttgggttatatgagccgatccacggttcggcaccggatattgccggacaaaacaaagctaaccccctggcgacaattttatccgccgggatgatgttaagatacagtttagactgcccggaagaagcgttacttattgaaaaagcggtaaaagcagtattacaaaaaggttaccggacgggtgatattttggagccgggtactacgttagttacctgtgaagaaatgggtgatttagtagcggaagaaatcttaggtggggtttatgatgaaggtttacctttatgatactactttaagggatggagctcaggcggaagggataaattataccgtttccgataaattaaaaattgccaggaaattaattgcctttggcattgattatttagaaggtgggtggccgggagcaaatcctaaagatttagagtttttccaggaagccaaaaagcttgattttaataaaactaagcttgcggcttttggttcaacccgccatccaaggctaaaagttaaggacgaccctaaccttctgaacctgataaaaagtgaagccccggtagttacggtatttggtaaatcatgggacttgcatgtagagagtgctctggctacaaccctggaaaacaaccttttaatggtgtacgaaacggttgcctttttaaaagaggttgggcgggaagtggtttttgatgcggaacatttttttgacggttttaaaaataatcccgagtatgctctcaaagttatcgaacaggccgccagggctggagccgatttcatagtattatgtgataccaacggtggaagtttgcccaaagagattcgggccggggtggaagcagctttaaaaattcacccccgtatcggtattcacgctcataacgattcggaactggcggtggccaacagtttaatagcggtggaaacgggagctactatggttcaggggacgattaacggctatggagaacggtgcggtaatgccaacctctgttccgtaattcctaaccttattttaaaaatgggagtggaggtaaattgtcaggataatttaaaaaacctgacccggctttcccgttatgtatcggagatagccaacctccatcccaatccctatcagccgtataccgggcagagcgcctttacccataaaggcggggttcatgccagtgcgctcttaaaggataagggtacttatgagcatattccgccggaactggtaggcaaccaccggaaagtttccatttccgaccaagccggagtttcaaaccttctttttaacagtgagaacctggggctatcggaagaagaggtaaaaacctatggtaaagaactggtggcggcaattaaggcgatggagcaccagggctaccagtttgaaggggccgaagcttctttggagcttttggttcgaaaagttacgggaaagctttcggaaccgtttaaaattgacaactccaagctgatcattgaaatcaaggaagatggccgggtcttatccgaagcggtggttaaagtccgggtgggggataccaccattcataccgcttccgatggcaacggtccggttaacgctttagataatgccttaaggaaagctcttttagaaatataccccaatctttcggagcttaagcttaccgactataaggtccgggtcttaaacgaaaaagccgggacggaggcggtggtgcgggtgttaattgaatcgtcagctggcgagaaaagtatcaacaccgtgggagtttccaccaatatcattgaagccagtttaaaagccctgaccgacagcttgatttactttttaatcaataacaatgaagggactgtttcttaaaacagtcccttgtctttttcataaatgcttataaactttaaaaagggttcgagatttattttatatttttgcaggtgtaacttaagggaatctaatgagatatttttttggttatattttaaaagcattgctacatcaaataaatctttaggtcctccagctaagagtttttgagcaattaaatcataaaggctaattattttaaatttctctttttcctcaatggttacttctatagcattatttacgaaatcgatttcatgagggaagcgtgccataattatgtcaatactcacattatcaattacagctttaattatgtctcctacgggatctgctaaagatgattttatatagttaaattttactgaatttctttcaaggatatcaaaaaaaatttcctggggttcgggccaaagggctaagatgtcaatatcaaaagtgcttcttggttcagcataaaaagaaacggccaatcccccgattaggcaataacgaatcttttctttttcaaagatgttagttattttctttaaactttgaatcacctatttcaccctttttcaaggtcaaaatcgtttcgttaattttttcaataattaataacttttctttaaaggagagatttgccgtcggcgataatggtcgagaatcgttttttatttttgcaaaaatgaattctagctgagcttggaaattggatttcatagtaaccccctgaagtaattatagctaaaataccagataatgtaaatatggggtttttacagatatttttggtaaccgtggtaagtttctaccagccttccggcggctaaggattacattaaaataacgaccctaaaaatccttttaacgccggcttttttttctttttcggtcataatttgaccagacaattcccacagcggtgactgcagccaaagtgataccttttaccagagcgcgttcaactaaatccggctttaattcaggggcaaattttgctgccataggtaaaatttttgtcacaattaccccaataaagccatttaatcttaaaaaggaaggggccccgtatataagcaggattaaaaggggatgaaggttaaagcgatttaccagtaaacttgccaggagagttaaaagaataaggctcggcagataagtaattaaaatggttttggcgagtgcgataatttttggcgtgccgagaaagagaaaatcattatcggtcacatataatgctgcaatcaaaccagctattgcccaaagaattttgtcagtgaatttttccatgatttggcctcctcaggtaaactacttaaaataaggtaagagcgccaaaataaattctaaaagtatcagtaaaacaatggtaatctctaacgctaaaaagcggctggtgaccacttcttcggacagcatggagtagcttcgctccaggacatttaatttatgacgaatttgctcagcccagatgttggttcggaaaatccgtaaagcctgggaatagacccgggcgtaaaagacatcttcggtaacttttaaagcattttgcacccgctcggtaatttcggtgatatcggctacggtttttagcaggcgtttcattattgttcggtacttaccaagctttttgtagccccgttcttcttcggcctggtcgatatcctggtacatttcgttaattgcttttgttagtaagctatcatagtaacgaagctctaagagctgagagacggcaaactctaaaaggtcaataacatccatattgccattggcgtcatagacgaaggctgcatcccaggtaattatggtcatatcggtgtcggcataggaaaagcggttgtttaaaatttccgcccgggttgtggaggatataggttctttttctcctaaaagaagcggaactggatcgtaatttggtttttcgtttgtaaaaaaaatcaggaaatcttcttcaaaaagttctggcgaaggtttaattaaagcaggagttaaaaggtcttttaaaaacttcacttcttttttaaaaagtccgtcaaattcttcagtattgtttaagtaaaccatcagttctaaaaactcatcatggtttaaatctttaaggtccaaacttaagtttaaacttaagacaccccaggcgaaaatttttcccgctattttggtctgtaaagttttaccattaaagaaataaaaaccggtagaatattcgaagattaatggtggttcttctatgtgaatggctttgggcggaatttttttaagctttaaccgaaaaggccttttttcactcaggatttcttcggctttggcaaggtttatctcttccgcgatatcaaaaagacggtataaaaatatctgattcaaaaaaatcaccccataattttaattataaacaaaactggggcaaaagggaaataacgagagaaaagagaggttttcaagggaaaatcggtttttacttaaaaaggaatgtttcctgaaacaatctgagccagttcttcgggtaggcctttttttctgattgcagcagcggttatatcatacggatagggaatcgggcgaaaatttaccgtaagtttatcataagtaacttctacctgggcgtaaacggcccgggggtctttggttttgggtttaccgagggagccggggtttaaaaaatgccgtccctggtggaggaaataaaaaggataatgggtgtgtccgaaaacaaaaacatcgatatccgggtaatcttcaataagtttattaaaccggccggggaaaagatccggtgttaaatactcgtttaaccgctcgggagagccgtgaaataggagaaagtttttgccatgaatgacaaacttaatagtatttggtagttttttgaggtattctctattttccggcaacaggcttttgacggtaaatgccaaagattttgccccaatttcgtgttccttggccgttttataatcgcaaccacaggttggctttttattggcagcaccgtcatcgtaattgccaagaactccttcaatatttttatcccggataagttcaataacttcgttgggataagggccgtaaccgataaggtcgccggtgtggtagattttttccactttattcatttcggcatcggccaggacttcttttaaagctggcaggttaccatggatatcgccgataaaagctaatagcataacttacacctcgtttttgtagactactttcttagtataccaggactactttaattttaaaaaaaattaagttaaaatttagttaattaaattttcttaacgaaggggaatttaccgtgattgaagcattattttttgtaatggaagaagaagaaacgaccttaatttggaagaaaataaaagaaaagttgtctcttgaagaagaaccgggctttgtaaatccgttaggtaaaaacattatcttattaaaacgagggatgggaatagggggcagattttctttttttctggcagaagatttattggtgttggtaagagaaggagaagataatttacttgatggtactaccattagttcttttaggggtccattattgacgaatctaatatttgaccatataatatcatatgagtttaactaaattagaaaaatcctgtgaacgggacgagtagcaaggctcaaggccccaagcgagccggggagggtggaagcccggcggtcgtggctttggcgaaaatcccccgggaggaggcgacccaaaggcgaaaagcccagtaggtttgcccggcgcctgtgccgttattttaacgaagtgaccggatttttccggtaatttgggtggtaccgcggtgtaaagccgtcccttaacctttttgggttaagggattttttatttgggttacaagcgcttaataataaaatttatgccataaaggagaggatagaggaaatggactacggaaaaaccttaaatcttcccgttaccgattttccaatgcggggaaatcttccggaacgggaaccggaaattttggcttactggcaaaaaattgacctttaccggaaggtacagcaaaaaaatgaagggcgtccgaagtttatcctgcacgatggtcctccctatgccaatggcgatattcatatgggccatgttttaaataaagtcttaaaagatatgattgtgaaatttaaaagtatggatggttatgatgcaccgtatgtgccgggctgggatacccacgggcttcccattgaacagcgggccataaaagatcttgggattaaccgtaaggaaataagtcccttagagtttcgggctaaatgccgggagtatgcggaaaaatatgctcggatccaaaaggaacagtttaaacgcctcggggtacggggagactgggaaaatccctatcttacccttatgccccactacgaggccaagcaaattgaaattttcggggaaatggcgaaaaaaggttatatttataaaggtttaaaaccggtttactggtgtccggtttgtgagaccgctttagcggaagcggaaatcgagtatgctgagaaaaaatcaccgtctatttatgtgcgctttaaggtggtagagggtaagggaaaagtgccggaagatgcttatctagtaatctggactaccacaccctggacccttccggctaacgtggccattgccgtccacccggaatttacttatgctttggttaaaaccgaaaaaggtgattatgtggtagccgaggggttagttcagcaattttttgaggcaacaaaactcaccggagaaatagttgcccgttttaaaggggaagagctgttgggagtagtgacccggcatccgtttatcgagcgggaatctccggtggtattagctgattatgttaccctggaatccggtaccggtcttgtccataccgcgccaggccatggtaccgaagacttcgaaaccgggaaaaaatataaccttccggtgctttcaccggtaaaccaccagggagtttttaccgaaggtgcgggaaaatatgcggggatgaaaattgatgatggcaacaaagccattacccaggatttagaagcttccggagatttactggcaatgtcgtttattaagcactcatatccccactgctggcggtgtaaaaacccggtgatttttagggctaccgagcagtggtttgcttccattgatggctttagagaacaggctttaaaagaaattgaaaaggtcgaatggatccctgcctggggtaaagataggatttacaacatggtgcgcgaccggggtgattggtgtatttcccggcaaagaacctggggcgtgccgataccgattttttactgtgaagcctgcggcaaggaaattattaccgatgaaagcatcaaagcggtttccgatttattccgcgtcgagggaagcgatgcctggtggaaatacgaggccggggaaattctccccgatggttttagatgtccccattgtggaggggtgaaattccgtaaggaaaccgatatcatggacgtctggtttgattccggttccagccatgcggcggttttagagcagccggaatactggccggatttgcgctggccggctgacctttatttagagggttcggaccagcaccggggctggtttaactcttccctttctactgccgttgctaccagagggatggcaccttataaagcggttttaacccatggctttttggtggacgaaaaggggaggaaaatgtccaagtctttaggcaatgtggtagatcccctgaaagttattaaagaactgggagcggatattttgcggctctgggtggcatcggctgattaccgctccgacttagcaatttccaataacattttaaaacagaccgccgaaggctaccggaagattagaaataccattcggttcttactggggaacctctatgattacgaccatgaaaaacaccgggtaccttatgagcggctgttagaaattgaccgctgggcccttgccaagctccatcgcttaattgcccgggtggtaagagcttatcgggattatgagtttcacgtagtattccatgcggttcataacttctgtacggtcgatatgagcgcaatttatttagatattattaaagacagactttatgttgaactgccggatagcgaaaaacgccgttcagcccagacggtgctgtatgaaatccttgatagccttttacggctactgacaccgattttggcttttaccaccgaagaagcctatcgccatttcccggccaaaggcaaaaaagagtcggtgcagcttttagacatgccgaaagttgaagagagatatctggatttaactttagaagagacctgggataaaatcttagaggttcgagctaaagtcttaaaagctttagaaattgcccggcaggaaaagttaataggccacagtcttgatgcctgggtaactttaaaggcttcgggcgaactttacgactttttagtagagcgggtaaatatgtggccggaaattttcattgtttcccaggttgatattcaaaacgaggaagttaccggagaaaacggtgaattacctttagaagttgtggtgaacaaagctttaggagaaaagtgccagcgttgctggatgtattcccctgaagtgggattggatccggaatttccggatacctgtccgcgctgtgctggagtcctgcacgagttaaaaaaccgtccgctgtagcgggcggttttttgtctataggtatgaaaattttgttttgcggtaatactaccaataaaattaccgcggtgcggaggggatacgatgaattgtccgatttgtggtggacgggctaccggaaaggtgggaaccgaccagtatttttgctggaattgttgtgttgaataccggataaataaagaaggggtgcaaatttttgaattgggcgaggatggaagcctcatggcctttgatccttacaatcagcaactgtactaaaagggagcaagggaggtagcattatgcggcggaatttttggagtggccttttagccggaagccttttgggtatgacattgctggcatcggtagccaaccggcgggagggccggaagcttatgcgggaaggcactaaagcccgtaagaaattaatgcggttgtatgatgatttgaccgatttatggaaataggtgagagagtgttcccaaaatttctttatttctttctaagagtagcagggattgttgttgcccttatctttttttatcggataagggcagtttttttcccttttattttagcgggatttttagcttatcttttgcactggccggtagaatggcttgaacgaaaaaaaattaatcggggctttggtatatttctactttacctggtgctgggtataatgatttttcttattacaaaattttttctgccgtcttttataaagcaaatcaatgagttaatagctgttcttccgggttacttgaatcaagtgcaggagtttttggatcgacagcaggcgggaattgaccggggtagtcttcccccggaaataaaaaagagccttctaatccaaatagattctttagaaaaaagcgtagcggggattttaaagagccttttagctaccctgtggggaatatcttcccatctttttgattttcttttagctccgattcttgcctattatattttaaaagatgtccataatttaaaaaaaaatattctgggttatttacccgttgatttccgggatgaagcgattatttttcttaaggtctgtgaccacgtttttgggcgttttatcaaaggccatttgttaatttgcctaacggtgggtatactaaccggtttaattctttatatattaaagataccttacagttttctcctggggctattagccggaattatggagttggttccttattttggaccaattttagctagtattcccattttagctcttgctcttttgaagggaaaggttttatttataaaaactttattagcaatagttttaattcaacagatagaaggaaacgtcttagccccgaaaattttgggagatagccttggattacatccccttaccgttatttttttactcctttgcggttttaatttaggaggggttttgggcatgattttagcagtcccggttgctgcagttgttcgcaatttatattttctctttcgctggcgggggaatagccttgaagttgacagtaaaaattttggtaaagtataattagataaagttaaaaccgtttgaatgggggaaattttgtgttagcgcgcgaaatccgggaaaagttcttgaaatttttcgaaagcaaaggtcataagattttgcccagtgcttcccttattcctgcaaatgacccaagtcttttgtggacggcagcagggatggtgccttttaagccttattttaccggagcggcggttccggaggtaaggagagttactacttgccagaagtgtctcaggactcccgacattgagtcggtaggacggactgcccgccaccatacgttttttgagatgcttggtaacttttcctttggggattattttaagaaagaagcgattacctgggcctgggaatttgttaccgaacatttgggcatatccaaagataaattatacataacgatttatttggatgatgatgaggcttttgatatctggcacaacgtggtgggggttccggcggagcgtataacccgccttggaaaagataccaacttctgggagattggggtaggaccctgcggaccatgttcggaaatttatgttgacctgggcccagaaaagggttgtggcagccctgactgcggtgtggcgtgtgattgtggtcgctttttggaaatctggaacctggtgtttatccagtttttccgggatgaacaggggaactatactcctttagagcaaaaagggatcgataccggcatggggttggaacgagtggcgtcggttttgcaaggggtaccttccaactttgataccgatattttccgggaaataatggattatgccgctcaaatccttggggtcaaatacggttacgatgaaaaggtagatgtggctttaaaggtgattgccgaccatacccgggcaattacctttgccattaccgatggagcccttccttccaatgaaggccggggatatgtgattagacgcttgcttcgccgggcgctgcgctttggccggcttttagaccgggaggagccgtttttacacttagtagctgccaaagtaatagagcagatgggcgatgtgtacccggaattaagggaaaaagcagaacatactttaaaaatcattaaacttgaagaagaaaagttcagggaaactcttaatcagggactatcaatgttagcagaactgatggagcgcttgacacaggaaggaaaaaaggaaattcccggacatcttgcttttaaactttatgatacttacggttttcccattgagttaaccaaggagatcgccgaggaaaaaggttttacggttgatgaggaaggctttaaacagcaaatggaagaacagcgccggcgggcccgggaagcacgggaagatgtggattatttatctaccagggatgcattcttaaaacaattgaaagaagaactgggagaggtaacttttgtcggctatgagaagctttcggaatcgacagagataattgccatcattaaaaacggtcaaaaggttgaaagcttagcagcggaagaggaaggagagattattacccgggtaactcccttttaccccgaagggggtggacaggtagccgataaaggcgaaattttaggtgacggttttaaactttcggttttggatgtagaaaagcctttaagtgattttatccttcacaaggttaaagttgttgagggcagtgtaaaagtgggcgataaagccactttgatggtggatgaaaccacccgcatgagtactgcccgcaaccataccgccacccacctgctccacaaagccttaaaaatggtgttgggtgaacatgtaaatcaggcgggttcgctggttactccggaacggttgcgctttgactttacccattttgagggagttagtgacgaagacctccggaaaattgaaaatattgttaatgaggcaattttacgaaatcttttagtgcaaattgattacaccaccttagatgaagcgcgcaaagcaggagttattgccctctttgacgaaaaatacggcgacctcgttcgggttgttaaaataggtgaattttccgcagaactctgtggtggaacccatgtttcttctacgggggtaataggtttctttaaaatcttgggcgagagcagtatcggtgccggggtacggcgcatagaagccctgactggccttggagctttagaatacgtaagaagtttggaagataccctgcaaaaggctacagaaccttataaatgcacttttgccgaattaccggagaaaataagcaatactttaaaaaccctgaaggaaaaagaccgggaaattgaagctcttatgcaaaaaattgcgtccattgaagttaaaagtttacttaactccgtacgggagataaagggagttaaggttctttcggccataattgatggggccgatatggagggacttagaaaagcttacgatgtggtgaaggcttccctggccaattacgttgttttattagcgggggttaaggatggaaaagtgaacttcctggcgggcgtggataaaaaccttaccgataaatatcacgccggtgaactggtaaaggaagcggcaaaaatcgccggaggcggcggtggtgggagaccggatatggcccaggcgggcggaaagaatccggaaaaagttaaggaagctttacaggtaatagacgcctacgttcagtcaaaataactttagcggtataaacccctcttttttggggaaaattcccctaaaggggggcttttcttatgaaaatacgctgtcaatccgactgctggcatcagataaacggttactgcaatcaggaaaaagtctggctgaaacaggaaggtcttagggtagtgtgccgggattatgaccgaaaaatgcccgaaaaagatactaccaccgtcttttattaccactataacgataacctctggacttaaagaaaatttttttggtttacaggaaatgtctttaaagatgccgaataatatatataagatttggcgcagaaaagggggtgcttatcattgggtgaagatatggaaaaaaccatgcgctttggttttgataaagaaaaaaacaccaagcataaagcccttttacttaccatttatgaagcgttgcaggaaaaaggttataatccgataaatcaactggtgggataccttttatcaggagatccggcgtacattaccagtcataaaaacgcccggaatttaattcgcaaaattgaacgggatgaattactggaagagcttttaaaagtgtacttggaaagggaataaaaattggaaagaagggttcttggaagaacgggaattgaagtttcgcggctttgctttggagctctaacaattggaccgctgcaaagaaatttgcccttaaaggaaggagcccggcttatacgccttgctatagaaaacggggtaaattttattgataccgcagagctttaccaaacctacccgtatatcagaagggcattaaaaggtttgcccccggatcaggtggtaattgccacaaaatcgtatgcggcaacagctcaagctatggagaaaagccttaaggaagctttaacttccctggggcgggattatatagatatttttctcttacacgagcaggagtcgtattttaccttaaaggggcatgaagaggcccttttttatctccaaaaggccaaggaaaaaggctatgttcgggcagtaggtatttctactcattttattgccggggtaagggcgggaatgatgcatcctgccgtggaagtgattcatcctctgataaattaccgcggcataggtattgccgatggcacggctgaggaaatgcttgcagctatttctgaagcttatctcatgggtaaagggctttatggtatgaagcctttaggtggcgggcatttgggaagcgattttaaaaaagcttttgacttcgttctggggataaaagaactttccgcaattgctgtggggatgaaatcggaaattgaggtaattgctaatataaactactttcaaaaaagtgaaattgatggtaagatagaagagagtttaaaaaaaactgccaggaagcttcatattgaaagctggtgccagggctgtggacgttgtgttaaagtctgttcccagaaagctttaacgctgggaccgaagggcaaagtgcgggtaaatcaggagaaatgccttttttgcggatactgtggtgctcactgtcctcattttgccatcaaagtaatttaacccggcgggtggatggatgaaagttttaggactggatgttggagataaaaaaattggggttgcgctgtccgatgaacttggccttacggctcaaggattaacggttatttaccggacaagcttaaaaaaagatttggaggaaataaaaaaaatcattgacctgcatcatgttaccgaagttgttattggttacccgcgcaatatgaacgggactgcaggaccccgggcggagctggttaagcggtttgcccgggagctttacaaatttacagggattaaacccgttttttgggatgaacgtttatctaccgtggaagcggaaaagctattaataagcggagatatcagccgccggaagcgaaaaaaggtaattgataagctggcggcaacgctcatcctttcgggttatctaaattataaaagtaaaaattagaaagaggtggaatctatggaagtaggcgaagtaattaccctcgttgatgaggaacaaaatgaatttgaatttgccgtcattgaccttcttgaagttgaaggcaagaagtacgcaatcttggttccggcagtggaggaagacgaagaagagttagaagatgaagaagaagcggtgatcctccgtttagagatggacgaggatggtaacgaaattttagttgacctggaagatgaagaatgggaaatggttgccgatgcctggaccgaaaaaatggaagatgaaggttcagatgagtaaaaagaaagcttttaaagctttctttttttgtggcataaaaggaaaaaaagaaaaaacgtagtattatataacggtaccaaattattagtttaggtggggaaaaatgaaaaagagctacataattttaactgtattaattgccctggtgattatgtttttagctggcattgtgggtttttcttactatacctacataaagccttaccaggggaaaatcgcgtacggcgtgaccgtggaaggtgagccggtagggggcatgacttttaaggaatttaaacgttacttggagggattaaataacgaacttcaaaatcaaccggtagtgctaacccttggtaataaaacctggacttataaaaaaggcgaccttggtatatcgttaaataccgctgaaatgtaccggaaagcttatgaattagggcgtaaaggttcgttattaaaacaaattatggaaagacggcaattaaacaaagcagcagtcgatataaaatatcttgttcgacttgaggaaagaaagcttttggccaagcttgaccaaatcaataaggaaatttatgtcgaacccaaaaacgcggagtttcgccttttgcccaatgaaacttttgccataattccccataaaacaggtattgccctggatagtgaacaggctgttaaagatgtgcgggcaaatttactggaaaatcctctaaaagtaagttttaagttaaaagaagtattgccggacaaaaccaccgaagacataaaaaagatgcgtttaaccggtcttttagcaagttttaccacgagctttgatgtcaggaaagttaaccggtcttataatattggagtagctgccggaaagctaaacggtattttaatagctccgggggaagtgttttcctttaataaaacggtgggcccgaggagtgccaaagaaggatataaaaatgccccggtgattttacgggaccagttggtagaagcgctgggcggtggggtttgtcaggtatcgacaactctttataatgcggttttgctggccaatttaccgattgttgagcggcataaccattccctgccggtagcgtatgtgccgccgggtcgggatgcgacggtaaccgacgggggcaaagactttaaatttaaaaataacctgccctgttacttgtatattaaatcttacgttaacggcaatcggattacctttaaaatctttggggatgccagcttaaaaaagcacgtggtgattaaaagctgggttacgaaaactattccttataagacaattatcataaaagactcaagccttcccgaagggaaaaaggttgttaaacaggaaggagcccttggcaagtatgccaaagcccagcgaatagtctaccaaaacggccgggtagtaaaagtggaaaacttaagggacagttactacaaaccaatgaatgaaattatcctggtaggaaccaagaaagttccaaactcttctgcaaaggaaagttcagtaacggaaaatgtttattaatatttagaggagaggattggatgattttagttaccggtggagctggttatattggttctcacatagttcggcagttatgcctaaaaaatgaaaaagttttggtagtggataatctttctaaagggcataagaaagctgtggatacaagggctaagcttattgtgggcgatttcggggatgaaaacctccttctggaaattttcaagaaatatgatataaaagcggttattcacatggcggcgcaaagtttagtgggggaatcaatgagccagccggaaaaatattttgaggaaaatatcagtaaaaccctgagtttgttaaaagtaatgctcaaagctaatgttaagaaaatggtgttttccagtactgcagcggtttacggagaaccggaaaaatggccgataaccgaagattttccgcaaaaaccaaccaatgtttacggttattccaaactggtaattgagcagtgccttgagtggtatcgccaaatacatggttttaattacgtatctttacggtattttaatgctgccggggcagacccttccggggatattggggaagaccacaatccggaaacccacttaattcccctgattttcaaagtaattttaggagaacaggaagagttgacggtttttgggaccgattatcccaccccggatggcacttgtatccgggattatattcacgtaaacgaccttgccgaggcccatattctggctttaaataaactcaataaagacgaaagcggcgtttacaatctcgggaaccaaaaaggtttttccgtaaaagaaataattaaggtcgcagaagaagttaccggggtaaaagttaaagttcgttacggccagcgtcgtcccggagatccggcggttttggtggcttcttcggaaaaaattcagaaagaactcaattttactcccaaatttggagacattaaaactatcgtccaaactgcctgggagtggcacaaaaacaatccccgggggtatgaccggtaaatgtccaagaaaatagtattaaaagccacccttttaataatggctttaacattaaccagcaggattctgggttttgtccgggagatggccattgcttccgttttcggggcaagtaagcttgtggatgcttatcttgctgcgcaaattatcccgacgttttttgccagtttcataggtggcgggctgatggtggtagttgtaccgataattaacgaatttttggcgcaaaaaaaacatcaagaagcaacatatgttaccaactctatcctaacgctatcttttttggcccttggaattattatggttatcggagtttttactgcgccttctttaataaaatttgttggttatgggtttcagggggatactctaaaacttgcccggaccctctccacctggctttttcccctggcagttttaatgagtttgacccaaattttaaccggagtattaaatgcttaccagcatttttttacaccggccttgggaccggtgttaaacaatgtggttttaatagccgcagtcatcctgcttgggaaaagccagggaattgttgctctggtagggggaacgttagccggctggactatttaccttttaattatgcttccggcgtttaagaaaactggcttttattttaggccggttttagatatccaccatccggcagtagtaagggcctgggagatgtttttgccggtaatcattggtaccaccttcactcaaataaatttactggtagaccggatgctggcgtcatcccttacggaaggcagcatttctgctttaaactatgcggcaaagctctaccagctgccactgggcttgatttccctggcagtttcaagtgccatctttccgagtctttcaattttggcggcccaaggagaaaaaacgaggcttttagaacttacccgctttggcttaaagctgagcacggtaatttccctgccggctcaggtgggacttatggttttagcaacacccattgtggcggtgctttttgaacggggggcttttgatgcccgggctaccgagttaacggctggcgcccttttcttttatagcttagcaatcgttttttacgttatcaatgcggtattaaccagacttttttatgcccagaatgacacccttacccctttaaaagtgggggctttagcggttctgggaaatatcggggcgaatcttattttagtccgttttcttgcccaccgggggcttgctttggggacaagttttgcggcaattttaagtaatgttctcttcttttattttgcccaaaaaaaaattggcaatttgtttgaccgggaaatgcaaagcttctttcttaaatcattagctgcctctcttttaatgggaataggtgcttataaaatatacgattggttattatttgagggacgggccgttgctttatttaccgctattttgttcggggtaaccctgtattttgttttgcttgtggtttttggggtggaagaggtaaaatatattaaaaagctttttttaaaatttaaggcaaagctttctttataaaattaaattctttttttatttgctgattgtaaaaagaaatgatatttcgctggttttccaagatttttacgtagcttatacttgctctggggatgtaagtcccttgaattaagcggttttttgcaaatggtaggaaatgctgggtaaattgttgagaaaagagtggtaaaaggtgaaaaaactcctttatagcataacagcttcagcattggtagttctggcggtttttttgggcttttggtcctggtggcaggaaaatatggctcctgtaaaccctgacgaccataaacttgtggtggttaatataaaaaaaggtatgtcaccggagacaattgctcgaattttaaaggaaaaagagttaattaaaagtgaaacggcttttcttctttaccttcgttatcacaggctgaatttaaaattacaggcgggaacctatgcgttaacgaaaagtatgactacgccggaaattgttaaaacggtagtggaaggtaaaagtttaacttttaaaattaccattcctgaaggttacaacgtggccaaaatagcaaagttaatggcaagctttggttttaatgaaaaaaaggttttagctttggccaaaaaccctccttatgattatccttatttgaaagaaataccggacaatgtccagtataaacttgaagggtatctttttcctgcaacttacgaaatttcctataccgatactgaagaaaaaattatcggtaggatgttaaaaaaatttaacagtattgttgaggaagaaaaccttataaaagaagcccaaaaacgggggtttactttacatcagctgctaactttagcgtctcttatcgagctggaagccaaaaaggcatcggaaaggccgttaatttccggggtaatttacaatcgcttgcaaaaagggatgctcttggaactttgccccacggtggaatatgcgctggggcgccataaactacggctttcagcagaggatttaaaaatagaatcgccctataatacctataaataccggggattacccccggggcccattgctaaccccggactttcttccattaaagcggcgttaaatcccgcaaaacacgactatcttttttatgtagcccgaccggatggttatcatgcttttgccagaacttatcaagagcatttgcaaaacgtaaaaaaatatctgccttaaggaggcagtttatgaactacgagattttagctccggcaggaaatttggaaaaacttatttttgcctttgtctatggtgccgatgctgcttatttagccggaccaaaatacggtcttcgggcccgagccggaaattttacctgggaagaattaaaaaaagcccgggaaatagcccgggagctcaaccgtaaaatttatattaccattaacatttttgcccataataaagatcttgaagaacttccggactatctggagtatttaaataagataaagccggacggggtaattgtggccgatccgggggtttttcgcctggtaaaaaggtatcttccggagataccaatccacatcagcacccaggccaatactaccaatattgaagctgtaaaattctgggaagagctgggggccaaaaggatagttttagcgcgggagctaactctggaggagattgccgaaattcgtcaaaatacggcaatggaactggaaatgtttgttcatggcgccatgtgcatttcctactccggaaggtgtcttttaagcagttaccttaccggacgggatgccaacctgggggattgtgcccaggtttgccgctggccttttcatctctatgaagaaaaagctcccggtcagttttttcccattgaagaagacgagcggggaagctatatttttaactcttatgatctttctttaatcgaagacctgccgaaattggtggaaattgggataaatagctttaaaatcgaaggacggatgaaatcggttcattatgtggcaactacggcgcgaatttataaagaagctttaaccctggctttagaagggaaaactctctcaccggaaaagcagaacgaacttttaaaaatacgccaccggccttacaataaaggctttttgtacggaaaaccgcagcagggaagggtggatgaaaaaaattataccctggaatacgaatttgtgggcatcgtttggggctttcaagatggcttaaattatgcggagcagcggggaaagattgaaaagggagattatctggaaatctttacccccgacggcctaacggtaagggggatagcgcaaaaactttatgatgaagaacaaagggaaattccttcaactccccatccgcagatgcgcttttattttgcagggtttccgccgctcccgaaatacagtttaattcgcaaggttcccaggggggtttacaatgagtgaaaaagaaatggtgctcgttgaggtaaacccgagcgaaattgtttatctggactttcttttagaagggtttaatggccttggcattgggcatacccttgatccgaaaattgctcgtgttgctatttacactacttcttccatgaaggcggaacttatctcaaccttaaaaaaactgcctattaacgtaacccttatcggtgaagaataaaaccggtaggggtttttacgtaaatagcgaaattttcgctaaaaatcgttgactattttagtataagtaatataagataatagtataatcaaaaaatgtaaaaagaggtgtaggaaatgacggtaaagggaaataaaattcgcgagctcagggaagagcgcggacttaccttaaatgaactttccaaaaaagcgggtctttcaatttcctacttgagcgaaattgaaaggggttccaaaaagccgtcattaaaaaccattgacaaaattgccaaagctttaaacgttaataaagcgcaaattttggaaaccgagcaattggaagtaagcctaactttaggcgagcgaattcgcttgataagggaagaaaaaaagcttaccataagcgaacttgcggcgcgggtgggcatatcggtttcctatttaagtgaaattgaaagggatacggtgaacccttccgttgctaccttacgccggattgcggaagaattaggtgtatcggtagccgatttaatggggaaggaacattcccttggttacaagttaaaaaagttaagggaagatatgggccttacccaggcggaattagccagtcaggcgggggtttctccgggattaattggccagatagaacaggggaaagttcaaccttcgctaaaaactatcgaaaaattggcggaagtattgggaacaactccttgttactttattttggaacaaacctctccggaacaaatgttaaatttaatgagtccggaattaagggagcttttgctaaatcccaacgttcaatcgttattgagcagtatttgtaccttgaatgaaaaggaactccagtttattttaaactttatccagctgtttaaaaaatcaggggtaatggaagaataaattttacacatatattattgacagcgaaaaatttttatactataatcgtaaagtgtcggagggaggttaaaaatgccaaggtacgattttcgttgtgaagactgtggcgaaaaatttactgcctgggcttccataaacgaccgggataaagtagtttgtccaaaatgtgaaagtaaccgcgtaaaacaacttttaacgggatttggcatcataggcggaagccagagtagcagctctttaagttctgccggaagttcgggctgtacttcctttggctgaggaatataagcagtttagcccgggaggctaaaatttatggataaaaaagcgaaattacaggaattggaaaaacggtatcaggatcttttagcgcgctggccggctcattcggtgaagccggaaatgattatcgaaaaagaagaactggaagacgaaatagctgagctcaaaaaggctattgcggaagaaaagatgggtcatgtttttgatccgcaaaatcggcataggttaaaaaacgaaaaacgaaaaaaaatcctgccccccgaggagacggtggccaaactgccgctaaatcccggggaggttattttagactacggtgcggggattggttattttaccgtacctcttgctaaaagaaccgggagctcgggggtggtttatgccgttgatatttcccccgagattataaaagacctggaagaagaagtgttaaaagagggacttacaaatgttaaaacagctttagttcccggggatgggagtctaccggaagagtttccggagtttgatgtaatttttttagcaacggtgttgcacgagctttcggaaaaagaagcggttttatccgcattgacccaaaaactgaaaaaacagggtaagctaattatcattgactgggaaaagaaagaaaccgaatttggccctccggtagcccacagggtttctgtggaggaggcggtttcttatcttgaaaaagctggtttaaagctactgcagaagatgaacgtaagtgcagctcactggggtataatagggataaaagaataaaaggaggaggtctttatggttttaaagtttaccgatgccaattttgaagatgaagtaattaattccgatatgccggtattagtagatttttgggcggagtggtgtggtccgtgccggatgattgcccccatcatcgaaagactggcgattgattatctcggtcaggttaaagttggcaagctaaatgttgatgaaaaccgggaaacggctattgctcttggaatcatgagcattcctacggtaatgatttttaaagatggaaaggtgcttgataccattatcggttatcagccggaaaacgtctttcgcgagaaaatagaaaaagcgttaaaaaagtaggttaaaaacgtaattgagaaaagggagaatcttaaggtgtttgccaaaaaacaagcggtaataatttacgagcggtgcaaaaactgtgaagtttgtgaaccccaggagaagtgtccggcctacgccatcattaaggaagacgatgaatattacatcggaccctcctgtcaggggtgcggttactgccgtaagttttgcccttataatgctattgagcttaccagttaggtgattaaattgttagaaaagattatagctcgttacgaaaaggaatccggtgaaggtctttcctgcggcaacaatatagcggtgggaagcttaaaaccgggcatgatagtactggatttgggatgcggcaatgggggagaaacaattagagctgcacaaattgttgctccggggtttgccgttggacttgatattaccgaaaaacttttagaaaaagggcaaaaaaaagcccgggaacagggagttaaaaacgttgtttttatcaaaggtgaaatagaaaacttaccctttgtcggggaaagctttgatgtggtaatttccaattgtgctttaaatcatgcccgggataagttaaaagtataccgggagatttacagggttttaaaggaagacggctattttattgtatccgacccggttagcctggtggaacttccaccggaaataaaaaataacgaggaactctgggcccagtgttttgctggagcggaagaagagtcgaagtatttacgctacattatcgaagccgggtttactttggagattttaaaaagaagggaatacgaaaaaaacggctatccttttgccagtcttaccattaaaggtaccaagaaaaggaggtgaaatcatgaaagctattaccagaaaacaaaccgcaaagtgtgactacaaccttgggtgcgctcagtgctgctccaagacctccaaggtggttgcgggttgccacgactaagttttatccggaaaagaggagataaccatgtattttagtaagtataacttaattttaccctttgcagataattacttacttttaaatcctctttccggagcggtggatttgctggaagaaagcgattaccaacttttagaggagctaagaaaaagctcctctaaaaattttgaccggcaatttatcgcttacctccgggaaagaggttatatatatgaagatgaaggggaagaagaggagaaattaaccgaaacctttaaagaattcttggagataaacaatacctcccctacccagattttttttgtaccaacttacaactgtaatttagcgtgcagttactgttttcagcaggggattaaagataaaaaagatttaccaacaaaagaggttttggatgccttttttaattacgtaaatcaaaattttaaaaacgagccggaaaagccgtttttaactttatttggcggtgaaccgttaattgcttcggaataccaaaaagaagttatagcttactttctctatcaggcgaagattaacgggtatgaagtttcaatagttaccaacggttatgcccttaaggagtacatgccaattttaacaaagggcgtaattaaagaagtgcaaattaccgttgacggaccaccggaaattcacgaccagcggcgggttaccaaaggcggcggtaaaacctttgacaggatttttgaagggctgcttcttttaaaagaagcgggcattcctatcaacctgcgggcagtggtggataaaagcaatcttataaccctggttgaactggctaaacttcttgacgagaacggatttttggatttacccaaaagcaagtttaaaacccagatagggagaaattacgagctgtttgaatgccaggaccagagtcaaaatctgtatgaccgcttagctctctgggcagaatatgccaagctctctaaacaatatccgattttacaaaaattccaccttccagaatttaaaggagtaaagtacctggtggataacggggagatgccttttcccacttatgataactgcccggcatttaaaaaagaatgggcttttgattatcagggaaaaatttatggctgcaccgccaatgtaggccgggaggagttcatggtaggaactttttatccggaagttcgccttgatgaagaaaaaatcaaaccctggcaaaagcggtcaattttgactatcccaaaatgccgggaatgcgaagtggcccttttgtgtggtggcggttgcggtaccgttgcttacaaccgggaaaaaaccgttttagcaccggactgccggccaattcgcgagctctgggaaatcggagtaaattactacagcaaagaaattaaagccttaggagagaactaaatatggcgtataccgaaggctgtctgatttgcggtgccgagattacttaccaggaggaaccggcggagaaaacctgcaccatttgcgggaaaaaagaattaagtcaggcccagtgcagtcaaggacattttgtttgcagtgactgccaccggggggaacatttaaagactatcataaatttttgtcaaaacactgattggcaaaatccggtggatatctttgattatcttacccaggtgccgggttttcccctgcacggtccagaacaccatgctttaactgcagcaagtttaattgccgcttatcagaatattaccgggcagaaaaatcccagagccattcgggatgcggtggtacgggctaaacagttagtgggcggtagttgcgggctctggggggcctgcagttcagctctgggtgcaggaattgccttttcgataatttttggtaatactccgttgtcccgggaaagatggggggatgctaaccgggctaccggtaaaatcctggaaaaaatcggcgctatcggtggtccaagatgctgcaaaaggacttcttatttaagcttaataaacggagctaaaatcttagaacagcttactggaataaaatttcagctaaccacacctaaatgtatgtttagccgtcgtaataaagagtgcttaaaagaaaaatgccccttttatcccggatgattgataaattttcggggaaaataagaaaaaatcgtattaagggggtaattaaatgaccgaattaattttaacaccggaagaaagagaagttttattaaaagctattgaccattgtttaaatacgtgtaaatccgggggagcagcaagtggatgcccggactgcgagaccctggaaaaaataaagcaaaagctctaaaaatttaaactcaagggggagaggaaaatgagcgacaaagttatatatttaagccaagaacagtttgacgaagtggtattaaaaagcgatgttccggtaattgtggatttttattccgaagattgtccaccctgcgaggcactggctccggcttacgagaagcttgcccagcagtacggggataaatttaagtttgtcaaaatctaccggcagcaaaaccgacctttagccgaaaagctgggagttaagggtagccccacagttctgttttatgtcaacgggcaagaagtgggccagaggttaaccggctatatttccaagcgtcagctaagggaagccatggaaaaagcttttggccagaaacttttgccggaagttccggaaacggttaagtatgatgttattgttcttggtggcggtccggcaggtttaagtgcggctctgtataccgcccgggccaagttaagaaccattgtggtggatgaaagtgttcccggtggccaggcggctaccacctaccatattgctaactaccccggtacccccggaacgattagaggtaaggaactaactcaaaatatgcttaatcaggccttagcttttggtgcagaagttgatgatttaaaagaagtattaaaagttgaattaaccggagaggttaagagggttatcaccgaagataagatttatgaagctccggccatcattttagccaccggagcagaaccaagaaaacttccggcggaaggggaagaccttttccggggccgcggcgtccactactgtgctacctgtgatggggcaatgtaccagggcatgaaagtagtggtggttggcggtggcaactcagccgtagaagaagcggtatttttgacccgttttgccaccgaagttacgattattcaccagtttgaccacttccaggcttccaaagttgcccaggaagaagcttttgccaatcccaaaataaaggttatctgggattcggaagtacgtaaggttgttggggataaacatgtaaccggcgttgtgattgaaaatctgaaaaccaaagaactttctaccgtgcctaccgatggggtgtttgtttacattggaactcagcctaaaaccaatttgtttgccggacaggtagagatgaacgaatggggttatattattaccgatgaagaaatgcggaccaatataccgggagtttttgcggcgggagatttaaggcagaagtcagtacggcaggcggtaaccgctgcggccgatggggtaattgcggcagtaaatgtggagagatatcttgccagtaaaaagtaaatttagtattattgaaaaggggcacctccgcgggtgcccttaaataatagtttattggtataataagattaataccccccgttaaacatagatgtgttataagttataaaaaagtgaaatgaaagggagatgaggagatgaatataacttttaccgaagaagctaaaaaatatttggaaggaaaaaatgataccattagaattgaatttatggcttacggaggtgggtgatgcccggtacagcaattgcccaccgtgtttgtgggaaaaccgcaggatgaacgattttttaatctttatgaagtagaaggaattaaggtctatgtgccgaaaaatacaatagcggttaaagatccggttaaaatctaccttgaaggcaagtggatgtttcagcgcttagaggttgatggtcttgatcttgcttaatatttcttaggggggtattctcttgcctttaaaaaagattttcctcttcacagcggtaattttagtggtggttagtagttttccagccctgggagaagtggaccaagacgttttaaacgatgtaattcatactttttgggctccggatttttgtggtatgaacctggccgattgtccggcttcttccgctgaagaaatgcggaatcaaattaaagaaatgttggaacagggaaaaaccaaacaggaaataataaattactacacaaacctttacggtaccaaaattttagcggaacctcccaaaacgggtgtatatgcggcaatttgggttatgccggcaattgcggtagttgccggcggtgtattagtttacaccgtggtcaagaaacgccggaaggaagtaaaggtggaggagaagaaagagctaacggtagatgacgaccttagtttggaagtggaaaaggagttgaagaaatatttataagtggctaacacttggcatttctccagtggctttaaagattggctcgctggaaattcgctggtacggagttttgatggcgataagtgtattgattggtacttatcttgctttaaaagaagcaaaacggaaaaatatccatgaggaccatatttacaacttggttttactcggagctccaatagggtggattggagcccggatctggtacgttctctggaactgggattattacagcaagtatccggccgagattccggctatctggcatggcgggcttgcctttcacggtggtattttagcggcaatcctagtggggattgtttacgcccggatgaaaaagcagtctttttggcaactggcggatctttttgctcccagcataattttagggcaggcaattggccgctggggaaattattttaaccaggaagcttatggctaccctaccgatcttccctgggctatgtatattgacggtgcctggcgccatcccacctttttatacgaatccctctgggatctgggggtgtttgtttacctctggcaaacccgtaaaaaacaaaggtatagtggcgaaatctttttaaaatatcttctctggtattcggtaggaaggtttattgtagaaggttttcgggtggatagcttttgggttggcccctttcgtttagaacagcttttaagtgtggggttaatcgtatttagccttattatgatgagggtgttggggagaaatgagggagagaattagcagtattctttcggttattactgcggttttagggtgcattacctgagtgggaccggtaatattagcctccttgggtctgggaggagcgtctttttcgttttttgcgccactggccccttaccggagtttctttttagtacttacctttgtttttttaggttacgccttttatgaaacttattttaaaggcaaaagttcgaagttaaacaaaatcgtcctctggtcggcaaccgttttggttgtgatagttttaacttatacttatcgctataccttactaagcttattttctttttaaggggaggggttttgttgccgcggagcaaatatgtattttgggtaataatagttttgctattatttgctttgacggggtgcttaaaagccggttataaggatttagagcccgatgaagccaagaagcttattgatgaaaatccaatgcttttaattatggatgtcagagaaccttatgagtatgccgaagcgcgtattcccggttcccataacattcctatgggagaggtggaacagcagttacccaacattgataaagaacaggaaattttagtggtatgtgaaaccggaagtcggtcggcaagtattgcccagatgctggtgagtaaaggttacaagcatgtttacaatttaaaagggggcattgctaactggccctatgaattggaaaaataaagaaaaacacacacgtccaaagggcgggtgtgttttttgttttaaagcttagctttcgtttaccgcttttaaaattctttcttcatccaaaccaataataacttctttatcgttaataatcaatgtaggtaccgtggtatagccggttgttttaaacatccgctcaaaggcatcaaggtctttcgtaatatcgtaatcggtaaaatttagccctttttcctgaagaaaatttcgcaccaggcgacagtacggacaggtaggggtactgaacaactcaattttagccatgatttttacctccttactcatagtatagctttttccgggggaaaatgataccgaaaaaattttaccacagggtattgacaggcgggagatggttttttaaaataaaaaatgtaaataataactattactaataataaaaaattaatggagggatggttatggatttacagcttattaatgaaaaccaaatcggggttgcgaaagacacagaggctttagcggcggttgaaggtgagtttaaaggtgaaacctatgaagttggagtgtatctggcaatggcccggcaggcggaaagggaaggactgccggaagtagcccgggttttagaaaaaattgccttggaagaagcctggcatgctgcccgttttgctgaacttgccggcaaaatttcgtccagcaccaaggaaaatatcgaaaaaatgctgaaaggtgaaatggaagccaataaaggtaaaaaagaagctgctaaaaaagccaaagaattaggtttggatgaagtgcatgatgctttggacgaatcttcccgggatgaagcaagacatgcccgtgctttaaaaggtttactggataggtactttaaataagaaaaaggtccgggtaaccccgggcttttttctttcttgacagtttcaggaagttttaatataaacttagttatagatagaaaatttttttccgtggatgggggactgcggtgtttggaaattattttgggaaaattattttaagctttttttccttttttctcttaacggttattttgcacgggggatttagagggtatctaaaaagcctttttgtttccctgaaacgattattaacaaccagggagtatttattatattttctggggattcttcttcttttgcttttggatgtgctggaattaaaaggggagagtggttttccttcttcttacctttattcgtactttattgccaaaattgaagctcctctgattataaagttacagagctttcagcctgcttggttagtatttttgttgagctatgtctacgtttttctttttccggttctgtttgctgctatcctttattatggtctgattaacgatcaaaagacattaattgccggacttttttatatttatcttataaactatttagtggccatgcctttttatgttaacctgccggtatatgaagcctggtcgattcacccggggattaaacttttactggtgaaatactaccctcaatttaatgtggagtaccgctccttttccggaattaataacaattttcccagcctccacactgccctttcggttagctttttctatttagcatttaaacttcgagataaaaggcttacgggtgtgctgggggtttcttcgagcttgatagtaatttccaccatttacctggggattcactggataattgacattattgcaggcatctttttgggagttggggtggtctatttttacacctaccaaatagaagagcgggaatttatggtaaatttttacaaaaaattagcttttgcttttttagcaatagtcttttttcttggcggattggttaacggcgctccccatgcggaaaaatattatgcctactttaaacagcaggtgagttacatggagattcaggaaaaagcagcaaccaagctgaaaagtttgtacgatgtttttaaaaatgagttcaaggaatttagcgaccggctgtaattaagccggaattttcttttttaggcaggaattttaaaaagaatagcgaaagcatatagtattttaagaaaaatcaaaatattaaaatattattaaaactggggtgaggagatggaactattagaacagttctggaaaaaagaaaaaagagctctggcccggataatttctttagtagaaaataacgggccggaaaaagaagaagttttggccaaaatttatccccataccgggacagcgcaaatagttgggattaccggggctccgggggcggggaaaagctcattaaccgatagtttaatcgaacttctgcggcgggaagggaaaacggtagcggtggtagcggttgatccttcaagcccgtttaccggcggagctctcttgggggatagaattcgcatgcaaaaccatgcgctggatgaaggggtatttattcgcagtatgggaagtagaggaagccttggaggaatttctgcagccaccaaagatgttgtgaaagttttagacgcctttggttatgattatataattgtggaaacggttggcgtgggtcagggcgaactggatgttatgcatgtggcggacaccgttctggtggtgttaactcctgctgccggtgatagtattcaaaccataaaggcgggtattatggaaattgccgatatttttgtggttaataaagcggacttacccggtgccgggaaaatggtaacggatgtaaatgctatgttagacttaaaaggtgagcagcttgtctggcgtcccccggtagttaaaacgtctaccactaccggcgaaggtctggaagagcttttagaacttattaaaaaacattttgcctttttagcggaaagctctgagttggaaaagcgaagacaggaacgacgggagcgggaaattatcgaaatagccatgaatgccctttaccggaaacttaagtttttactaacggaagaggatattaaacatttaattgagagggtaaaccgcaaagaaattccgccgcaggcggcttctgaggagctcttaaaaaggttgggggtaaggaggtaatgctccatctttactatgggccgggaaaaggaaaaagtaccgctgccctgggaatgcttttaagggcttacggccatggacttaaggtggcgtactttggttttcttaagggcgaagggttttacggggaatttgaaacgcttaagaaattggacattgaaaaatattgccttgggaaaagctgcccttatgcttcgttaattaaaaccggaataaaatcctgtccggtaaaagataactgcaacctttgccacgtaaaccttaaaaatccggacgaggaagataaaaagcttttcctggaaggatttttctgggccaaagctcaaattaacgcttcaccctaccggctggtcgtgatggatgaattagctttagcggcaaagattgatttaattgatgaagagagtttaacatcctttcttaaggagataaaaagaaaagaaaatcttgaaatgattcttaccggacgggaagcgccgctttatctaaaagcttatgccgactacgttacttattttgccgaagagaaacatccttttactgagcttggacttacttcccgaaagggggttgagttttagccaaaaaatcaaccgtttaacctcaaaattttgcagttcacggtaagtttattggaagcagcagctttttggattataacttaaagtagcaaaacattttgaggaggggttttaaatgccaaacatggtcgactatgaaaaaacttaccgtgaatttcggcaccaggtgcccgagtattttaattttgcccgggatacttttgatgtctgggcccaagatccgaataaacttgctatgctctgggtcgatgacttcggcaatgaacggcgttttacttttaaacaattttcagaattatcaaaacaaactgccaatttctttaattttctgggggttaagcagggggaccgaattttagttattttgccgcggttaccggaatggtgggtaatttacctggcggcaattcgggctgggataatttttattccggggactacccagctgacttctaaggatattaaataccgggtggaaacagcggaaacggttatggtgattaccgatgaggataatgcggccaaggtggaagaaattaaaggagagttaccggtattaaaacatctcgtaatcgtcggcaagagggacggatggctttccttaaacgaggagattgctaaatttagtccggagtacgaagctgctaacactaaaagcgatgacccggcgattatctttttcacttcgggaaccaccggctatcccaagatggccgtgcatacccacgccagttacccgataggccactatattaccggaaagtactggctggatttaactcccgatgacctgcactggaatatgtccgataccgggtgggcaaaagcggcctggtccagcttttttgggccgtggatttgcggtgcggcaatttttgtccaccattcggtgggtaaatttgacgctaaaaaaacgttggagcttttagctaaatatcccatcaccaccttctgtggtccgccaaccgcttaccgggtttttgttctggaagatttaaaaaagtataagtttccgcatttacgccattgcgtagctgcgggcgaacctttaaaccccgaggtaatcaaagtgtggaaagaagcaaccgggctaaccatccgggatggttacggccaaacggaaacctgcgtcctggtggcgaacttcccctgttttgaagtaaaacccgggtcgatgggtaaaccggctcccggctattatgtctcgatcattgacgatgaagggaacgaactgccgcccggcaaggaaggtaatattgccattaaagttaaaccggagcggccggtgggactgtttaaagaatactggaaaaatcccgataaaaccgccgaagtgttccggggcgactggtatttaaccggcgaccgggctattaaagatgaggatggctacttctggtttgtgggccgggctgatgatgttatcctggctgccggctaccggataggaccgtttgaggtggaaagcgccctggtggagcatccggcggtggccgaggcggcggtcgtggcgagccccgatgaaatccggggagaaattgtcaaggcgtttgtggtactggccccgggatattctccgtcggaggaactggttaaagaattgcaggagcacgtgaagaaagttaccgctccttataagtacccgcgggaaatcgaatttatcgatgctttacccaaaaccgtttccggtaaaatccgccgggtggagttgagggaaagagagtgggccaaaaagctcggtaaaaagaaataatttaccgtggaaaagggagggagatttatggatgagttaaaaaaagcttatgaagagtggcagaagaagtatcaggaaaaatgccccgataaagatgaagattttgtaaccatttccggtgaaccaataaaaagcctgtatactccccttgatctggaagggcataattacctcgaaaaattaggattccccggggaatatccctttacccggggaatccactacaacatgtaccgggggaaggtctggactttccgccagttttccggctttgccactgccaaggaaaccaatgaacggtacaaaatgcttttagccaaagggcagaccggtttatcggtagcttttgatatgcctaccatcatggggtacgactcggaccacccgcgggccgaaggagaagtgggacgctgcggcgtagcgatcgactcgttggcggacatggaagagctttttgacggaatcccccttgacaaggtgagcacctcgatgaccattaacggtccggcagcggttctctgggcgatgtacattgcctgtgccgaaaagcagggggtaccctcggaaaagctttccggcaccattcaaaacgatatcttgaaagaatatatagcgcagaaatcctggattttcccgccggagccgtccatgcggattatcaccgatatctttgcttacggggccaagcacgtgcccaggtggaatacgataagcatttccggttaccatattcgggaagcaggagccacggcagttcaggaattagcttttaccttagccgatggttttgcttatgtggaggcgggaattaaagccggccttgatgtggatgagtttgctccgagactttccttcttcttcaattcgcacatggatttctttgaagaaatagctaaatttagagcggcccggcgcatctgggcccgccggatgaaagagaagtatggagctaagaatccgcggtcctggcttttaagatttcacacccagacggcgggctgcagtttaaccgcccagcagccggaaaataatattgtgcgtacagcctttgaggctttggctgcagttttagggggtacccagtccctccataccaactccatggatgaagttttagcactgcctaccgaaaaagcggtcaccatagctttaagaacgcagcaaataattgcccacgaaaccggtgtcattaacaccattgatcccttgggcggttcgtattatgtggaagcgttaaccgataaaatggaggaggaagcggaaaaatatttcaagaaaattgaggaactgggcggagttatcgaagccattaacaaaggtttcttccagcaggaaattgccgatgcggcttatcgttaccagcaggcggtggagcggaaaaaacggattattgtgggagtcaatgaatacgtggaagaagatgaaaagatcgacattccgatcttgaaaattgatcccgaggtggaagagcggcaaaaacggaagttaaaatccttaagggctacccgggataatgaaaaggtggaaattgccctgcgggagttaaaagatgcggcgcggggaacggataatttaatgccgtatatcttaaatgcagttcgggtttatgccaccgaaggggaaattattcaaagcttaaaagaagtgtttggggaatataaagaaaaaccgattttttaagggaggggagaagatggcgcggaaaataagagtactggttgcaaaacccggactggacggtcacgatcgcggcgccaaggtggtggccagggcgcttcgggatgcgggcatggaggttatttataccggattgcatcagacccccgagcaaatcgtccaggcagccattcaggaagatgtggatgtggtggggatcagcatattatccggtgcccatatgaccgtttttcccaaggtaaaaaagcttttagaggaaaagggagcgggagatatcatcgtcatgggaggcggaataataccggacgatgataaaaaagagctgattgaaaaaggatatgctgctgagctctttaccccgggaacccctttagaggagattattgaatgggtccggaaaaatgtaaaaccaaaagaatattaaagggaatataataaatccccggttttggccggggatttttttaaattacttttaaactttgaaagccggttttcagggctttttcgtttacggcaagcacttccggtttatttttaaaaatatagcttaaattgagagtggctgtttccaaggaaatcaggttggttacggctaaaactgcgcctaacatcaccatattggaagcccgggattcgccgattttaagagcaagttcattggctggtatttgatggatatggatatcactttttatttcagggatggaagggataagagagctattaataaaaagatgcccgcctttttttaccgtatctttaaactttagtaacgaagggtagttcattgctaccaagacatcgggctcggtaaccaccggtgaggcaatgaactctttttctatcactacgctgcagttggcagtgcctcctcgcatttccggaccgtaagaagggataaatgaactattaaaaccttctttaatggcagcatgggctaacagcatgcccatggccataataccctgaccgccaaagcctgcaaagataaactccattttaccacaccccttccggttttttaaattcccccggaggataatactgagccattgtttctttaacatactttaaagcttttaccggacttaagccccagttggtcggacaggtggagaggatttcaaccagggaaaaacctaaacctttttcttgaacggtaaaggcggttttaatcgcttttttagcttttatgacctgaccgggatcaaaaagcgctacccgggcaatataagctaccccatctaaagtggccagcatttctgaaactttaaggggaaaaccgttatctttggtgcgcccttcgggggtggtagtggtcttttggcccattaaagtagtgggggccatttgccctccggtcatgccgtaaatggaattattaataaagattaccgttatattttctccccggcctgcggcgtgaacgatttcacccatgccaatagaagccaggtcaccgtctccctgataagtaaagacaattctatccggcagtgcccttttaattccggtagctactgccggggctcgcccgtgggcagcttgctgcatgtcaaggttaaagtagtcgtaggctaaaaccgagcagccaacggaggcaaccccaatggtcttttccatgagtcccagttcgtcgatgacttctgccaccaaccggtgggcgataccgtgggtacagcccgggcagtaatgaaagggtatcttggttaagctttccggccgggttaaaatttctgccattattcctgccccccttcaaggatttctaaagttcttctaaaaattttctggggtgaggggacaataccgccggcggtaccgtaaaaataaaccggtttttggccttttactgcccgttcgacatcttcgaccatttgccccatgctcatctccactaccataaatcctttactctggttaactttttcggcaattacggtataagggaaaggccacagggttatcggcctgattaacccggcattgatacctttttcctttaaaagctcaattacttttaaggaaaatcgggccgaggagccataggctacaaagaaaaattcagcctcttcatttattacttcaacccggacttctttttcggcaattacttgatattttttaaagagtttttggttgtgactgaataacttttccggatcaaggtacagggagtttataatgttgggtttccggttcttccttccacgggtggcccaggttttttcctccaagggaaaagcggggatatagggttttaacgtaaccgactccatcatttgtcccagtaaaccgtcgcccaagaccatgaccgggtttcggtagtggtcggctaaatcaaaggctaacattgtatggtcgtataattcttgaaccgaagaaggagctaagacaattaaccggtagtcgccgtgaccgccgcctttggtggcttgaaaataatccgattgcgaaggctggatgcctccaaggccgggacctccccgcatcatattgacaattacagcggggagttctgctgcggcgaggtaggaaatcccttcctgcattagactaatacccgggccggaagaggaagtcatggttctaacgccggcgccggctgctccgtaaaccatgttaattgcagcaacttcgctttcagcttgcaaaaaggtgccaccggcccgaggaagatgtttggctaaatattcaccaacttcgttttggggggtgatgggatagccaaaataaacattcagtccggccctaattgccgcttcggccagcgcttcattgcctttcattaaaaccgtttccatttaccttccctccctctggaccgtgatagcaaggtccgggcacatgcggtagcaggtaccgcaggcggtgcaaacttcctggtcaaagcttaggacgcggtagcccttttcatttaaattatcggtaaaagttatcgctttaaccggacaaaattccacacaaagaccgcaggctttacagagattttgaacgtaaattatttttggcaagttaagccctcctttgtaaaagccgctttttggcatacatgattgcagcttcctggggagttatcttttgttcccgggaaagagttaagacttctttaactttatcgtaaattgtggcaaccttagcttttacccggttctgatcataaccttccgggtttaattcttcggctacgttaattactccgccgccgtttatgatgaagtccgggacataaactattccgcgttccgctaaaagtttaccgtcttccaactttgccagctggttattggcagcaccggcaactatttttactttaagccggggaatggtgttttcgtttaaaattcctcctaaagcacagggagcaaagatatcggctttgacatcataaatttgctctggttgaacaaaacgggcgttaaaacgttttattgcttcagctaccctatcctcaaaaatatcggtgacaattagttccgccccttcctggtgaaggtgttctaaaagatacattcccacatggcctaaaccttgaacggcaacttttttgcccttaagggaagtatcgccaaaaacatattctaaggctgctttcattcccgtgtagacaccaaaagcagtaaagggagaggggtcgccgcttttggcgggaagaccggcaacatacggggtgtgtctggatacttccagcatatcttgcgaggtaattcctacgtcttcagcggtgtagtacttgccccctaaagcgtttactgcttcagcaaagcgggcaaatagctctgaagacttatcggttcgaggatcaccaataatgaccgctttaccaccgccaaggtttaaacccatggcggagtttttataagtcattccttcggcaagccgcaggacatcggttaaggcctcttcatcacttttgtaaaaccacattctgcatccaccaagagcaggacctaaaaccgtactgtggacggcaattatggctttaaagttagtttttttatcggtagcaaaaagtacggtttcataaccttgataattttcctttttaacaatttccatcaccgtgccccccaaactttttattttaaaaattttcaataaaaaagacacgcaaaaagcgtgccatttattaataaaagggatttatccgattgttgaaataaaattcagataatgtgaaaaaaatttccggaaagaagatacttataaaaggtcaaactcttttagcttgttatacaaactgcggggagttattccaagaagctgggctgctttggttttgttatatttagctttttcgagagcttccttaaccaccgatttttcaaattcccgggtcagtttctttaagtttaagtcggagctttgggttttagaaaaagaagtttggggagtttcttcaaaaagcttgggcagatgttcggggcccaagcgattttcggccagggatacttttaacatcgcccgccctaaataattttcaagttcccggatatttcccggccaggaataactcattaaatagcggaaaacttccggatcaataaatttaatattgcggccgtattccctgttaagtttttggacaatagcccgggctaaagcggggatatcggttttacgttctcgtaaagccggtaaattaatggggattacgtttatccggtaataaaggtcttcccggaaggttttattttttaccgcttcttctaagtttaaattggtagcagcgataatccttacatctaccggaattggctgattaccgcctacccgtacaatttccttttcctgaagaactctcaaaagtttagcctgcaaattggaggagagagtggtgatttcatctaaaaacagagttcccccattggcttcttcaaagacaccttttttaccgccttttttagccccggtaaaagccccttcttcgtagccaaaaagttcactttctaaaagactttcggttaaggcggcgcaattgatccggataaaaggtttttttgccctgggactctggttatggatagcgtgggcaaatagttccttaccggttccggactcgccgcgcagcaagacagtagcggaagtctgggctgctaacttggcaagctctatagctgaaattagtaagggatgttctcctattatatcatcaaaggtgtagcgggcgctcgaagcaagggaacgctttaaccgatcgatttcttcggtaagtctttttaattccgagacatcgtgaataacggcgacgcttccttttagggtgccgtcgacaattaggggtgcggcgttaaccaccacttccttttttaagggaccgactttcatcgtgatattttttatcggccttttttcctgtagtactcgaaaatgaacactttccccttcggcaatatcaaccgttgccggtttaccgatgacatccttttcggtaagtccggtaagttcggaataggctttattgattaaaagcccgtaaccccgttcatcgaccaccgagatagcgtcttgcgtacaatcaataattgaagttaataaggttttaatttcctgaaggttggttaattcctcggctaacttttgcatgtcagtaatatctttaaaaatagcaaaggcaccgattacttctccaaattcattgaagagaggaatccggctggtaataatttttgcttgtcccaagtcttgaaactggttgatttcggctttgccggttttgaggataacgtgcagccgggtgttagggatggcgtcaacgacgtattttcccagtgcctggttgcggtttatcccggtaattttttcggcagcgctattaaaccaggtaataattccttcacggtttaccgcaattaaaccgtcgtgggcggagttaattatggcttcaagctctttttcctggtaaaaaagttcatcagctaaagatataaaaagtttagcgatatagccgctaagataagggatattttcctttaagttttttaaagttttttcgatttgggggtcgccggtggtgtcaataataagattgggagctttcgttagcccttcctcaagggttgagaaaaccgggatatttaagtccttggcaattttgacccccaaagcttccgggtttttttctactgccataagctttaaattactttttttaccaagaatttttaaaaatctggttccgccctgccctaaacctaaaagaaggatcttaattgcttccattatctcaccctgtaaaataaattgtttttccttaatatattcgccggaaaaatctttaaacctctatttttcgtcaaacccttgcatagggatttggggtgggggtaagatgtttttagaagcatttctggagggagataaaaatgaaaattatcgatgctctttttgcgccaggacttaccggtttttattttgatgatcaagaggccattaaaaaaggtgcggtacataacgggttctggtatgaagggaacccccaaactcccggttacaaaaggattcgccagaagggtgaagcaattctggttatgcttgttttggaaaatggggaagtggcgtatggcgattgtgcggcggtgcagtattcgggaacgggaggtcgggaccctctttttactgctgaagagtttttgccgatcctggaaaatgaaatacgcccgaagttaattgggcttgagttaaatagttttagaaaccttgctcatatttttgaccgggagctaacggttaacggaaaacctttacataccgctttaagatacgggctaacccaggcgcttttagatggcgtagcccgggcgcaaaaaaagcttatggcggaagtgatagcggaggaatatcagctaccggtgattcccgagccggtaccgatttttgttcaaaccggcgatgacctatacaccaatgccgataaggcaattattaaaagagccgacgttttaccccatgcccttattaataacgtggaggaaaaattagggcggcagggggaaaagcttttagcttacataaagtggttgaaaaaaaggatatttgagctggctggtgatgaatatcgtccggtgattcatattgacgtttatggtaccgtcggtttaatttttgccaatgaccttgagaaaattgccggttaccttgcaactttagctcatgaggcggctccctttaagcttagaattgaaggaccggtagatatgggaagcctctgggggcaaatcgaggctctatctaagttaagggaaataattgaccgaagagggattcccgtggaaattgtggccgatgaatggtgtaataccttggaagacattaaattatttgctgaccataaagcgggacatatggttcagattaaaactcccgacttgggcgggataaacaacgttgtggaggcggtgctttacgccaaaatgaagggtataggtgcatatctgggaggtacctgcaacgaaaccgaccgctcagcgcaaatttcggtacatttggctctggcaacccgcccggaccagatgttagccaaacccgggatggggttggatgaagggttaatgattgtttataatgaaatgcagcgagcaattgccctgttaaagaggcgaggaggtaaataaatggaaaaggtgaaaatcctatcccctaccgctattttggggtacggctttccggttaaatcttttgaagctggattggaaaaaaagccagatgttatcgctgttgatgctggttcggtcgaccccggaccgtattatttaggagccggaaaatcgtttacccagcgggctgcggtaaaaagggacctttattacatgcttaaagcttgtgtggaactaaatattccgctgttaattggtactgccgggggagccggcggcagggttcatttaatggaagtagtagaaattatcaaagaactggcttttgaaaatgatctttcctttaaaatggcggttattgataccgaaatagataaagagtggttaaaagataaagttagacaaaggaaaaccaaaccgttaggaaatttaccggatttaaccattgaggaaattgaggaagcggtgcggattgtggcccaggcgggaatggagccgtttatcaaagcgttaaaagccggtgctcaggtaatcgtggcgggaagagcttttgacccggcggtttttgctgcctatccggtggcccacggttttgatgtgggtttatccctgcatttggggaaaatactggaatgtgcggcgattgctaccgaaccgggcagcggcagcgactgcttgatgggggaacttgaccgggaaggatttgtagtttaccccttaaatcccgaacggcgggctacacccctttcggtatctgcccattccctttatgaaaaaactagtccctttgagttacacggtccgggtggtaagcttgacctctcccaggtgaactttcaagcagtagatgaccggacggtgagggttaccggtactaaattcattaaaacccccaattactacctgaaaattgagggcgtaaaaagagtaggattccgggccattagcattgccggcagcagggacccgaaatttattgaaaatttccagtccatagcatcaggggtaaaaaaacgggtggaagataattttccagaacttgcgggaaagtattatctaaactttatagcttacgggataaacggtgttatgggggcgttagagccggaaaacaagctttcccatgaaattgggattgttatggatgtggtggcggaagataaaaatactgccgaacagatattaagttttacccgcagtaccatgctccattttggttttcccgggcgaatttccaccgccggaaatctggcgttttccttctctccttcggatattccggttggcgatgtttataatttctccatccaccatttggtggaagtggaagatccggaaaagctttttcccatcgaacacattgaaataggaggtagaggcggtggtaaaacttattgatattgccaaagtaatccggagtaaaaactccggaccttttgagcttacttttgacattatttttaaagataaggaaatttacgaaaaggttaaagggaaaaaagctattaatagcgaattaataaaaaggctttataaaatttctgaagacaaaataataggtatttattattttgatccggcactggcggtgaagtttactatagtacgtcccctgccagcaggacacctgggagaaaccgatatttacggggcccagcagcatgcaccgcttttaaatgcagaacttgaactgtaaaggagaggcaaaatggggagaattgaggtcattaccggtccaatgttctccgggaaatcggaggaactggtgcgcagagccttgcggcttatgtatgctaagaaaaaagtaatagcatttcaccatgctctggataatcgcttcgggcataaaaaaatagtcagtaggagcgggtttgaactggaatcctacccggttcaaaattttgcttttgaggtaatctgggatttagcaaaagattatgatgcggttttagttgatgaagctcaattttttagtgacgaactggtggatacctgtttaaatttgcgccggcgttcgaaaattgtggtggtttccggtttggatttggatgtttacgaaaatccttttggcccaatgccgaaactgttagctctggctgacagggtggataaattaaaagccgtttgttttgaatgcggagaggaagctacgatatcatatcgtttatcgggggagaaggaacaaatagtggttggagacaaaaattacatcgccctgtgttaccgctgttattatgccaagaaaaaagaagagcggtagaacgctaccgctcgtagtaacggcatttttcccgggaacagccgtgggggtgctttagatattcgctgcatgatattttataattgaggggcagattgaaaatttacccctcatgattattttaagaaagaaggggtagtatggacattagagaaattttgacccgttttaaaaatattgcggtggtaggggtttccgataagccggaacgcccgagttatcaggtagcaaaatttttaatggaaaaagggtacagggtttttcctgtaaatcctaacttggatagttttcttggccaaaaagcttataggtctttagaagaaattccagaaacggtggaaattgtggatgtttttcgcaagactgaagaagtaccggcaatagctaagtcttccgtgactattggtgctaaggttttatggcagcaggagggagtaaatagcccggaagctaaggaaattgccgaagctgccggtttaattgttattgccgatcgctgtatcaaaaaagaatatcttaaaaatttcccttaaaaaggggtgaaggttaaatggccaattgcaccgaggtaatggtaaaggaacatgaacttatcttgagaatgttagatattttagaaaccggagcggacaagctttcccggggagagtttgttccgccggaagtatttaccggagcggttatttttatccgggagtttgctgatcgctttcatcacggcaaagaagaagatgtgtttttccctgctctgtatgaagcgggaatgccggaagaaaacagccctcaggagcttttaaatttagagcacaaactcgggcgaaggtttgtggggcgcctggatgaggcagcagagcagtacatggatggggatgacggagcaataccggcagtggtggaagctgcccgcgactatgtaaggctcttacggcagcatattttaaaggaaaatgaggggctttttcctgtggctgaacgccttatgagcgatagcttaaaggaaagggtaaaccagaactatgcggaagttgaaagggaaagatttcccgaagacacggtgctaagatttacccagttagtggaacgttttgaacatttactggatataaagaaaaattaacctggaggtttttatggagtaccggtggagagtaatgtgggtagtggctcttgggacttttatggcgccactggatgccagcgttgtgaatattgcccttctttcaataattaaagattttaaggcaagtttagcgaccggagaatgggtaattttaatttaccttcttttcatcagcactcttttgctgacttatggacgcctgggggatttgtacggtaaaaaattggtttacgttacgggctttgtagttttcactgttggttctttgttatgcggtctttccccgacccttggttttttaataggagcgcgggttatccaatcccttggcgcagggatgatgatggccatggcgccggcaattgttaccgaagtttttccatcgcaggaacggggaaaggctttggggattaatggcatgatggtggctgcagctctggcttttgggccttctgccgggggatttttaactcactttttcgggtggcgttccgtgttttttattaatctccctattggattaattgggagtattttggcctttaaaataattaagaacgatttcacgcgggaaaaacattcctttgattttctcggggcttttttaagctttcttggtcttggaagccttttaatccttcttaccttttttgaaaaatacggctttacccatcccttaatgattggtgccttggttatttcaatcctggcttttcttttgtttttatacaccgaaaaaaaggtttctgaaccaatggtggatttgggcttatttaaaaatcgtgatttttcgtttagtaacttaagtgcttttttaagctatgttgccttgtatcaagtggtgtttttaatgccgatttatctgcaacagttgcgacattttactcccgaaaaagcaggaatggtaatgtcggtgcatccgttactaacaatgattgtagctcctttaagcggaagcctttccgacaaaatcggttcgaaggttttagcccctttgggaatgacggttatggctttagggttatttgccctttcccgtttaaatagcgagacaacagttggcataattatcttatctttaatgttaatcgggcttggcagtgccatttttcagtcgcccaacaacagcactataatggggagtgtgccgaaaaatcgcctgggaaccgcttccgggtttctggcgacaatgcgcaatgtcggaatggtaatgggagtagccgttgccggggccgtgtttaccggccggcgtacttattatttaacttattatttgcaaaatcactatactaaagaacttgcaaccgtaaaagcctttgttttagcttttagggaagcatttttagtgggcgcttttattgccctgttgtcggctgcagcttcactggtaagatcccgggggcgaaaagaaaagcttttacaaaaataattctggagtgtttactatggccttaaaagaactggcgaaaaacttctggcggaaaaactttaatttaaaaccctttgaaaaagtaataattgtttttgataataaacgggaagagctggcgcgggctctttccgaaactgccgtcatgtttaaagccgatttgggcctggtaaaaatttatgattcggagcttcctccggatatcgaagaccgtctggtcggggcggacgtagttgtctttttaaccgaaaaatcttattctcaccatcccttaagggtaaaggcttgtgaggcaggagcaagaattgccagtcttcccaaaataacttcggaaatctttaaaagagctgctcaggcggattacgaaaaattggcggccagaacgaaaactttggcggaccttttaaccggtgcttctgaagtcaaaataacctcttcccttgggaccaattttacggtaaatattcgggggaaagaaggcttgctggatatcggaaactttaccgagcccggtaattttggcaattttccggcgggggaagcatctttggcaccggtcttagagggaacttcaggggttttggtggtggatggccgaaaaaagctttttggacctcaccccttgattgttcgggtggaagacggccgggtggtgagtgttgaggggcccgggagtacggtgctggaggagtattttaatcagtacggagagaaagctcgccttatcggtgagtttgggattggcagtaacgagcaggcacatatagaaagtattcccctggaagcggaaaaagcaatgggaacggtccacttagcccttggcaataatttatcctttggcggcgaaaacgatgttcgctttcacctggatttaatcattactcagcctacggtagcgttagatgggaatgtaattatcaagaaaggtaagcttttaatttgaccgtttgggggcaaaaaacgaccgtttaccccaaaaaagatgaatattgacattgaatcccctaaaatttatacagggggtttttttatgcggatggttcatcaggttaaaggtgttgtctactttgtggaagatgactgtttaagaaccggctttaattatctcattcgctacccgcagttaatttatcccctggtaggctataagggaaggcttttgggagctgttgagctttcttcgctgctctatgctatatccactatgcaaagccatgcaacgccaataaaaatgtacgttcggggcgattatcccgtgcttccggccggtttaaggaaagaaaaacttttagaaatctttgttcgggaaccttttttgtggtatttgcaggaaaatgaaggtaaaggctttgccggcctggctttgggatataaactgctacaggatggaattagtgagggaaaagtagaagcggctacggttaaaaaattcagtgagctttttggcgaagaattttataaaagcttaaaaattttggatgcaggacaaatatcttttttgtttaaaaaatttttaatgattgcgacttataaagcttttaattttaaagcggtgtatccctaccttgatttatcttccttggaggaaaaaattattgaactaagtcttaaacttaataacggccagaaagctgaactttccaaaattgccggatttaaaagatcggctttgtatcaacagcttaagggccaagccagggaggggaaaaaagcttgaatttacttcacgaccagccgctaattttggacttaacccgccttttacccggtccctatggtacgtttctattggcagcgtacggggcgaaggtgatcaaaattgaagaaccggtggtcggggactatttaaaaagtatgtttagttctgatggcaaggagtcatttatttatcgggtcttaaacgccgataaagaaaaaatttatttaaaccttaaagatgccagtgatcgggaaaaatttttagatttagttaaggaggctaatgttttagtggaaagctttcgccccaaggttatggaacgtttgggcataggttttaagaggcttaaagaaataaatccaaagcttatttacattaacctggggggctatctggaggggtccgaggaggcagaaaaagcgggacatgacataaactatctggcgcaaagtggaatcctgggggatacctataaggatggaccggtgatccttggagcaccaattgctgattttgccggaggacttgccttgagctccctggtgatgggtggcttatattatcagcaacttacgggacaggggatgtatatccaaataggaatggcagagcttatgaaaagctggggtgtactggctgccgccgtttacggtgaaaaaaataaagttccgggcccgggtaaaggaatcttaaaaggtggggtagtttgctacaatatctatcgagctaaagatgggtacttagccctgggagctttggaagaaaagttctggttaaattttttaagggctcttgggcgggaagatttaaaaccggggcagtttaccccggcggtcaagggaaaccggtactatgacgaagtttgcgctatctttgctaatttgacattaattgaggtggagaagctttttaaggatgtagattgttgtctgactcctgtgaaagagctaaaggatattgcaacctccgatgtggtggaaggtagcgagaaagctctgggatttttccgggtagaaaggtaagttgacgtgtttaagatatttttcttttggtaaaagggataatttttgtggtaatgtttaactcctccataagcctttttctttccaaaaagaggttttcatttagcttgtaaaagttttcccagtattcgtttaaccaggacatgggaatataagctttttgatttattttaaataccggaaaattgccgtgaaggatacggtatagattttcttgccgcttgatttctttctcaattttgtttaacttgatacttaataacatttttctatccattttaacaccccaaggaaattgtaacataaatttacaaaatttacaatattataatgaaaggttttggttttatgaactttcagttaaatttggggaagatattaaagcgcgctgccagctactttggggaaaaaaccatcgtatcttatgaagctctggagcgaaaggagataacttatagagagttttactcccgggtcttggctttaattggttatttaaaagctctgggggttaaaagaggaagtcgggtaggggtttttgcctggaataatttagcccatttaatgctttattatgcggtgccttgctccgaagcagttttacacccggtaaatttacggtacagcaaagagcaaatgctttataccataaatcacgctgaagatgaagttttatttgtggaaaaggaatttttgcctttagtggcggaaataaaaagcgaacttcagagagtgcaacaaatattacctttagacgcggtttttacaaattttgtttcttttgccgaaaattttgaccaaattccggaagaccttccggcaaaattatgttataccaccgcaaccaccgggactcccaaaggcgtaatgtattctcaccgggacctgtatctgcaaagcatggctctttgcatgaccgatagttttggcatatcggagaaagaacgaatattaatcatggttccgatgtttcacgtaaattcctggggaattccttatgctgcggcaatggtaggtgctacgatggtcttacccgggggaaattttaaagggcaatttttagctaaaataatttctgaagaaaaagtaagtttagctgcaggagtacctaccgttttccaggaaattttaaaagcagcgcaaagcgaaaatattgatttgggaagcctgcgaactgttctggtgggtggagctccccttaccagagaaattattgagggatttgcccgatatggtgttgaagttcgtcaggtctatggacttaccgaaaccgcgccttttgtagcaagtaattaccagaaatcaaccctcgtccatcttagcgaagaagaaaagaaaaaacagcagctaaaaatcggccttcccgctcctggcgttgaggtaagggtggtgggcaaagatggaaaggatgtgccctgggatggggaatccattggcgagctctggttaaaaggtccctggcttgcccgggaatattacaatgatgaaaagcatacccgggaagcttttgtggatggctggtttagaacttttgatttagttaaaattgatgcgttagggtatattgagttttgcgaccgggaaaaagatgtaataaaaagcggtggggaatggatttcctcggtggcggtggagaaatatcttctgtcccaccccgatgtaaaagaagcggcggtggtaggtttaccccatcccctctggcaggaacgaccggtagcctttgtgactctatgggaacaggcaaaggtaaccgaagaagaacttctaagttatttgcggagtaaacttctttccttctgggttcccgaccgcatactttttttacgggagttgccccgtaattcggtaggtaaagtagccaaaaaattactgcgggaaaaatatcatgatttattgcttaaaaacccgaacgaaagggaaaaagtataaaagtataaaagcagatttttaatgggaataataccatactaagtggtgccaatttacccgttgcttttttaaaatcaccggtatataccggtgatttaattttgtgcgcttttaatttagtaaaaataaaggaatttttacgataattgccgaattaaaaataagggtgagagtatggagaaaaaagttgggaattcgaaaattattttaaaacttggtgatataaccaaagaaaaggttgatgctattgttaatgctgctaattcaaggcttgccggtggaggtggggttgatggggccattcaccgggccggtgggccgaaaattatggaagaatgccgggaaataattaataaaataggtgttttacctcccggggaagcggtagccacaaccgccggaaatttaccggcaaagtacgtaattcataccgtagggcccatttaccgtggtggccaaaagggtgaggaaaatactttaaggaacgcctatttaaattccctgaaattagcaaagcagttaaatgtcaagacgattgcgtttccttcaataagcacgggagcttatggttacccagttaaggatgcggcgagggtagccctgaaagctgtgatagagtttttagaaggagaaccggaagattttaccgtggtttttgtgctgtttgacgaaattacttatgctgcctaccaggaggctctggaagcctatttaaagtaaagaagggagaaggaagatgaaagtttttgctttaatgggaagcccgcgggaggggagtaataccgacattttaattgaggaagcactaaagcctgccagggaagctggctgggaagtggagaagtttaatattgatcagctctacatcaatccgtgtcggggttgtatggagtgccggggtaccggtgattgcagcttagaggaagatgatatcctggtggtggccagggcaatggcggaagccgatgcctacattattggagcgccggtttacggtaaccatttacccggccaggtaaaggttttgtttgaccgcttgtcgggtttaattcataaggtcagttatgatggtgcaagtttgcgttcgcaaagccgcttaccccataaaaagcggcgggtttttatctttgccgtagcagcggccggaagacctgaatcgtgcgatggagttcttaggtatttaaagttttttgtaagaccggaactaaacggtggagaggtgtttgaactggcagttaccggagttggggccaaagggcagataggctttggccccgaagagttggaaaagatgctgataaaatataattatgataaccctgaagaaaaaattaaggaatatcttgatttgcaccaaaaatatctgaaccttgcccgggaatttgggcaaaagattttgaccctgtgagtgaaatataaaaaaggaagggtttttcgcccttccttttttactttaataaggaaattagctggtacatgagagcagccatcaatcctgccgctggtattgttaacacccaggccgttacgatgtttttacccacttcccagttaaccccgctaaatcttttggcagaacctacacctaaaatcgaagaagccaccacatgggtggtgctaaccggagctcccaggagggaagaaccgtaaatggtgatggccgatgaaaggtctgcggcaaaaccgtttaccggttcaatgcggaagattttactgcccatagtcttgatgattcgccagccgccagaataagtcccaaaacccattgccaaagcacaggcgagctttacccagaggggaatttcaaaagttgtaagatatcctgcactaaaaagagctaaagttataattcccatcgatttttgcgcatcgttggaaccgtgggaaaaggaagccatagcggcggataacacctggagttttctaaacttcatgttcaggggaaaaggtgccgctttatcaaaaatccagaaaaaagaagtcataataataaatcctatggaaaaaccgataattggtgataaaaccaatggcagcagaactttttctaatattcctttaataagtaaagctttgacaccggtaccggcaatggtggccccaattaatcccccgattaaagcgtgggaagaactgctgggcagtccataataccaggtgataaggttccaggttattgctccaactaaagcagcaataataacgtactggttaatggcgctgggctgaactattcctttaccgatggttttggctactgcggtaccggataccgcaccgacaaaatttaaaacaccggctaatagaaccgcctgctttggggaaagggcccgggtggtgaccgaagttgctacggcattggcagtatcgtgaaaaccattaacaaaatcaaaggttagtgccaagatggttacaatgaccactaaggtaagcgtactaagcatactttaagactacccctttaattaaatctcctaaatcttcgcataaatctaaaagttcttcgatatgttcgtatatttccttccacttaatcagttcaatggggtctttgacatttttaaacaaataagaagtaccttcctggaaaatttcatcgcccacactttctaaacggtttatttccatacaaagttcaattagtttttcgtgatgaccgggaacattgtctaaaagtttaacggcttcgtaaacttgatgggctactttgttaattacttctaccatttttaaagccgttggggttgggctaatagcgtcatataaaaccattttaaggtaagtggcgtagataaaatctaaaatatcatccaagttagtggcaattttcataatatcttcccggtccataggggtggaaaagcttttgtcaagtttgtctaaaagagtgcgggtcacttcatcccctttgctttcaatggcctttaaattgtacaaactttcctgagccgagtagggtgaattaactgctgtgactaaaacttctgctccttccaccacgtatttggcgctttcggtgaaaagttcgaaaaaaaccggtttctttggcttcaaggaaatcatgggctcccttttctccttccttaatcttttttttaaaataatgtaaagattccgttgttattttactttcttcccccggaaatgttaaagcgggtttacaatctattaacataaaattaactcctcaataaatatgttgtataatataggcaaattgaccgaaaaacggccgccgcaggccccgccctttagggctggggataaggcggccaaatttttatgggctacaattatattgccgcttgtggtataataattttatgaagcgcaaatttaagtccaacaacaatatcatgtattcttgcaaataccatgtagtctggtgcccgaaataccggcgtcccgtcctgaaagatggagtagacgtgcggctcaaagagatcctctttgaagtggcacgggagaaaagggccgaaattattgaattggaggtcatgccggaccacgtccacctgctggtagaggtggacccgcagttcggcatccaccggctggtgaagctcatgaagggccggtcctcccgcatcctacgccaggagttcccgtggctcaggtcgaggctgccgaccctctggaccaacagctacttcgtggctaccgttggaggtgcgccccgtgccaccctacgcgagtacatcgagaagcaaaagtacgtctagcacgcccagcttcgtgtgcgagctcctcctgcgggtctctcccgcccaggagaaagccttgctggcccgcctggaggcagcccggcagctctacaacgcctgcctgggggaagctttaaagcgcgtggggctcgtgcaacaatcgaagctgtggcagaaagcctggaaagcaggggacaaagagctaagaagggccctgatccgggaagcttgtctaaagtacggtttcacggacgccgctttgcagcactacgccgtgaagatacggcgctcctgctggataggcgaccacctggatgtccacgtggcccagaagctgggcaccagggccttccgtgccgcccaaagggtgcttttcggacaggcacgcaaggtgcgcttcaagggcaagaaccagatggacaccgtggagggcaagagcaacggagcgggcatccggtggcggaatggtcgtgtggtctggaggggcctggttctaccagccattatcgacccagaagaaccggtaatctgtcatgctctttcctgccgggtcaagtacgtccgcctggtgaggcgaaaaataaacggccgcaaccgattctacgcgcagcttatctgcgagggcacaccctaccagaaacctgaaaatgccctgggagaagggactgtcggcatcgacgcagggccctctatcatcgcccgtgtcaacagtaaagaggcgcgcctggatcgcttttgcgaggagcttgcaaagaaggaagcagaaatacgcaggctccagcgcaggctggaccgttcccgcagagccaacaaccctgagaactacaaccccgacggtacggtaaggaaagggccgaagcagtggaagaagaccaacacgtacctcaagaccgaggcccgcctggcggagctctggcgcaggctggccgcccaccgcaggagcctcattggcaggatggtcaacgagacgctgcgcatgggcaacgtgttcaaatttgaaaagctttcctaccgcgccctgcagaggatgtttggcaagtccgtcaacacccgggcgccggggatgttcttccgggagctcacccgcaaggctgagagtgctggcgggaaggtcctggagtttcccacccggcttaaagtcaaaggtacagaaacttgcgttggcctttccagctactgcgtttgcggggaacacaagaagaagtctttgtccgagcgctggcacatatgctcatgcggtgtaaagtgccagcgggacctctacagcgcctacctggcatgttttgtggaacaggttgggcagaatgatttcgagctcgacgcgggcactgccgcgaggcagtggccgggtgcggagccgctcctgcaagcggcgtcgggccgtatccccaacccccgaatgtccggctcctccggacagccccgcaaggggacagagggggtcgctgcggaagagaggacagccaaagccgaggcccgtgatgctgtagcgccgtctcatggcggtagcgagagcccgggagaggtcgcggtggttcccctcagaacccccgggctttagccctggggaggctcagaaaagaggtaatatcgcgatgttaaaaacaaaggtatttcgggaagttttagcaattaaaatgggaagaaccatctttggcaaattattgtatcccgttcatgctttttattttgatggggtattaatcgataccggttgctggcactgccgctttgaatttagttcttttctcaaggaattaaatattgataaggttattttaacccacgcccatgaagaccattttggcaatgtttgggctgcagaaaaatggcaaattccagtgtatgtggaagaaaagggcctaccttttttacaggaaccgcgaagattaaagatggagctctaccggaagataacttggggggaaccggcaaaagccaaagccctacctttaccccaattggtagaaacgcagcattttaccctggaagtaataaaaacccccgggcacagtccggaccatgtctgtttttatgaaccggaaaacggttacttattttccggagacctgtacttaggggaacgccagaacttgttaatgtatactgaaaatttttgggaaattagaaattctttaaaaaaggtgttagctttaaaccctaaaatccttttttgcggtttaaacgggtatgtccccggggcttcagaaaaattaagagcaaaacttaactactgggatgatttagccggtaaggtcttagatttggcagacaggggatttagtttgaaggaaatcaaccaactaatgtttaaaaagaaacattttatttccatagtttccggcggttctttttcttcattaaaccttgtccggtcaataattagagaccggaaggacggggaagaaatttaacaaaaatttacctggacccgttactgggtccttttaatttttattacccgtgtaagaaatttgtaagaaatgaaagttattattataacaaacatagttaaaaagggggtaggtcagcgtggctcgaaaatttacacggcgtaaatttttaaagggcgctggtgccggggcagcgcttatgggtttaaaggccgtcggaaaaagccgctggattgaaaattttagccaggatatagctgaagctgccaatcttccggcggaaaagtgggtaaacagcgtctgcccatattgcggtgctggttgctccatcctttacggggtaagggaaggaaaagtggtaagtgttcggggtaatcccgaggcctggaaccggggtggtgtttgtataaaaggagcaaccctggcggatttgtaccttagcaattctcccggggtcaaagatcggctgaaaaaaccgcttttgcgggacccggagaaaaggggtagtttggagaatttccgggaagtttcctgggacgaagcgttaaattatatggttaagaaagtaaaagaatacacaaagacaaagtttggggataagcacccctttgccatgtacggcagtggtcaggtatctactgaatttatgtacctgcaggcaaaattcaatgttataggcatgaatattcataacgacaacaacggccggttatgccaggcaactaaagccaacgctatggtgatttcctttggtatcgatggcccgcctatgagctttgacgatgtttttgaggcagataacctgtttatctttggttttaacatagctgacaccttaccgggttggtttggcaaaatagtggaggctaaagtccaaaaaggtgataacttaaaaatcgccgtgataaatcccgtgaagatttccgccacccagattttaaattataaagctggggatttgtatcttccgattattcctaccaccgatgtggcctttattaacagtatggcccatgtaataatttatgaacttgagggggtaaaccgggattatgccggtgatgtgagcaggtgggccgatgatgtaataagcggcaaagtcaagcctaaacatatcgacaccgaatttatcgccaaatacgtaaatttctatcggggtgattatcaagttttagcccggctgggtaaagaaggtcctaaaattttcgaggaaattaagcttccttccggactggaagggtttaaagaatatgccaaatttttagccgcgtacaaaccggaagatgtagccaaaactactggattaaccccggaagatattcgcaaggcagctcaaatgtttgtccgaaataaaaataccatgtctatgtatctgcagggctttggccagcagtcaaatggggtttccaagcacttggctctggtaaccctgcacgcggtaaccggccggattggcagagcaggagcaggggtaatgccgacggtaggtcagcccaatggacttggtcaaagagttggaggtgcggtggtaggcagacttccgggcaaccgtaatcacccgctggctgcccatcgggcatcactggccaaggctatggcccgggggaaccaggaaatggaagccaaaattttggaacggcttgaagacccggtaacaaagtattcccgactttctctgacctccgttgatatctttaagaacctcaaaaatggaaacataaaagggatctggacggtttgcactaacccgatggtggcgtttcccaacctcaacatggttcatgaggctttacggaaagccgatttagtggtggttcaagatatctatcctaccgaaaccatggcttttgccgatgtggtgctcccggcagcggctatttccggagaagcgtacgggacatatttaaattcggagcggcgagtccagatattagaaaaagcggtggaaccccccggggacgcgttacccgatgaaattattcaccttgcttttgtttacaagtaccagaaggctttggccgaagaagggcgtcaggaagacgcagattttctaaagtttttattagagcccataattcagggttacgagccattatttgaaaatgtccaggctaatatccgggaattaagggaagctcatcaggaaattcaaaaacgactgtttagcgaacttgcgtatgtttctaagggaataccaggcaatgatttaagcggcttatcctatgaacggttaaggacggaaaaagatgctaaagggtatgtgggctttaagcttcccgttttggacagcagtcacaaaggtcttgaacggctttacgatgaaaactacgaagcaatataccaaaaacgttttgctactccggacggaaaacttagatgtttcttatttgagcaagttcatcccgcagaggaatggattgatgctgaatatccgtttatgctcactctaccccggatttatgagcactggcataccaggacccggacgggacgctgcgcattgccccaccggctgcgccccgaagcctggctgtccataaatcccaacgatgcgaagaaacttggtataaaggacggggactgggtagaagtggaaagccgtcggggtaaggttacggtgaaagccaaaatcgatactgtaaaaacaccgcgggaaggggtggtttggatgccctgggcttatggctttttagggaatttgtttaccggccaaaaagaggcgcctcccggaaaatccgccggaaatgtcttaagtaccgatgcttacgaccccgtttccaaacagcccgaactaaaatttgccgcggtgaaaataagaaaggtgtgatgacggatggcacgttacggaatggttattgacctgcgtaaatgccgggggtgccgcggttgtaccgcggtttgtgccgtggaaaataatgttccggtagatagaaccggtgaagaggccggtgagcagttagcccggtgggcagccggggagcttgattattacaacatgcgggtattaaccgcaacggtatatggtcaaattcgctccatacccatgccgtgcatgcactgcgacaacgcaccctgtatcgccgtttgtcctgtaaaagcaagttacaaaagaaaagacgggatagtagtcatcgataaatataaatgtatcggctgccgtctttgcttaaaggcctgtccctatcaggcccggtatatacgcaaagtgccggtaaagggtgaacccaagggagtagctggaaaatgcgagttttgcgcccatttggtagataaaggggaaaaaaccatgtgcagtagaagttgtcactccggggcgataaaatttggcgacttagatgatcccaatagtgaagtaagccagcttttaaagcaaaacgctaaaaaggtaaagaggcttaaaccagaatataaaacgtcacccagagtttattacattaccttttaggggggagagcggtgaaaaaaaagctccggctttttattctgttcatttttttaatggttgtggcaactcccgtaatggccaaatccgataggagttacgggaataattgcctcagctgtcacacaaggtttgaatttccggaaattaagccccagacggggagcaccattaccgaagcccagtttgtaaatttgctcttagaaaaggtcttgcagcaaaaggtgcaggtgtttgaccgggaagcagcaggaaatgttagcgatctaaagtatttagccgataccggcctcgtacctgctatggaattaagtgtcaaaaatcccagtaaaggccttaccaggcttgaagcggctgggtacttggctcaggtgctaaaaccttccctatcatccaaagaaacagcggctattttaagccgcctggccgaccggaataaaatcccctcttcctatcaaaaaggggttgcctatttgctgaaatataagctactaacccctgaagcaaaagtttataaggtgcggaaaaaagttaaaggaaaatgggtttatcaaaaagaaaccaggtattattttaaccctggcaaaattgttactaacgccgaagcgattaactggctgaacaaaataaagatttaaattgtttgggggtgcaaaattgaagaaaaaattgctgttaactctggtaatagcaggtattattttgctatcggctcttggaattgggattcacgagaccagcaagccaaccttttgtaatacgtgccattcgatgaagccttacgtgactgcctggaaaacatctgcccattcaaagaccgactgtatggcttgccatcgggacccggggcttgtaggacttgtaaaagttaaacttggtggtcttaaacaagtggcggtagagcttacccgtaagcctgaaccggcagaaattaaagggaaggcagaagtacccaaccgccgctgtcagtcctgccatgaattaaataaacttcccgggcctacggctataaattttagtcacgagctgcatgcgggtaaaaaaggactggaatgtgtaacctgtcacggggatctggttcatggcgagcccaaaaccttaaagatgcaggactgcctcgactgtcataaagcgaaaaacgggccggtaaaatgtgaaagctgtcatcagagtaaagcgaccatgaaacctcagaatcacgatgcgaaatggcttgcagctcacggtgaggcagccaaaaaagatctaaaatcttgtactacctgccacaccggggaattgggggtagaaaaatactgtaacacctgccataacggtgtacaaatgccccacccgaaaggttggctccaaaatcacaaggtttccgatgtaaaagtatgtaacacctgccatgaaaagcctgtggaagggggaaaggcccaaacctgtataagttgtcaccaggttgaaataccccacccggctaattggaataaagagcatggaaagtttactttacaaaataaaaacgtcaattgctattcttgtcatactaaaaccgaatgcagtagctgtcacaaagtagacatgccccatccgagtgggtggcttagaactcatggagttacggctttagccaagggaagcagcacctgttatacctgccatagcaaaactacctgtaccagctgtcatacaagtaaatcgccccataatagcacctttttaaccgttcacagcaaggaatatagggaaaatccggcaaaatgtaatacctgtcataccaataaaactacctgcaatacctgtcatcagaagcttggtcacgatagtagctggatagtacgtcacgggcaagtagcaaaaacccaaacgtcctgcctgccctgtcaccggcagccggattattgcagtacctgccatcctaaaaccggtcacgatgaacgctggatacaaaaccatggtattacagccaaacttcgtcccgaaagctgtacgccctgccatgattttaaaatcttttgtaaaaaatgccataattaagaaatctaaatgttccgggcactgcccggattttttttctacgaatattggagaaaaattgttataattatcgtagaatgtaaaaaggggcagtaaatatgatgcatgaaattaaattaagccaaaagcttatgcttggcatgggcgttgttataggctttttttcgcttctggcttttatctggaacgttgccgaaacccgctatagttaccagaaagagcttttagaaaaagcccgggttattacttccggtctggtggcaacccgccgggtaatcgccgaaaatcaagataaaataaattatgacagccaagggcattttgaatttaaacatttaaatccggcggcggttggacgacaggtagcaaagtatttcaatcaaactaccggctaccggctaaagcaaacccgccttaaataccgtaatcccgaaaatgccccggatcccgtggaaaaagaaatgctcaaagagctggccgcaaacccgcaaaaacaggaactttatcgcaacatagaaagggatgggcaccgttatttttactatatgaaacctctatacattgaagagccgtgcctcgattgtcacggcgaaccggtgggagtcaaagatattgccggctatcccaaagaagggtataaacttggggattttgccggtgctatttcgctggtggttcctgcggataatttgcaagtcgagtttgaacgtaaattaaaaggaaatttcttattgtttcttgcctttttaggtactatcggtctttttagctttacagttataaaaaataccattgaagagccgctaaaagaaattgtggctatgactggagaggtggctaccggtaactttaagacgaaagttatagaaactaatagccgggagattaaagaactttccgaaaacttccaccagatggcccagaagttaaaagaactttatcataacctcgaggaaaaagtaagagagcgaactcatgagctttccttagccaatgaggagttagccagggccaacgcttttaaatcggagataattgccatggttagccatgagctcaaaactccgcttaccagcattttagcctttggtgaaattcttttagccgacagtgaaaacctgcttccctggcaaaaagagtatttagaagatataatggaaagcggccaggaacttttaaagcaaattgaaacactcttaactatggctaaaattgaagccggaaaaattaccgttacctattctccggtaaatttgcagcaatttttggagcaatgttttaaattttacaaaaataaagccaggtcacgccgggtaagcctgaaaattaaaacgaatattaccggaattttaataaccgatgaacacaaactgaaattaatcctgggaaatataatcggtaacgctattaagtttactccgccgggggggaagatttcggtaggattgcggaaaatctttggccgcctgtatatctatgtgaaagattccggaccgggaattgcaccggaagacttacctaacatctttaataagttctggcgtaaagatcaaaaggttgacggtactggcctggggcttaccttggcaaaagacctgtgtgaactgctcggttacgaaattaaagtaaagtcgaaactcggtcgtggaagcagtttttatattgttattaaggaagggtttagcgatgtataaaattttagtggtggaagatgaccagaaaatccaaaaagctcttgcccatcttttaaaggctgaaaattacgattttgtgcaggcgtacgatggagaggcggcagtagaacatttttaccgggaaaattttgaccttgttatattagatttaaaccttccgaaacaggacggattttcggtattaaaggaaattaaaaaccgggaagacgttccggtaattatcctaactgcccgaggggaggagatggataagattaccggatttacccttggagtagatgattacttaaccaaaccctttagtcctgcggaattaatgcttagaataaaggcagtcttgcgtcgttaccgcaaaggcaggggtgaggaggagatcctgaaatatggtaaggtagctgtgaacttaaaaacccgggaggtcttaaaaaacggggagccggtggagttgacttctaaagaatatgctttactggaactcctttttaaaaaccccaaccggatatttactaaagaacagataatggataggctttggccggatacttttcccgaggatcccaatatcgtttcggtattggttcgaagactccgggaaaaaatagaagaagaccccagttccccgcggattattaaaacggtctggggagttggttataaagcagaaaaaatatagaaaggagcaggaaaaatggatttaaaattgtctcacgttactttatttgtacgggaccaggaagaagctttagcctggtatacggaaaaacttggatttgtaaaaagagaagacaacaattttggccacggtatgcggtggcttactatctctccggccaatcaacctgaaattgaatttgtcctttttaaaccttttggggaaaatgctgaagaacagttaaaactggtaggaaaaaatggcacctgggttttcttaacttctgactgtcggaaaacctgcgaggagttagcagcccgtggtgttgaaattgtttcgcctccgcaggaggtaccatggggagtttcagccctttttaaagatttatatggcaatatttacaacttagttgaaagaaagtaaccgttagggacggttcttagaaccaccattttcactatcgacagaaagcccgcagcatttagactgcgggctttctttatagagaaagggcgggtggattatttcttagcttccaaagcttttaatcttgcttgataggcaagttcgatagacttatttaaagtagcgaaagctttcgccgggttatggaaaccggtggagttttccgccgctacataatcccagtaccactgactttcccgttgaagtttttgcgcttcggctaaaattgcaggatcataagtgcctgctgccaccgatttgataacctttaaagtttcggcattggcttctcctgcccggtcgatagcggctttcacccgatcctgaatgtaaaataccctctccattaaatacttggcatctttagtgtggcactttttacaggcggacatgtcttttaaaggtgatgtccactggtggcttgctatagtaaacgtaagatttccactttttacggttttcttgggcatgtggcaatcggcacaggtagcgcctgcctgctggtgcgtgcttccctggaacatttcaaattccggatgctgggcttttagttcttttacaaaggtagagggattggtccagtcgctaaaggctcgttcttcatagtactggtagatgttttccggatcaaatcctttatcccaggggaaggttaacttcttgccgttttgcgggtcaaagaagtattccacgtggcactgaccacagacataagtgcgcatctgggactgtgacgctttggttacatcaattcctcgacgcttcatagcttcaatgaatgctggccgtgtaacaactaacttgaaggtttttaaatcgtggcagtcgctgcagccgatggagtgtttaaattcatcctgataaaccagcattggtaaagtatagtaggcatcgccgtactttttcattgcggccggcacatcggaagacttacaggtcatacaggtcatcggagttgcgggagacagtcgcttggtcgattttacatcttctaaagtataatagtgtccccggtcttcgttgtagtctttgctgaagggatagccttcccagagggtttttaagtacggagattcttctaagtgggaatagggtattgagccgccgtacttactgggctcctttttcatttcactgtttttaaagaaagttttagaaacttccgcaatgatttgcgaaagggtaggttttggcggggctttttttacagcagcttcggtagtaaccaccgggcttactattaccaaagctaaaattaaaagtaaaagtccgccggagataagataataaaacttcttcatgaacatccctccttgaaagtgtttgttttcacttttactctaagagatatttcttacaaaattcttacaaaatttattttttcataaaattttcttgacgaatggggaagtaactgggaaaataaaagtaaaaatataccagtaaaggaatggtaggcgtgactatttctataaaaaaactacttaaaattttaggaattattttaatcttcagcggaattggtttttattttaataaagttatcattaaagatatttgcgtaaaatcctattatcaacatttattaaaagctgagtatgataaagcagcaaactacctgttttactgggataaatattctgatagacctgcaaagcttccggctcttgcagcaaagaatctttatctgcgaaagactgaactactaacaggtcgaggttatagggtggtagaaataaaagatatttcaaggcgtattgatgatggacttttaatttatcgggttcagggtacttatgaagttaatggtgagcgaaatagctttgaagatgaactttactttattaacaataaaattatgattgaaaatagcactgacccctacctaagataccgggacgggaaaattgccagaatatttcaggaaagctatgacgaaggcttaatctttgccgatttaaataatttaattcaggaaaaagaaaaaaagagcgagtacaatggaatcattgtattcgtaagaggtgctattgccgacggagtaagaactgttcttaaagtggcggtagagggaaaatatccaggaaaagaagagtgggattttggaaatattcagttgattgatggagcggggaagaggtatttgccggttaagtggagcaaaggcagtgaggatgagaccttaattgaatttgccggaagtccaacgaaaaataccgatgtaaccttaacgttaaaaagaataaatggggtcgaaggaaagtgggaagtgaaatttcccttaaaggtcttccggccggtggagttaggttttaacatttcaggaaaagaacatgggaacgaactaaaaataaagaaaattatctttgctaaaaccattactaaaattgaaggagaaattagcggtgacgacttatttgaagaaacttatgcaattattgcagggaataaaattaattttaaatccgttagtgtggataaccaatcacataaaataaacttatatttaatgccggttgactatttgaaggtaaataacttgaaaattgttataaaatttagtaatcccgggaccaaagaaagtttctttttaaatacggatttaaaatggtaatcgaggtggttacttatgccctttgcgtggatggattttttgtggacggtaattaacttttgtatattaattggaatgctttatattgcggtaaggtttattaaaaaatactggtagtcttatttttaaaggtggtaaaaaaggtgaggagaaaaggaatttttatcctattaattgttttaatattcctctttttattttttaacttaactccagcggcagaaattttaaatgataaatttaaacagtttggcgaatttctaaaaaaagttaatcatgataaaaagtatgatgtagttgttgccagaattggtgaccgggatgtgacgctaagagagtttgaactgtttaaaagaagttatgttttagacggcagaactgttactccggaagaggtgctggaggaattaaagagacgaacggtgttgaaggaagaagccgaaaaaagaaaaataactgtttccgatgaagaagtagaaaaggcaatccaggattataaagaagggatggaaaacttaaaaaagaccaatccggcagagtatagcgagtttctaagttaccttgaagggttaaatatgaccgaagaacaatactggaaaagtaaagaaatttttgaaatttaccgtaaggctcttgtaacagggaaggttcggaaagcgattttaaaagagttaagcgaaaaatataaccttactggaaatgagcttcagaaaaagtatcgggattatatcgaagaagaaaaggcaaaacttaaagttaaaattttaaaaccagaacttatcggaataaaaaacagtacagattcctaagagccgcagcctaccttgggatatattaacagtaagttttaaccaaaggggtgtggctttttatgttaagtaaatttggggacggtgattttacagttgggaagaaaaatatctttaattatttttatttggttttttttaaatttatttttatttaacaatgaaataagtacaatagcaggtaatttgtttcaaactcctgcagataaaaataaggaaatgaaggagctggggatttttcttggtaacgatgtgaaaatagataacgaggagttaagaaatatagattttaggaaattgaaaaataaggttaatgaatttttaggagaaaaagattttaaaattaccttaactaatattgaaatggagggaaaccaaagaaatattgaagttaaagtaaaattaagtgacggtacaaggtatataacgctcgttccagagctcaattatgaagtagtgagatttactgatgaaaatgccataagttctaatttaagcctaccggtaatagctcatgaaatagccaaagagactgcctttaattttgtcataaagcattttaagccgtttaattcatataacatgattttggacgaagacaagtattttaatcgagggtctctgcgagaatatagatttgtatggaatgcggtagatgacgaaataaaacttcccatatttgttgccgcagcggttgatgccataagcggtaaaataattagttacacctgtggttatactggtgaaaagtttaaaaagttaacgccgagaatatcaacaaaagaagcgttagaaatacttgagaaaaaataccccggtaacgaaattaaagattacaacattacattaatgattgggattaatcataagagcaaagttcaggaaaatattttaaaatattcgattgaatataaatttaacgttccccaggataaatgctttgatgaaaaaggcaaatggattcatcacggtggaaggatagaaataaatgcggaatcgggggaaattatcactgaagggatttattaaaatctaagattttggggaggatggttttaatgagtattggagatgatggtttgggcgtggctgtgaaggaaaggaagatattttcatgaaaaagaaaaaatatttttaattttattttgggtattattcttttgctttcactgcctgtagtaccaattatgatgaaaatacattaaaaagtattttaataaaagaaataaaagaaaatattctgccagccgaaaatatcaaggtagttttattaaaaaaatttaataaaaatgagtatgttgctatttgtaattatgacattgtaaatataaattatgaagatctcgtgcaaataaatattaaatacggtaaagttaacgtatatggcttaggcggaggtattggaaaaaccagtcccgatcaaaagatgaccatttccagtacttcgtatgattcggaaaagttcaaatttttaatggtttacggaacagtatttgataaacgtattgccaaagttaaggtagtttatgttgatggtaaagaggaagtaagcgatgtaagttacgaaagcgatcttggcggatatctcttctaccgggagaattatgtaaaaggctttaaaagagtagaagcctatgataaaaatggcaatttgatagaaagatccgatcagttgggaggctaatttacctcttggctcagcccttttgcagtatccggcggtaattaatattagcggtattgctgctggttttctattacttggattaatctttaaatcccaaaaacatttttccggctaattttttggactaagagagtacctatccaggcaaaggtttgatagcccacaattagacttagtaataaaacgcccggtaaggacattattaagcgttctaccgtaaacgaaaggattaccggattgacgattatagatttttcaaaggacaaggaaattgtgaagaagcttttgccacagtttgagtttattttccagcaaagtatgaattaacatttaattatgagggattttaaaatcctgctaagtggcaggatttttttatgtactgcaattgatcgagcatgcaaagcaatactatttcagcccgcataatatgaccgtgccttgaggtacgccgctatctaaagcggtgtcatgcggttaaagcgataggattttttcttttttacccccttttcccgtcaccctttcccaattcccgcatatcatatagggaagagtgtgcgggagggatggtatgggtgttttaggtgcacttattaccctggtagtggaaggccttttatttctacttgggtatttggctggcagtgcttttccccagccgttatcggaagaagaggaggcttactacattgataggcttttacagggtgaccgggaggcccgggatgtgctggcggagcggaatttacggctggttgcccatattgtaaaaaaatttgaaggtaccggagaggcaacggaagatttaatttccattggtaccattgggcttattaaagctatcgatacctttcgccccgataaaggaactaagcttgctacctatgcggcaaaatgcgtggaaaatgaaattttaatgcatcttcgtgccaccaagaaaaaccggggtgaggtttccctttatgatcccatcggttttgataaagagggaaatgaaattacccttttagatattctcggcacccggggagatatcgttttagagcaggtggtgcggatgctcgatgccgagactatcgagaaaaatttaaagaaactaactccccgggaacgaaaggtaattgaagaaaggtttggactttcccaaacccccaggaaaacccagcgggaaattgccaaaaaaatggggatttcccggtcgtatgtatcaaggattgaaaaaagagccatcttaaagcttttaaactgttttcccgaaaataaggtaaaattttaagccgccttaaattttaggcggctttttgaagtattagtcagttaggtggtaaggaacactggttactaaaacattttttctaaaaagcagtaaagtctttagcttaaaaccggtttggttatgaagaagaaaatgccaccatttatgagggacaaattcgggaataaccaccataataaaacggcctttttctacagctctgtgctccatatggttgataaatcttaaaagtgggccgtaaacatcccggtaagcagaagtaatgaccagtagttttgccgggactttaaatttttcccacttttcttcaatttttgctttgctttcctcattaaaagcaatgttgatagctattacatcctccgagatagagcgggcgtacttaatagcgtttaaaactactttattaaaacttgctacaggaataattactaagggtgattggttttcagttttccagatatcttcaggtatcgaaactactcttaattgttcggctatagctaaatagtgacgtttaattttggaaaagagaagaatcattagcgggattaaaataacaacaatccaagcgccacccaaaaatttagtggtagcaattattattgaggcaataccggtggcaatagctccgagactgttgattaaaatattaactttccaaccgctttcttttgttttataccagtgcttaatcaagcctgcctgcattaaggtaaaggaaacaaaaacccctacagcgtacagagggattaaagcgtgagtatcgcctttaaaaataattattaacagagaagaaattactcctaagattacaataccatgactgaaaactaaacgggtcccgaggaccgaaaggattcttgggagataaccatctctggccattaaacaggaaagacgaggaaaaccgttaaaactggagtttgctgccaaaaacaaaattatagctgtgctggcttgtaccaggtaataaaaaagggttttcccaaaaattatccgggcgatttgcgaaacaactgtttcgccaactttagggacaacatttaagttataggcgaggtaggttattccaaagaataatgttcccaataaaagggccatccaaaccatcgtgatgcgggcgtttttgtcttcaggcgggaaaaaagccggaacgccgttagaaattgtttcaactccggtaagagcggtacaaccggaagaaaaggcttttaacaataaaaaaagagttaagggggcaaaactttctgccgttgtagtaactggtaatggagtaagttgaccagtaataagtttataagttcccactcctattaaaataagaaaagtaaaaataaaagcataagtaggaatagcaaaaaaggtaccggattcacgtatacctctaaggttcataatagtgataaataataccgttaacacgcctaaaatcacccgatagggataaagggaaggaaaagctgaggtaatagcagcaatacctgaacttacactaactgctacagttaaaatgtaatcaactaacagtgatgacccggcaattaatcccggaacctgacctaaattttctaaagatactacataagctccgccaccattgggataagctaaaattccctggcggtaggataaggttaatattcctaagagaaataaaatagcaattgaaatggggagagataattttaatgctacgggaccggcagctattaaaacaagtaaaatttcttcggtcgcataagcaaccgatgataaagcatcagaggaaaaaattgctaaagctttaattttggttaaacgttcttcagcaattttttctgtcctgagtggagagccaattaacaagtcttttatgcggtaattcataaaaccttcctcctgaaaatcttttgtttcgctacaacaattaattaaactactttcatgtttaaaaataaatcttagaaattaagcaaaatgaacgaaagatttttaaataaccatcattttattaatgattaaattaaggccttttaaacattgttattttatgaaattgcgtgatttttaaaccaccgcctttttttaacgacctggtttagccatatttatgtatttacaaaaaaacgttttttcgatattcttaaatcagaatatcggaggtggaaacttgcgtttaagaagcaaattatggattgtaaccgatgagggagaaaaattgtttggtgatggaccgtatcgcctgttattaggagtgcaaaagactggttctttaaagcgggctgccgaagaacaaaagatggcttacagtaaagcgtatatgatgataaaagccttggaacaaaggcttggaataaaacttttaaacttttacaaaggcggaaaagggggcggaagggctgaattaaccggggacggacttaagcttttagaaaaatatggggaatttcgcaaccgtgcccaggattatctggatgaattgtttgcggcttattttaaggaggagtaaggtaatgcagtcaataattaacttatttctggcttttttaaaagtaggggcgttctcctttgggggagcgtactctttaattcccataattgaaagggaagtggtggaacattaccggtggctgaccaaagacgaatttatggaagtactgggaataacccaggctattccgggagcaatttccgccaaatttgctacctataccggttacaaagttgcaggtataataggagtggttgttgccaatattggtaatattctaccaccggttttattaatgcttagcttaatcgggatactctttaaaattggccatcatccgctaactaaaaattttataaagggagtaaaatacggtacctttgcgatggtactgggctttggggtgtcaatgcttttaaagacaagttttgcagtaaaaggatatataattgctgcgctggtttttaccgcggtagctttttttaattttgatcccgctttaaccattgttggagcaggaattttaggtataatcttatttaaatagaggtggaaataatgaaaaaagttccggtgcaggaagcgatagggatggtattatgccacgatataaccaaaatcgtcccgggagaatttaaaggtcctgcctttaaaaaaggccatattatccgggaagaagacattcccgaacttttaaagttgggaaaagatcacatttacgtctgggaagtaaaagagggaattctccacgaaaacgaggcagcccagagaattgcccgggcagttggtggagaccggtttatttttaccgaaccaaaagaaggaaaagttaatcttttagtaaaggaacggggacttttcaaagtcgatcgcgaggctttatttgagataaatatgttgggagaacttatggtttctacccttcacaccaaccgggtggtagggcccggtcagtatgtggccggcacccggattattcccctggtgattgaagaggaaaagataaaaaaagtagaagagatttgtcgggataaaaaggttttagaggtaaaacccttagcccaaccaaaggtaggggttgttaataccggtaacgaaattttttatggccggattgaagacaagtttacaccggtgttggcggaaaagttaaaagcttttgggttaacaatagacatgcatcttaaagcgcccgatgatgtcgagaaaatcgccgaagccattttaaaactaaaagaagcgggtatggagctaattttagctaccggtggaatgtcggtagaccccgatgacctgacgccgggaggaattaagagagccggtggcgaagtagtagtatatgggtcgccggtgcttcccggtgctatgttcctgtatgctcttttggatggagtaccggttttaggacttcccggttgtgtcatgtacagtaaaaccaccatttttgatttggttcttccgcggatcttagccggggaagtattaaccagaaaagatattgcagctttagggcacggaggcctttgccttgagtgtccggtttgcacctacccccattgtccctttggaaaataaaggaggcaatatgttaaactatttttggccggatttatatttagaaaaggttactgtactggatgaagagctcttaaaaaaatataatttaaaaggaataattcttgaccttgataacaccatttccccctggggggagaaaaccattccccgggatgtggttaaatgggtaaaaaaattgcaagagtttgggataaagttttgcctggtttccaacaacagcaacgagcgggtgcgagaagtggctgtttttctgggtatcccttatgtagcccgggccattaaaccccggaggcgggcgtttttgcagggagtggagcttatggggcttaagccgtcggaagtggcggtgataggagatcagcttttaaccgacataattggagccaaaagagcggggttaatggcgatcctggtaacacctatggcttcccgggagtttatcggaacgaaaattaacaggtttatcgaaagttaccttttaaagcgacttttacaaaagggtctgaaaatatacggacctcaggggggattaaatggccatgcggataaacggtgaaaccaaactaacggggataatcggttatcctttaaaacataccctttcccctcagatgcataatgaagcttttaaagccctaaatttaaatttcctgtacctgcccctggaagttgctgaagaaagcttgccccaggccatctatggcctaaaagcttttaactttcgggggattaacgtaaccattccttataaagaaaaggtttttccttttttagatgaagtagcaacggaagcaaaaaccattggtgcggtaaataccatcgtccatgaccggggtaggcttattggttacaataccgatgcccccggctttttattaagtttaaaagaaaacgacgttgaagttaccgggaaaaaagttttgctcttaggagcggggggagcggcacgggcggtagcgtatgcgcttttaaccgccggagctgaacttatcattgctaaccgcaccatcgataaggcaaaggaattagctaaagacttccagggagtcgggaaaatatccgaaattcttgaacttggcgataaacccatttcccttgcgccttatcatatggcggttaatactttacccctgggaatgcatccttatgaaaaccagatgccggcggtggattttaccggcgttacttccgattttgtggcttacgaccttatttataaccctgccgaaactaaattcctgaaagcttctaaagaaaaaggtgccaggacaataaacggtctttccatgctgctctggcagggtgttctggcttttgaaaaatggaccggggttagcccgccggttaaggtgatgaaaaaagctatcggcctttcttgttaaagagccgggaatcaagtaaaatagaggtaaattttactgatgggggttgtgcgatgtttcggtatttaacttcgggggaatcccacggtgaaggattatatgtgattttggaaggagtgccggcaggacttaaggttgaccttgattacataaaccacgaactttcccgccggcaactgggctatggccggggggagcggatgaaaatagaaaaggatgaagcgcaaattttaacaggcgtccggggaggctttgctaccggagcacctattaccataaaggttaaaaaccgggattatgaaaactgggagaagtttatgcggaccaccggagaaatcgaaccgggaagggaggttaccgtgcctcgccctggtcatgccgatttagccggggggttaaagtacgggcataaagatttaaggaacgttttggaaagggcttcggcccgggagacggcggtccgggtagctgcgggagcagttgccaaactttttttggcggagttcggcgttcggatttacagtcacgtattgagaataggttcggtggaagtggaatatcccgggggtcttcctgaagaagagctaaaaaaagccgatgaacaccccctgcgttgtcttgacgcccaggttgagggacggatgctcaaatgggtggatcgggcccgggaaaacggggatactttgggtggcatttttgaggtggtggtgtttgggctacccccgggcctgggaagctacgttcactgggacagaaaattagatggccgtctggccggagcattaatggccattccttcggccaaaggggtcgagattggcgatggtattgctcttgccaatattcccggacggatggcggtggatgagatttattacgaaaatggccacttttaccggaaaaccaataaagccggggggttagaaggcggagtaaccaatggcatgccgttaatagccaaagtttccttaaaacccattcccactcaggtaaagcccttaaaatcggtggacatcgttaccaaggaaacaaagccggctcaagtggaacggtcggacataacagccgttccggcggcgggagtagtaggggaagcagttactgccctggtattaatggaaagctttcttgaaaaatttggcggtgaccgaatcgaggaaacaaaaagaaactatcaaaattatcttcaatctatagccaattattagaaggaaaagagaattttatagcgaaaagttattattatagaaaggtgaaaaaatgaacaagcgctttatagactgtcttggggaaatgtgccccataccggtgataaaagccgaagaagagtttaaaaagctcaatcccggtgaaagctttgttttagaaacggatcatagctgtgctcctctatttataaaaaaacagttaaaaaaatataaatgcaaaattaaagtaaaagaagttgattttggcatctggcaggttacggtcgaaaagtgttaaggaggactaaatcctttgcagaccgaaaagagagcttattatttatcggtaataccgggttatttattattgataggtctggggatagcgttatctatcataaatcctgctatgcttttgtattattttttgggtatgggcataggttttgccatgcaaaaaagtcggatttgcgtggcatcagcctttaatgatttatttttgtttaaaaaccctgtcggtatgaaaaatctttttttcttaattttatttaccactgtagtatttagtagcctgcagttttttttaccaacgcatttcggtaagggatcgatttactataccggaccctttaacctgttaggcggtattttatttggttttggcatggtctgggctggcggttgtgccgggagtaccctggtaaggatgggggaaggccaattggcggcctttttaacctttatttttatgtttttcggtacctttttgggaacatatctttttaactttatctgggaaatggtaatttcctttaaacccgtttatttaccggaaactttaggatggttaaacgctattttattacagttgtttttaatagtcttaataatcttagtgttttatttttgggaaaaaaaacaggaagatttggcagaagtcgagttagaatgggaagatactcccttttggaaaagaccctggccttatctggtaggggctttgttttttgtggtatttagtggactcatcttttatttttcggagaaagtgtggcgggttaataccgtcttttccttctggggtttatggctcttaaaaagtctcggaataaacattgaaaactggaagtttcttgctttatcaagccaccggcaaatttacgaaaatgggtttggggcacttgtttttaactttgttaattttggtgttatcgccggaggctttttagcttcttcaatttctggagaatttaggattcgcaaaattcgaaaaccaatccagttctgggggagcattttaggtggttttttaatgggtataggtgcccgtttatcctttggttgttccatcggagcttttatcggaggaatagcttccttttccctgcacggttggttattttttgctggcttactggtaggggcttttttgggaaccaggggattaaaatattattaccttaaagcaggaaaaaattaagatagctcgaatatttataagcgttgcggataaagtggcttttggagggatggggtaagatgaaaataaaaaaagtaattgcccttttagcggtgattgtgttaacgttagcttttactcagggttgtggtttaaagagagaaagtaagcttgtaaagatgtataaggagcttgatttaaaagattttaaaagccaggagttagtgggggataaaaataaatcggagaagctggcacgggaagtttatgtagaaccccagctatccagggttttaaagtatttagaattcctacggaaaaatgacacgaagtttattttatataaagttgattataaaaaaattgaaattaaagagcaaaaggatgatatggcaaaactgttagtggaaagtgaagttaccggcgatttcttcaccataaaatatcccgagaaaaagttggattctttagtggcgagacctcttaaatacgaaattactttaaaaaaggtcaacgataaatggtacatttccgatgccaaacctttaagttaagggctgaaagcaagcgctttcagcccttttttaacagaaacctcgttctttgggagaattaataaaagctaaaaactttttctccaaaagggaacgttttttattttttagcgtaatagctacaaaaggatgaagcagggatatgtctttaactttaatcgattttagacttccggttctaagttctttttttaccgcaaaccgtgggagcagcgatacaccttttccagattccaccgctactttaatagcatcgatgctgtttacctccattacgatgtttaaatcggaaatattaagtcctttttctgccagagctttttcgatagtctgcctgatacccgatcctttttcgcgaatgataaaggggagagttcttagttcgtcaagggtaagaatttctttgttcttataagaattattattggggactactaagacaagctcatcgtaagttaaatgagaagagataaattcgttactttcaatgttactttccactaaacctatatcaatttgccggtctaacagggcttcgataactttttcggtattcataatggttagcttaatacgggcggattcgtacttttcctggaagatgtaaatgctacagggtaaggcataaccgcctatggttgaggctgctccaatcgataattcttcttcttccaggttttttaaacgctcgatttcttcatttaaattttttaccagattgcagattcgcttggcgtagtaaagcagagtttcccccgcttcggttaattcaatcccgcggtttgttcgttccatcagtttaacctgcagctggttttccaaggcggcaatttgcgtggaaagggcaggttgggacaaatgcattaactttgcagctttggagatgctgccctgctccacgatattgcaaaaagcttccaattggtttaaattcacccggatacaccctccccttattaagaagccaaataagtcttaaaattcacaaacctttttataacttttttcggcataagtttttaaattccttctttttcataagatttatttatataaaacggtggggtttatctataacgtgaaaaggtgtaaaccggataagggggtgttacgttctatctaaaaaaatataaaatcagattaagttttcttggtaataaaaaagcaatgatatagttctttgaggggaaattgctgtggatacggcagttagcagggttaacaattcacctctttttttatgcaaaagttgttgaattcaggttaaaaaaggcatataatgaattaaagatgttgatttgccggatgttgctgtgaaggcggtaattggcaggattgggggagcaacttccggctttttttgtatatttttatttgtatatttttaaaggaaagggttgttaaaatgaacatcattttagtgggactaccgggggctggcaaaacacatataggtcggattttagcgaggaaattaaaaaggaattttgtggatcttgaccggaagattgaagaagagacgggacttacgattaaagaaatatttgcccgtttcggtgagcgctatttccgccgtttggaagtaaagaaactacaggaactttttaaacttcataatgcggtgattgccaccggtgggggaacggtagaacgaatggatgcgagaagaaagttaaaaaatcttggcttagtggtttatttaaaggcgtccccggaagttataatccggcgtcttattaatttagaaaatagaccaatacttacccagggggaccctttagaaaagctttcggagctttaccgtcgccgggataagttttaccgggaagtttccgatgtagcaattaataccgaaggtaaagactcaggcgaggtcgttgacgcgatcctaaaatccctgactattgatggtttacggtttccccggaaactttacattaatttggctgaaaatagttatccggtatattttggcgaaaaagtggcgttaaaagcgggtgagtttttaaaagaaaaagttaccgggaaaaagattttaattgtttcccaggaaaatatctttggtttatatggcaaaactttagaagaaagtttaacaaaggaaggttttaaaaccgacgttttttttcttccccagggggaagttgcaaaatctatggaatatattgtgaagctttacgataaagccatagagtttggactacgccgccatgataccgttatggcctttgggggaggagtagtaggagatgctactggattttttgccgcaacctatttgcggggaatcaattttgtccaggtaccgacaactcttctttctatggtggatagcagtgtaggggggaaagtggggattaaccttccccaagggaaaaacctggtaggagccttttaccagccaaaagtagtgttaatagatactacttacctaaaaactcttcccagaagagaagtgctggcgggattggctgaaatttataaagcgtttttaattgctgaagaaagccttgtcgggtggctttccggattaaacctggataagctccgtccaagggattggcaaaggattatcaaggcggcggtaaaaataaaagcaaaggttgtatccctcgatgaacgggaagaagggttacgggcggtattaaatttaggccacaccataggccatgcgatagaaggtgtaaacgggttttccggtattcttcacggcgaagcggtagctctgggaatattatgggaagccaagctctctaaagatttaggatatttaagggaggaggaatgggaaaaaatacgggagtttatcgagaaaaattatgcttacttaaaactatccttaaatcccgatagcttacttgtttttatggataaagataaaaaaaatcgggaagatatcgcttttatgcttttaaagaagattggtgaatacccggaaaatgttgaaataaagagagaatggttacaaaagtggttaacgttgaatttttcttaaaggatttttgtttttttttgacgaactcttaaggtaaaatccgatgggagtgcggagctaagatgagtgaagcgaaagatggcaaaaaaaccaagagactgggtgattttttagtagaaaatgggcttattaccgaagaacaattacagaaagctttggagtatcagaaaagaacgggagagcgcctgggacaagctttgattaaacttggctatgtttcggaacaggatatcatgggggttttagagtttcaattgggaattccccaggttgctttatataattattcgttagacccggccttaattaaaagcatacccgagtcgctaattaaaaggcataaggtaatacccttaaaacgcgagggcaaccgcttaaccgttgccatggttgaccctttaaatgtggttgccattgacgacttaaggcttgccaccaatttagatattatcccggtcattgcttcggaaaaagaaattgatgccgttattaaccgtttttttggcgctattgatttaaacgaaaccattaaggacatagaaaaagcgggcgaagagccggaagtaataaaaaatgaagagacagaagaggttttggttgatgaagcgccggtggtgcgactggtgaattccctcttactgcaggcggtaaaccagagggcgtccgatgtccatattgagccttttgaagatatggtaagagtacgctttagggtagacggttttttaagagaagttatgactttgccccgggcgattagaagttcccttacttcccggataaaaataatggccaatatgaacattaccgagaagcggcttccccaggatgggcggattaagataaaagtagccaatcgccaggtagatatgcgggtggctacaactccgacgttatttggggaaaaggtggtcataagacttctggatcaggaaaatgcctttttaactttagatagactgggactttccagtaaaaacagcgaaagatttaataaaatcctggcccaaccccacggcatgattttaattgccggccctaccggaagcggcaaaactaccaccctttatgctgctttaaaccaaattcatgacccttccaaaaatattattaccattgaggacccagttgagtatgttatgcccggggtaacccaaatccaggttaatccgaaagttggactcacctttgcggtgggcttgcgctcaattctgcgccttgatcccgatatcattatggtaggcgaaattagggaccgggaaactgcagaaatagcggtaaaagcggccaataccgggcatcttgtattatctaccattcacaccaatgatgcagtttctactgtgagccgtctggtagaaatggggattgaagcgtacttggttgctgcttcgcttgtgggaatagtggctcaacgcctggtgcgcaaactttgcccggaatgcaaagcttctactaaaattggtcccgatgatcctgcttatcatgccttaaatctcggccaaggagagacggtaaccgtttaccggccggtgggctgcccggcatgtgaaaacacgggctataaagggcgggttggcatccatgaagttttaataaattctcgaaaagttagaaatcttattgtcaacggcggctcttatgatgaaatgttggcaaccgtgcgggaagaaggaatggtcttaatgttggaagacgggcgggaaaaagttctggcaggtattaccgcgccggaagagattatccgggtggccagtacggttaactaaaaggtggcaggtgaagtttttatgattaatgagcttttacggttaatggtagagtttaaagcgtcggacttgcatttaacggtgaactttcccccggcttaccggattcacggcaatatccggccgctaacggagcttgccagggaaaatccggggataccgcaaagcttgacaaggcttttaaccatgagcgataccgaaaccatggcccggacgattatgtcgaccgagcagtgggaaaaatttgcgaaaatgggtgaactggactttgcctactctctaccggatgtgggccgttttcgggtaaacgtctttcgccagcgaggagcggtagctttagttctccggcatattaattcgaaaatattgtcctttaaagagttgggccttccggaagttattgccgatctgtcccggaaaaatcgggggattgtcctggtaaccggtcccaccggtagcggtaaatcaaccaccctggcttcaatgattgatttaatcaatagcgagcgagcctgtcacatcataaccctggaagatccgattgaatatctgcatacccataaaaaaagtgtggtaaaccagcgggaaataggcagtgataccgaaagctttgccaaggctttgcgggctgcgatgcgggaagatccggacgtcatccttgtgggtgagatgcgggacttagaaactatttctatcgcgattacggcggcagaaactggacacctggtttttgcgaccctgcacacttccagtgctgcggaaaccattgaccggatcatagacgttttccccccttcccagcagcagcaaattcgcgtacagctttccaccaccattcaggggataattgcccagcagttaattccccggatggatggtaaaggccgggtagtggcggtggaggtcatggtggcaactccagcaataagaaaccttatccgggagggtaaaacccaccaaatccctgcccagattcaaaccggggctaaatacggaatgcagacgttagatatggcattagcgaaactttatcaaaatcggcttatttcttatgaagaagctatttcccgggcccatgatcccgaaagtttagcccgaatgttatattaaatttgggaaaaatttttgtcgaagaaaattacaaaatatattaaaatattaaacaaaaggaatagtttgtgaaggttataaggaaaggaggagagttatgccccagtaccggtataaagctaaagacctttcgggacgagtggttagtggtttggtagaagcggaatcggaagtaggggcgagaaatctcctccgggaaaaacgcttttttgttctggaattgaaaaaaagtgatggagcggtaaattcaggattttcctttagttttcaacgaaagttaaaagccaaggatttagccttaatggccaaacagttagggacaatgatagcggccggggtaccccttctgacggcggtcaatgtcctgtcccgccaggtggaaaataaaactttgaaaaaaagcctcattagaattgaagaaaaacttcgtaacggtaataccctttccgaaagcttgcgggaggagaaaatttttcccgaacttatgtgcagtatggtggaagtgggcgaagttggcggtgttttagacaacgtccttgatcggctttcccttcactacgaaaaggaagcccagttaagcgaaaaaatccgctcggcgatgacttacccgatggtggttttatttgctgccattgccgctgtcttggtactggttacatacgtacttccgcagtttacaggtatcttgttgcaggcaaatatcgaacttcctctgattactcaggtagtcataaaaataaccaattttttctcccagcatgcggcaactatttttctcactttaggtgcaattattggaggacttctttactggttttcaacccctccagggcgaaaaatccgggatcagttatcccttaatatgccccttattggtactctggttttaaaagggattattgcccgcttttcccgaaccatggcaactttagtccagggcggggttccgatgcttcagtctttaagggtggtgcaaaaaacccttggtaatggggaaatgcaaaaagtactggagttagccgaagataaggttagagaaggagaaagcctggccacttttttagcccagagccgttggtttccgccgcttctaacccagatgatgttagtgggggaagaaaccggtcagctggatgcaatgcttaccaaagctgctgatttctatgaagcggaagtagatgcggcggtgggaaggctttcgtcaataattgagccggtcttgattttatttatgggtggcattgtaggcttaatcattgtgtccatcatgctgccgatgtttaacatggtaaatgcggttaaatagtttttaccccctttttttcggggtaaaaataatgggtacttaatgaaaaagtttcataactttgccgagagaggaggtgaaagggatgaaaataagacaagcccttaagaaccagaaaggttttactttggtggaactgatggtggtggttatcatcatcggtatcctggctgctattgctctgccgaacttctacaaacaggcggataaggccaaagtaggaagagcaaagtcggagttggctcagatgaggagtattttgattacttataagagtgagtataataaattgcctgacgattttacagcattattgaaggataatggttttagtaacgggattcctaatgatccttggggtaatccttatgattatcaagctggtaatccatcaactggtccaaatgccaacttcttagtttattctaaaggtgctgatggtcaaccttcaactggtgacgaagtttacgctgatgttaatggggttgatcaaggtaagaagccttaatttttaaatatttttgggcggggttgtcccgccctaatatccatttttttcgaggtgaagaagtggaagttttaataatctttctttttggcctgataattggaagctttttaaatgtagttatctatagacttcccagaggacaatcaatactgtatcctccatcgacctgtccaaactgcggtcaaagactaaaaccatggcacttaattccagtattaagctttctcttgcaaaaaggtcgctgtgcttattgcggggggaagatatcttttaaataccctttggtggagttaatcaccgcttttatctttagcgttgtgcacttgaaatttggcttaagtttattaactctaaaatatctacttttttttattttccttatcccgctattttttcttgacctggaaaactttctcctgccggataagctaacttaccctttatttctggcaggagttttgataaaccttattacccgggagctttcctggaaaagcttaatttttggcgttattaccggttttggcttactgttcctcctggctcttatctcccgcggaggtatgggcggaggggatattaagcttgccgcagggctcggggcatttttgggttttccccttattttagagacgctatttttagcgtttttctttggcgggcttactgggataattttgcttttgacgaaaaaaaaggctcgcggtgacatggtaccttttggcccgtttttaataggggcagcatttattaccgttttatggggagaaaaaattataaaatggtatttaaaaatatttttcctgtaaccgaaaaaggctttactttaatcgagctcattgtggtaataactatagccggtataatttttttaacggcggcaattagcttagattatactttagcaaagattactttggccaatgatgcttatgctttagctcaaaatttacgtcaaacaaaagaattggcctcagcgcaggaaaaggcttttactttgtacttttttcaggagaataatagctacttaatctcggaaaattataaagctaataaactttatgttttatctcctcggttaaaatttattgctgtaccgttggatccagttacaattgattataaaggaagcagccgggccttttcggtggaaatggctaatagttatggagtaaaggttcgggtttatactactcccagaaccgaccggatttggattactcccttttattaggtggtgggatgatgaaggaaaagggatttagcttagttgaaacaatggtagcagtcctgcttttattgctaattttaattccgttattaaatcttcttacggccagcagtttttcttataatgctgctggcaaccaaactaaagccttaaatgcggcccgggaaataattgaagagcttcggcttaaaagttacgagcaaattaacaatacttccggggtaactccggacggttttaaatacagcttaagtgttgtaaataaatccactaatctgaattttgctattccctataaagaagtgtcggtaaccgtttattaccctactggtacgggagagaagacggtagttttaactactgtgttcaccccgcgaaacaggtgattttatgaaagataagggttttacgttagtagagctgctggtggttttagttataggcagtatcattatgctggttgtttttaatttatttgtctttacctataacctgtggtttaagggccagaaagcaattgattaccaggaacagctgcgctttgcaatggatcggatggcccgggaaattcgaacagcctcggcggtatataatccgtatgtaaaccctccgtcacctggcactgcttatacccaggtttatttagtaaataccgtaaacaacgagacctaccgggtttattactatttaaactctcttaataaaactttataccgcaaggtttactatccaaataacaaccaaacaacggaccctctgataagtgatgtcaattttaccgtatattatttaggttatgatgcggttaccaacaaaatttataacttaaaactcaatcttagtttaattaataaaccttctgctaccctttccacttcggtggtaaccagggtaacgagataggtggtgaaattttgttaaaagatgataaaggttatattttattaacggttttagttattggtattatttttgctattttagccaccggattgtttaacttatctttaaacgaaaaaagtatttctaacataaatttaggaaaggaacaagcctactattgtgcagaggccggactggagctggcgttatacgctttagaaaaagacccacaaaagtttctaaggcaaaatttaacattagacgaatttagcgatttgccggtagggaatggtaaaattgagcaagtaacttcccaaatcagttcggtgagtggaagtgtatatacaatattgctagaaagtaagggtattgtgcccaatggggcaaaaaagaccgttcaagcaagggtaaaggtaagtttaggtgcagcgcaaaatttaaacctcaacaattttactttattcttaaataataatgagcctaatttaaatttcaacaaaaaatccgaagttatcggtaatcttgttgttccgggagatattgtgttagaggcggatgatattaccggcgcggtttatggtcaaaacgttaccgtgttaaggggagaaggcaaaagttcctttacgattactaaaatttattacaccaattccgttaataccaacggtcttaatattcctacggaaaaaattaataatttattttcaactttaaacttaaattttgacgatagttatctgcgatcgttgcccaatattgtggttttaaagactaataaatactccttatctccgggcgatagcggaaaaattgtgtatcttattcctactgaacctaatgatgaggtagaaatagataataactcgtcttatcagtacaacggaaactatctaattatctctcccaatacaattgaaattgaaagtagctatagtagagcgaacaacaattcaaatcttacaataatatcggtaaatggggatataaagttagaaaagaaaatagatgtcaccgctaatctgattgccttgaatggtagccttgaatatcacgacaatagcggaaaagcaacggttaccggggttgtgatggtaaacgatattaataaaaaggaaaataacaacaatgtgaaagcaatgctaacttacgacccgtataataatttaaccaatatttaacaaccatttttaaataaaagtagtgaaattaaaatattagagtggaaagagctttaccaagttttttagaaaaggatggagggctaagtgcaaagttttatcgggaaatttatggggaaaaaccggtatattttagcttttgacgcgggagtgcggtattttaaagctgttttacttaaagctgacaaaaagcagccggaattattaaaaacggtaacttatcagatgccagtggaatttcaggagaatacggttcgggattatattcccaaatatttgctggcagccaaaaaagaatttaacataggaaaggctaaagttataactactcttcccggcaataaaattatttcccgcatcatcaaagttcctttaatgaaccaaaaagagttaaatgcctatcttgacttagaagcagagcagtatttaccagttcccgttaaagatagcgttttggcttcggtaattttggaaaatgccgaggcggatgatggaaccaaacagatgaacgttttactttccgccgcttcccgggaaattattatggatctttacgatacggtggtttctacgggcttaaacttggatgtgattgatcttccttttctggctttataccggggagttttttcccaaataaatccggaagtgccggtggcggtagtggatattggtgctggtaataccctgttaattatcgttaaagacggaattttaaaatttgtccgttcaattaaatggggggccaatgccatcacccagatgattgcaaccaatatgaaccttgactttgtcaaagcggaacaactaaaggaagagaagggtgagcttttggcggcagatgagcaggtggttgatcaggaaaaattaactattgatataagcattcgccaggcaatatcagaacttattaacgaaatccgccgcagtatagatttttaccgtacccaggagcgggggaataacgttgagcgaattttaattaccggaggagggagtaagttaaaaggactaaccgaactttttgaaagccagcttgaccttgaaacctttacctttgccccgatggtggaggaaaaacttgacccggcttttactttagcctacggcctgggactctggggggtggaaagggatgtataaagctaacctccttcccccggaactacaaaaagatgtcgaaattaacacgaaaaaacttgccattttggcggggattactgctttagttaccattataatcttttctttaattggttttatggttcgcgtttattatttaaaaaaagatttggaagttaaaaaggccaatatagtccaactgcaaaaaattgcccaaaaggtaaacgaaacgaaaaacgaaatttcgttattgaataaagaaaaagaggcgtttttggaactaaaacaaaagcgactggtttttacggttattttaacggatattaatttaaacatccctaaaaatacctggcttactgaaataaaatataatccggcaaccagggaattatctttaaccggttctacccgggattcggaagaagcaggaatatttgtttataatttaaacaatttaccgcatttctccaaagtacttttagtgcagatgataagaaacaatacgggaaattacgacttttccataaaggcaattttgaaataaggggatggttaaatgccattttgggaaaaacttgccccgcgggaacgaatattggtgggaatcgctctgggacttacagttttttatttgttatactattacgctatcatgcccaactggcaaaaatatcaggaactgaaaaccgagcttaataccgttaacgccgaatgggaacgcttgcagggaattgaaaatgtcttagcgactgaggtgaaaaataaggagcagctggagaaggagctcaaaaatattcgagcggaatttgattttaacgtagaagatggggcgggctttaccaaactccttgcttcggccaaagagaaaaatataagactcctggagtttaaacctgggtcggtagtggacaaaagctattattttgaatttcccgttgagattaaagttcaaggatattatccacaagtgctggagtatgtggagtctctggaaaactttccggaccttgcggaaataaaaaatttaactatttcctcggttcccggggatgtaaggggaaatgtggaagccgcttttactctggcaatttactcagctaaaaaccctgcggggtcccttatcattcaaaactacgaaaagttatctaccggaaagtataatccctttaggcccatgtatattccgccggtagctactaccccggcaactaataataacccgcctgggaataatactggttctggtgcaacggtacccggagagatttacaacaataataccgatgaggaacctttagtaaaataaccttgacctcgccttactgcggggtttttattttatttcttggaaaaaaaggatataatgttagttaaggagaatttctcagcattagagataatgagggggaaagccaatggataacttcacaataaacgaagtgttacgggaagcggcccgccggggagcgccctttgcggaaatatattttgaagaaaaaaataactttggccttgttttagaagacggaaaaattgaaaaagtaactcagggttacgaagctggtgccggtatccgggtgatagatgataacggaagaacaacttacgcctataccaatgatttatctttggaagctcttttaaaggccgttcgggtagctactctgggtttaaatgggttaaaggacagtgtgagcctggaaaatcccgaagtcacctccggtaacgtgcagattaagccgggagaagtggcagcggaagaaaaactaaaccttttaaaagttgccgatgaagagatcagaagactcggtcctgaaattcgccaggtgcaggcgagttacggggagttggaagccaaagtagttattgccaataccgaaggcacttatgttgagatgaacaaaacccgggtgcggtttgcggtccaggcggtagcggaaaaagatggggttattcagaccggctacgatgccataggtactaccaaaggttttgagacttttaaggagcagcaggtggatgttgcggcccgggcagcgggagaacgggccattaaaatgctttcggccgagcccgccccttcgggggaaatgccggtggtgatggccggtgaagccggcggcaccatgattcacgaagcttcggggcacggcctggaggcggacatagtccaaaagcgaatgagcgtttatgccggaaaaaagggtcagaaggtggcctcgccattgattactgtggtggatgatggcacaatccccggaaaatacgggaccgtaccgtacgatgatgaaggaaacaaaacgaagaaaaatgttctcattgaccgggggattttaaccggttatatgtatgaccggctaactgctaaaaaagataacgttgagcctaccggaaatggaagaagggagtcgtatcagcataaaccgattccccggatgactaacacgtatatagctcccggtgaagacgacccggaaaagattattcgggaggtaaaagagggtttactggttaaaaaaatgggtggtggacaggtggacaccaataccggcgattttgtttttgaggtatccgaagggtacctgattgaagacggccaggttaccgttccggtaagaggagctactttaaccggcaacggccccaaagttttaaacaatgtgctggccgtaggtaaagacctgggctggtctatcggtacctgcggtaaagacggccagggcgttcccgtttccgacgcccagcctactctcttaattggtaacctggtggtaggtggcaccggccgcatccgccgcaaatagcaaaaagaggtataattttagggactgtccccaaatttatacttgaggagggtgtagtgtatgccggcgtatgattttcgctgtaacgattgtggcgaactttttaccgtaagatgctccatttccgaaaaggaaaatgtcacttgccccaaatgcggtggcaaaaatttaacccagcgtttaaccgggtttatgataatgggtaagtcttcctcaaatggagagggggcaatggcatccggttcaagctgcagcggcaaaagctgttccggttgttctgggtgttaatgtggatttcaaaagagtcggcttttgccggctatttttttgcctgttaaaaaattcttaccagattgaagtaatatcctgaaaaatttctcaatatatatactctcgggtaaaaaatttggcaatagataaggcacccggggggaaaagggggtgaaaaaggacacccccggtgccaaaacccgagaggaggagtttttttgcgaaattttatgttttttcttttcttcggactcatcctgggggttgtaacatcgactgcttttgctgcccagataagggtaggccaggattacggaccaactcccaagtactttaatgccgatgataaagcctattaccccgcggaaatttacctgcccaatgaaaccaatcctgcccggtaccgcatccactccaattatagccggaataccgatgcctgtgctgcctgccacgccacccacacggcagtgggggaaaccctgctccagtggggaacggtatatgatacctgcatggcctgccacgacggcaccatttccaccacttataatgtgcaggaaggggaaataggcgccaacggtaaacccacttacggcggtatgtttggcataggtaatgaaccttttctttccaaccatctggtgaccggagcggtaaaaatctttgctgcacccggtggaaatatcaccggaaattatgaaacctatgatgtaccggaccaggggcagggaaaaatgtgggatataacctttggctgtgagtcctgccacagccctcacggcttgggcggcaacgcccgcatcttaaaccccaatgttaatgcatacagcctggtaaattataagactaatttttcccttaaaaaagttactgaagggaatgagactttctgggtagccttaagtagcggcaacagttttgattccactgccaaaaatgcttaccagtgggtaagaagttatccgtatcttaaaggaacaaaagtttattttgatggtactgaaaaagtcgagggagtggactatgaacttagtaattcccaggggtatactaaaataaaagttttacagggtaatcctgccaccattacggcgtccttttatcccgccctgcaagtagccatgaccattaccaattatcttgatggtgataacacttcccagtctcccgactccgaaacggtcattcacgtaaaaggcatcaatgctttctgcggggcttgccataccgactacaataccgaaaacgtttataaggatagtacgaaatcagaacccaacggctcttccgaccttttaaacgggaaatacacggaagcttaccggcaccaggttggttttaacgtggccgactttgaacagtatcttccaaactccaatatggcttatgagctccggggtggtaaaaaattcatgacctgtcttacctgccattatgctcatggtgtaagtcaaagtttttgggagaagacattagaagggaactggttcccggaagcaaaaagttactggggtaccttgccgttagttgaaattgccggatcttctgctctaaaacgggctcccaacatggcgacctgcgaaacctgccaccgtaaaggtcctgcttccgaaggatatacggccaattctgcaggaagtacgccgggaaataatcgtgatactcctgtaaatccttccttcccattgacccgggtagacaacaccctctgccaaaaatgtcacgaaaaaatctataccggctggctgcaaactaaacacgcaaatctaaggggagatagggtagactgtcaggattgccataccggcggcagtgaacacgtaaagtcgccttcagggacgtatatggatagcatttctgagctaaattaccagcagcaggtagcaaaatgtgcaggtgccaattgtcacggaaataccagtgatagtttagcaaacatggattataacaacgataccataagctttgtagacagcagcactccccaggtaagagaacatgtcagcagtaagcactacaacgtaggtgcgatgacctgtactacatgccataatcctcacggagtaattaagcacaacaatcaaacctatgagttaaaataccagcccaattccctctgtgccttttgccacgatttaggcgaatttgccggtgcctttaactgggaagattatatgcctccggttccaagggcagcggtaaatggtgctgcctatcatctccactcttttacctataaagaagccaattttcccgggtggttggatagtgatcattaaaaaataaagtgaaagtagcggggatagttccccgctttttttgtggtaaaaataacaaatcgaaatattacatataaaaaaatagaattaatactgcgaaaataaaagaaaaatttgcaaaagcttgataattaaagaaaaatagcatttacggaatttttgctgcaataaatctaacttatcgatataaataacatttaaaacaaagataaaggaaatatttaccaaaacatctaattaatagcataaaaataataatgcctgtacggataaaccgccgggaaaggagggaagaggtaatacggcgcatccggaattaaaggaaaggaggaggaagtattgaaggggaagattaaggtattgtgtttactgattttagccctgctgattttagggtccaacgcttacgccgcccagcttttgacgggcgacacctacgcccctacggtaaagaaagtatatgacgagcagaggggcatggtaagtaagtttaatgccgatgataaaacctattaccccaatgaaatttatttacccaatgaagccaatcctgccaattaccgcattcacaccaactattccaaaaacaccgacgcctgtgcggcctgccacgccacccacacggcggtaggtcaaacccttttacagtggggaacggtgtacgacacctgcatggcctgccatgacggcaccatctcgaccacctatgatgtgcaaatgggaaccatcgccactacccaaaagcccacctacggcggaatgtttggcagcggcaatgaagattccctctccaaccacttggtcaccggagcggttcagattttcgctgcccccgggggaaacgttaccggcaactatgaaaccaacgacactcccgacaaagccggtgccactgcctgggatattacctttggctgtgaatcgtgccatagcccccacggcttgggcggtaacgcccgaatcctaaaccccaacgtcaatgcttacagctacctgaactacaagtccaatgtggcgtatgtttataattctgctaccggttattacgaaaacagccagaaatatcagtgggtcagaagctatccttacaataaaggcacccaggtctgggtaaacggtcagttaaagaccgaaggggtggactaccttttggacggtaccagcggcgaaaccaggattaaattactccagggaaacggcagcgtaacggtagtatatgcctacttctatcccgctttgcaggtaaaaatggaagtaaaaaattatctgcagtccggcgaatccgtccagcacacttccggaatcaaccagttctgcggagcctgccacaccgactacaacaccgataccggggatatcgacaccagcaccggctcttcggataaattaaccggccactacaccgaagcctaccggcaccaggttggctttaaggtggacgagtttaaagcgttcttacccttgaccaacatggtttacgaaaagcggagtaacggcgatgtcatgacctgcctcacctgccactatgcccacggtgtaagcaaggaattctggaagcggacgctactggacagcaccaaagcagccgtatacggctactggagcgaggtaggagagaatggtttaaaagagcttgccgggtcttcggcgttaaagcgggcgcccaacatggggacctgtgagacctgccaccggaaaggccccgcggctgaaggctacaacgccaataccggacaaagcgtaagtgtaaccgccaccacttacgaaagccagacgggagctacggcggtgggcagcggcaaatgccagtcctgccacccgaaatattataccggctggagtaaaaccgctcactttgacaacggcgtaggctgcgaagcctgccacggaaacggaagccttcacgtcaaagcccccaacagccgaaacatcaccaaccctgctacaaagaacgtagaagggaaggttgacacctgcggtaccgcaaactgtcacggtaaaggagcaaccaagagaacagaaatttatgattttggcggtgtaagtgaaagcataatttactacagtgaagccatgagtcaggtgcaggaatttaaggaaagcaagcattacagtaaaggcggtgtttactgttccacctgccacaacccgcacggcatgatagcggataagaacggaatcgaaaagcagctaaaatacctgccgaacgctttatgcggcagctgccatgataccggagcggcctttgactgggcaacctttatgccgaaggtagcaagaagcgatggaagcgaccaggctttacacagctttacggcctttgaatcggaaatgccgggtttaagataagaggggagggaaaataattgaggaaaaggtataaagtaagtttaattgccgtcattacctgcctggccctgctgcttaccgcagcagcggccttcggctaccggcagtttgccaaagacccgatgacccagcagtcgttaaattgtgcaactacctgccactatacccaaaaagcctcggatatcggtagccttccctatgccaaggtcgttaactacgctatagtgaaaaatatattctccttggccaaagggaaattttaccccaaaaaaccgattaccaataaagagttccacgatgcagtggaaaaagcagcaggaaacaccactttggccgatggcataattcccgaagataacaaaaattttaaccgttccaaacttgccgattacctggcaagattgaccggagctactacttccggatacttaggacaaagaattaaggacttcaacggcaatcgcaatttagcctgggcaatctataatggttacattcctatttcaaagaccgacagcaataataatttttacgcctatccctccgcaatggtcacccgggcggaagcagcttatgctatcgtaactgcaggactaatcagggctaatgccgattccaagcccacgcctgttgccaataattcaaagcacagggatataacccaggattttcttacctgggtccagaataatccaactggtacctcggctgagttttgcttgacctgccatggaccgggtacaggtaaatggaactccatcaagaacatcgtttacaccaaccactatttaaaccgcaccttcaccaaaaacggcgatacgattttctggatggcctaccagtttgggcaaatgggcaatcctaaactgcctttagacctctacatgaatcaggataatcttcacaatgcggcccggcaaaatcctgacctcgcccaaatcgaaggcttcagggaagtgggctttggtccgggacagctgcagtttggcatgtacaaccgcctctgcggtgctccggaaaccttcggctaccagagtttcctgggccgctgggttggaaccagtggttcccgggctgccggctgcggccgctgccatatcggttacggtattaaatccgggccggccgaccccaactacaacaccggcctctttaaccagctttccggtgatgttgactttgctatccttgaatatgtcaaagatatcgactgcctcctctgccatgccgaccagtactatgtcagtaagggagcggcccgaaatgtcaaagtggtaaatggtaaggcaaccatctataccgtaggggaagtttataacggccaggatccgagcattaccaatcctcagcaaaaagtcttaaccgcgatagcttccgtttacaagaagcccaccgccaacggctgtgcggtttgccacgacttcccggcggacggtccggcctataaacggggcttctggcacgaccttgatgttcacttaaaagatgataagctctcctgtgtggactgccatccgggtggtgcctggacaccggctttaggtgacaccaccggacagggagtatataataagcaccagttcgtcatcggtcccatgcccgacctctacacccccaatgatggtcagcgggccaaacagtgcgttgagtgccataccggcacggtgcatgccaatcaggttataaacgaccacgggcggcgcttggactgccgcacctgccacatcagtaaagactatggcttggatttcagagactttagcaatcccgaaagagaagcagcggatggaatatatgaacccaaagattatgtgtttaacaactggagcgattcctcgttatacaacaataattcccatgaataccgcggaagttacggtacacccactttaaatttcaaacggcaggattacgaacacatgatgcggtttggcgtccggcccattggggacatctttgatgaagggaaacttttaggaagtatgggtaaaatgaattatccgcagaaccctgcggccaagattcagcctttccaccgggtaaacatcaagataccaatggcctttggcgatgtttactttaaggctattggcaaagactttgccaactttcccttcatgctgccctttgataagaagtattatgccgaaaccggcgatatcatacagtcggtttatcagggaatttacaagcttaagacctcctttatgccggcttatgatatgagcaatcaaatttattttggcgagcagaaagtacctaaatatgacggctataccgcgcacatgatttactttaacatgttaaacgaaaatatcatgaccaatccgcggatgtctatgactccaacttcaaaagggaacaaaccctttaatatgagcggctactttgagttttacggcttaatgcagatggaccacacgatacttccggcaagcgaagctttaacctgtgttgattgccacagcgctaccggccgggtagcaatagctactgatagttggaaaagccttggctattccgcaaaacgcagccagcttttaatcttcaccaaaaaataagatggctttaaaaggactaatttagccctcggaataaattttccgggggtttattttttgatttttaaccgtataaaagtaaaatatcagcagatggtggtttaaccaaggctttagaaaatggtgcaaaagaataattttttataaacatttcggcaaaaaagattaaaatttcttttaataccccaaaaaatcttatacgataaaaagggggagctaaaaaatgaaaaaaagaaaaaacattaaattgctttattttgtagtttttggagctttacttatcttactcttctaccaacaaggttttcgcctgcccagactttccagtatcaagcatctaattgtttatttaatgggggttctgggaataatccttattatgattggcctgcgccggcagatggagagaaaccatcccgatgatgacgaagatgaattatagggtgcaattaaattggtggtaggtggtaggaggttggataggtggttctgacctgggaagacaaatgctggttatagccgacactgcattaaaggcgaaggtatttaaaatccccttgactcggtaaatttacaggtatagattaatttttagataggaataattacgatgtaggtgggaatacgatgaatgtaagagaagcatataaaattttacgggataagggcataaagattacaccgcagcggcaggcgcttttagagctttttgccgatgaaaaaagctataccgcccgggagattgccgaaaaattgcgccggcattaccctggttttagtttcgataccgtttaccgtaacttaaagctttactgccggtgcgggattttaaccgagaccatggcgccggacgggatagcccgcttttccttaaataccggacagcaccgccattatttcacctgccttgcctgcggggagaaagtggccctggaatcgtgtcctattgaagaaaataaatttaaccttccgggaaaagtggggacgataacgtatcaccggattgaactttttggaaagtgtgcagcctgcgaggaggggaaaaagtgaagcgagtacttgcgctggttttagtttttactttatttgtactttcgggctgttccaatgcccggacggcttctacaaccgatagcggtaagcctttgattgttacttcaatttatccctatggtgagcttgcccgggagattgccggggataaagctgaggttacggttttagcccctcctggagccgatgcccatgattttgaaccaaaaccttccgacctttttaccctgaggaaggccgatttaatcatcttaaatggtgggggcttagagccctgggccggaaagataatcaagcttttaggaaaagataaggttattgaagcggaaaaaattttggaaggcaaagtaaaaaaagacgatccccattactggctatctttgatatttgcccgcaaaatagccgaagctattaaggataatttagtaacgctggatccgggaaataaaagctactatgaggaaaattaccgcaaacttgccgataaactttatgagctgcatttggcgatggtggatcttacctcggacctaaaaacccgcaagatttttaccctgcaccgggcctttggttattttgcagccgattacggtttacaggaaatttccctgatgtccggaaaggaagcggaagcaaccgttggcgatattgaaaagtttatgaaagaattttcggcggaaggttgtgaatacgtattttttgacccggtttttggtaaaaaggttgcggaaaaagtttctgaaaactacagggtgaagtttatgcccctttatactttagaaggagttgatgaaaccctaaaaggtaaaagctatttagaattaatgcaggagaatattgaaactttgcgccttgttttaggaggagatgattaaatttggggctagaagttaaaaacctctctgtaaattacggcggtgagccggtattagaggatataaatttttcattaaaggaaggggattttcttttggttctgggaaaaaacggggcaggtaagtctaccctgttaaaagcgattgttggggagattccttacttcgggattataaagacctttaaccataaaattggttatgtggcgcagaaaattcccgggaccatcccctttccggttaccgtggaagaattggtgctggcccggaacgctgaagggaaaaccaaaattattttacagtaaggaagaccgggaagttgccgtagaagcgcttaaggctaccaaccttcttaataaaaggaatagactcttaggaaacctctccggcggggagctaaggcgggcgtttattgcccgagcgctggcgggaaaagccgatttgttattgttagatgaacccaccagtggtcttgaccagatgagccggaaagaattgtatcaggtgttaaatacttttttcagagaagacaccattattttaatggttacccatgatccaaaggagataaaaattttagggaataaagtgctgcacatagataaaaaagcgttgtattttggggataaagacggctatcttgcaggggaggaaagggaacttggatttgaatgttgtccagaatagccttttaattgccctccttttggccattgagggaagccttgtgggggtttttttactggtaagaaggtacagccttttagccgatgctttagcccacttttctttggtcggggccgcattaggggtgtttttcggcttttcttcccttttaggcggagtttttgcggctttaaccggcggcgttatcttggagacgctacgctacaaagaaaatgcttttaacgacgcaaaccttgccttgatttcggcaggaggtttgtctttagcgctcattattgcttctttaaaaggagaggtctggcaaagtttgggtcagtatttgttcggcagtatcctctttgccgggaaaagggatttaatctgggcctttgttacttttctcggggtcttattatttcttttgttttatagccggcatttgctgcttctttccatagaccagtccggggccaaaagccaggggataaaggtaaggtttagcgagtttttcctgatcattttagctaccatagtggtttcttttggtattcaagcggtgggggcattacttaccggtgcttttttggtgcttccggctttaattggcattgaactcgcccgttcctttaccgggttaattgtctgggcggtgacggttagcttaattatggccgtggcggggataattattacatttttcttaaacttgccgccgggtgctaccattgtggccaccggtgtattaatatatattttggtagtatcagggaaaaaacttgggcaaagggggaagtaagatgtaccagtaccgtatggatgagccgagaggacaccggccttcgtggtttacggtaatagtggtggcggtaattgccggtttaattgggagcatggcggggatttatgcctatcccaaactttttcccgcgaagaatacgaagatagaatatacactaccccagactcccgaagtaaaaaccgccgaatacagctatacgccggtggtggcggtggccaagaaggtatcaccggcggtggtggggatatccaatattgcgccggggggcttttttggcctgggagggcttgaagaaaaaagctccggatctggctttatcatttctcccgatggctacatcgttaccaacaaccacgtggtagaaggagcatatgagctgtatgtgagtttggccgatggccggcagatgaaggccaaaatcatcggtaccgacccgcgggcggacctggcggtgataaaggtaaatgccaaaaatttaccggtagtaaccctgggtcattccagcactttgcaggtaggagagctggccattgccatcggaaaccctctgggtaaagaatttgcccgaagtgtcaccgtcggggtgataagtgcccttaatagaacgttaacttatgaatcgggagaaaaaagtcttaggctgattcagaccgatgcggctattaaccctggcaattccggtggacctctctgcaacgccaaaggggaagtggtagggataaattcggccaaaatttccattccgggctttgagggaatgggctttgccatcccgatcgatgaggcaaaaccgattattgagcagctaattaacaagggttacgttacccggccgtggctgggcattgccggtgcggaaatttccgaacaggaagcccagtattacgatataccccagggaatttacattgaaggggttgtcgaaggtggaccggcggataaagccggtattcaggctaaagatattattaccgccattaacggtacgaaaattaccaccatggcggaactaaccgatgaactgtttaaacacaagccgggagaaaaaataaaagtagaagtataccggctaaaggaaggcaaaaaatataccttagaagtaaccttgggcgaaaaaccaagagaataacgctggagggacggttctgagaaccaccactttcgacgatgaatagaaaatggtggctgtaagtaccgtccctggaggaggtattttagtggagattctggaactggcgttagcggaaattaaagcgaaaaaggctgatggggaagtttgttatacccggggcgaagagctttcggtggaagtgcgggaaggacgggtggagacggttaagcaggcggtagaagaaggggtaggggtacgggtcttttacgagggaaggcttggctttgcctataccacggtaatgactccggaaaaaatcaaggaaacggtggaaaaagcagtccaggcggcaaagattaccgatagcgatccttacttacgtttggcaaaaccttctacctacccaacgccggagttaaccgacccggaaataaccactgcttccttggaggaaaaggttaatttagcacttaccatggaaagagaagcgttaaatttcagccccaaaattaaggggattgaaactgcggcctatgatgactaccattatcaatggcatttagccaataccgaaggttttttcggaagtttttcgggaaattatgcttcaatttatatttatttagcttcggaagatgaatcgggctcggagaccgctttttcctataaagtaacccgcaagtttaaggaaatagacccgaaagctgtaggccgggaagcggcggaaaaagcggtagccaaacttggggccggtaaggttccctccggacggtatatggcacttttagacccgtatgtggccgtaaatcttttaggggtgttaaaagcctcgttcttagcggaaaatgtgcaaaaaggtaaaagccttttaaaagggaaacttggcgaaaaagtgtttagccccgttttcagcttaattgatgatggtacccttaaagatggcctggctactgcaccgtttgacggggaaggggtgcctacccggaaaaccgttttggtagaaaacggtactgttaaaagctttctttataatttatacaccgccgccaaagaaggagcggtttcaaccggcaatgccgttcgctcttcctttaaagctttaccggagctggggaccactaatttctacattcctcggggaggagttagccgggaaagtttatttaaacaaaccagccggggggtttatattaccgaagtgctcgggatgcataccgcaaaccccgtttccggtgatttttcggtaggagcgaccggctttttagtagaaaatggcgaaattatccggccggtcagggggataaccattgccgggaatataaaagatttatttggaaaattaattgctgtgggcgatgacctgcgcttttacggagctaaaggaagtccgaccctgttaattgaagaggtggcggtaagcggaagttagagggttgaaaccctcttttttttaaattctttcccggtataaaaatttgttttttcctcaaaaaaaatgcatatttatttttttaaattttaaattataataatattaagaaaattttgacggggtgggagtttggaacccttactaaagctttttcttttagcggtgataatgacagcttttgaagggttttttgaattttatgttttttttccggaaggcttaaagcttttactgcccgttattctcctgtttttaattaatttttttggagtatatgtagccagctacttttttcgcactttccgggtgattactttaaaaaaagaagagcaggaccaattaaatcctctcatgctggccaatgaagctttgccgattatcaagcagggattaaatgtggagaccgccggaaaaattgccgaaataattcagcggattagcgacatggaagcggtagcaattacggaccgggaaaaagtgctggcgtatgtgggggttggttgtgaacggcataagataggggaccctatccggacctttgccaccaaagaagccatccgcaccggggagcttaaaataattgaccacagtttaaaatacatttgttcggtaaaagactgcgactgccccctccaggcggcggtggttgttcctttgaaaattcgcgggcaggtggtgggtacaataaagctttaccagacgaaaaaaggcgagatgccggcccaaaccgtaaaacttgcgatggggattgcccagatcttaaacctgcaaatggaaatagccgagcttgaccgccaggcgcaaatggtgaccaaagcccagttagaagcgctgcaggccaagataaatccgcactttctttttaataccttaaataccatcattatgtttaaccggaccaacccggaattagcccgaaagcttctaattcatctggcaaaatttttccggcaaactttaaaaaaacaggggatgtttggcacgttaaaggaagagcttgattacgtcaatacttatttagttctggaaaaagcccggtttcggcaaaagcttagaattataagggatattgaccgggaattactgaattaccagtttccggtattaacattacaaccacttgtggaaaatgcggttaaacacggtattacccctaaagaatcccagggtacggttttaatccggattaagagggatggggaaaaaattaacgtggaaataaaggatgatggagtgggaatttctcccagtatggttggccgggttttggaaccgggatttggttcgggaaacggggtcgggatgtccaacgttcacgaacgtttgctcagtttgtacggccgggaggcgggccttaaaatagagtcgaagttaggggtggggactaccgtgagtttttccattccggcgttaaaagttgaagaagaaggggagagggaaaatgaaaattaggacgctcattgtggatgatgagtatcctgcccggcaggaactgcgttttttgttagcggagattccggaaattgaagtggtgggggaggcggcaacggccagcgaagcccttgcgttaatccgggcggtggattattctttgttgtttttggatattgaaatgccgggactttccgggcttgagctggccaaggaaatcaatgccctgccccatccgccgtatgtggtttttgttaccgcttatgacgagtatgctttaaaagcgtttgaagttaatgcggtagattatttactaaaacctattgagcccaaaaggctaaaaaaagccgtagaaaaggtaaagaagctaatccaggaaaacggcttaccaaaaggggaggaagtttttagcgcgtaccgcacaacgggaagacttgaccgcataccggccgaaaaaggcgggaaaacggttttggttggggagcaggagattatttatgcctataccgaacaggattatgtttacctgaaaacctatcaggataaatactttacccgttttaccctgaaagaattagaaggacggttaaatcccacggtgtttttccgctgtcaccgctgttttattgtcaatctgcaaaaggtaaaagagataatacccttttttaacggcacctatactttagtggtggatgataaagagaaaagcgaagttccggtaagcagagcccaggcgaaaaaattaagaaaaatcctcggactttaaaccgttaaaagcagaaaaaatgctttttaacgttttttttttacctttcacaatcaaaaactggattaataaccgttgccaaattattatataaaaaaaaggaaaaaggagggggcttatgagcgataattttgaagcgctcttgcaggaaagccgtatttttgaaccgccggcagaatttaaagaaaaagccaaagttgcggacttatccctttatgaatgggccgagcgggattttttaggtttctgggcggatgcggccaaagatatcgagtggtttttgccctttgagaaagtattggatgattccgatgcaccattttaccgatggtataccggtggaaagttaaacgtttcctacaattgcgtggaccggcacaccaaaagctttcgccgcaacaaagcagcgttaatctttgaaggcgaaccgggggattcaaaaattttaacctatcaggagttgtaccgggaagtaaataaatttgccaatgttttgaaaaagttgggggtgcaaaagggagacagggttaccatttacatgccgatgattcccgaagcggtaattgcgatgttagcctgcacccgcattggtgcaccccacagcgttgtgtttggtggttttagttcgcaggcgttgaaagaccggattgatgatgccaaggccaagcttttaataactgccgacggtggttaccgccggggaagtattgttgaattaaagaaaaatgccgatgctgccttagaaggggaaaccaccattgaaaaggtggtggtggtgaaaagaacggggcaggaagtgcccatgaccgagggcagggactactggtaccacgagttaatggccgatgcggctctatactgcgagccggagcagtgcgatgcggaagatatgctttttatcctttactcttccgggactaccggtaaacccaaaggcattcagcataccaccggcggttatctggtaggggtccataccacctttaaatacatttttgattaccgggaagaagatatttactggtgcaccgccgatataggctggattaccgggcacagctacattgtttacgggccactgtccaacggtgctaccgttgttttatatgaaggtgctcccgactggccgcaaaaagaccggttctgggagattattgaaaaataccgggtaaatatcctttatactgctccgacggccattcgaacctttatgcgctggggagaaaagtggccgaaaggacgggatctgtccagtttacggcttctggggacggtgggtgaaccgattaacccagaggcctggatttggtatcacgaacatattggcggcggccgctgtccgatagtcgatacctggtggcagacggaaacgggaatgattatgattactcctttacccggcgtgattcccaccaaacccggttcggctaccaagcctttccccggggtggaagcggacgtggtcaatgataaaggtgaaccggtacctcccggacagggtggttatttggtgctgaaaaaaccgtggccggcaatgcttcgcactttgtatggcgatccggaacggtataaaaacacctactggagcaagttcccgggctggtattttaccggtgatggggcgaaaaaagatgaagatggctacttctggattttaggacgggtagacgatgtcattaacgtttccggccaccggataggtaccatggaagtggaaagtgctttagtggagcatcctttggtggcggaagcagcggtaatcggcaagagccatgaagtaaaaggccaggcgatagctgctttcgtcaccctgaaagaaggggtagagggtacccccgaattggtgcaggagttaaaacagtttgttgcccagaaaattggtgctcttgcccggccggatgacatcttctttactgctgagcttcccaagacccgcagtggtaagattatgagaagattactccgggacattgccgagggtcgggcactaggtgacactactactttgaccgatccggcggttataaacaaaataaaagaacagtacaaagacgaaggttaattggcgtcaaactttccgaaaaccataaattttaaccactgggccagggagaggccggtttgttgataaaaggccaaatccctggctttttcctgatccttttgggctaaatattcggtggttaaattaattacttcttgatatagttctggtggaacttcaaaatattcctctaacactacccgggcagcataaacttctttttctaaatttttcagccgctgcagaagctcaattaagaccaaacgtaaaagaaaatcatcgataggcttttccacttcacaaaaacgttccaaaagggttttgtcggataatatttcccagggttcctgtttcatttttttacctcccggtaaagtattgccgggaattattttttttagacattttaagaaatagaatccaatacttgaaaaatatactttacaaaaaataataaaaaattatataataaatgaaaagtttaccaatttttgaaaaagaggaggtggacaattttgaaaaaaagatataaaaaaattatttttttcttagtttgttatctctttttacaagatattgcatttgctttaactgctggttttgatgggataaataaatacagtagtttactatatccggattgtacatatggtgatagagcaggtgcgtcatatgtaaataatctatacaacgcaataagtaacaaatttacacttggctttaaatatttagataataatgcatgggaatcagatattaccataaacagatatatgaataatgttgatttcttttcatttgctggtcatggaaaaaattattcagcatatgaaaatgcagctcatttttacgtgaaaaatgatggcgatcaatggcatagttcctcagaagaagattatgataacattaatgctcgtacaaatgaaacaagatttgggcataacaaattaaaatgggtaaacatgtattgttgttggtggctttatgatggaggaaatagcacgaaaagacaaaatttttataaaatgtttgaaggagctaccttaatgcttggtttttcatcggtcatgtatcttgatagccgtgaagggactgaatttggtcaaaaattagtaaatgggtatacaattaaaacggcatttcttgaggctgctaaaaaatatcagccccaaagagctgatggtgattcaattgctactgttattggttataaacttgcagccaatgatactataagtaattattttggaacattgttaccgagtaactggtatataaataatccatcggcatatggagttattgctcaggtagtcataccgcataatggaattaaaatttaaaggtggtgtaaaagttgaagaaaaagtggaatattactttgattttattagcttttttggttttttttgtttatattcttttgaaaagtgaaagtaattatggaaccattaatatacctcagccaggacaggagtcaccaaaaaagattgagtatatttttgaaaataataacgctctatttccggaaaatatcgaaatatataaatttaaaactccctattatgaaagtttacaacaaatagaaaggcttaaaaattattttaacataaaaaatactaccacgaaggaagacaaagataaaatacttattttaagcgaaaaaaaagttattgaaattgataaaaataatggatattttagctatataaataacgaaaaactgtataataataaaatttataagaacatacctactgattctgaagctattgaaatagccaaaaaatttctaatagaaacgaaattattttcgggaagatttcaaagtgtcagtgtaacagctcaaaaagcggaaaatgaagcgggcgagaccgtggttatggctaaagacgtttggttttatcctgtagtgaatggtaggcctatttatggcatttcaagaatcatcgttactattgggaataaaggggaaatcgaagcagtttgtaaatattatcgggattttgaattctacaaaaaagaaaagctaaagtcacttgaaaaggctgtacaagaaataaaagaaggtagggcatcaagtaatattcctccagaagctacaaaagcacacattaaaaaatctttcctaggatattgggaagatcctgaacagcagtatttaattcctgtatatgtgtttcaaggggaaacagcaattaataataaaattgaaaaatttgatattttcacaccggctattgaaaatgttgagttagtattaaataaaaatattgatgaggaatatttctcaacccagaaagattaaaatggataaaatgcttttcccggtaaagtattgccgggaattattttttttagacaattatctttgacttacggtaaaatattaataaagagagattaaaaaagttaaggggtagttaaggtgtacagctcgggaattgatatagttgatgttttaaggataaaaaaactccacgagcggtttggggagcgttttttacataagatttataccaaaggcgagttagagtatgctttttcgacaaaagaaccttatttgcgtttagccgcccgctttgctgctaaagaagcagcggctaaagctttaggtaccgggataggaaaggtaaattttaaagatattgaagtagttttgggaacggatggtcctgaacttatttttcatggttatgcggcaaaaatttttcaggaaaaaggttttacgggaaaaagcttaagtttaagccatgaaaaaaaggtagcggtagcaatttgcgtgatgtggagggattaaaatgcttcttttaaccgggcgggagatggcggagtttgaccagaaagcgattaatgaatacgggattccgggaattgttttaatggaaaatgcggctttaaagactttttatagaattaaagagattttgggagatgttagcggcaaaaaaattatcatcttagtgggaaagggaaataacggtggtgatggtctggcccttgcccggcacctggccaatgccggggctaaaatccgggtgtttttactgtttaaagataattttaaaggagatgctttaattaattttaatattttaaagaaaatgagtgaaaaaatctatgaagggattaccgaaaatttaaaccttttaaaaatctccctgattgatgccgatatggtggtggatgcgatatacggcaccggttttcggggggcgctaccgccggaaatccgggaagtggtggagattgtcaaccaggcggatgcagttaggctggcggtggatatcccttcgggggtagacgccagcaccggccaggtcgaaggcgttgcctttcaggccgactatacggtaaccttcgggttacccaaagtggggcaaatcctttttcccgggcgaaaatactgcggggaaatttacgtggaggatatttcttttccggaaaaactaaaaaaagagttttctgttcggcgctggcttattgaagaaaagctaattaaaaaaatcataaagccggtggcagcggatacccataaaggccggcagggttttacgctggtagcaggagggtcgcgtgcttactctggagctcctcttctttctgcaagaggatgtttagcgtccggggtgggaggggtttacctggcggtaccggaagagttatttgaacctttagcgggtaaggtaccggaaattattttacggggaataccggcagcagccgggcaactggcggcggaaggtttttttatgctcagtgaacttctttctaaagtaaaggcggcggttataggaccgggaatgggggagttaaccggaagtaaagaagcttatcttaattttttggaaagctgtcctttgccgctggtgattgatgccgacggtttaaataatcttgttggttatctggaggttttaaaaaggcgaacggctcctacggttttaactccccatttgggcgaaatggcaaggcttcttgggctgagtgttaacgaagtaaaggtaaagggtgaagaaattagcaaagagtttacaaaagaatataatgtttacctggttttaaaaagtgaaaccactttaattgccgcgccaactggggaagtctggtacctggccgggggcaatccccttttagccaaagccggcagcggcgatgttttgtctggcttaattgccggttttttaacccagggttatggtccggaggaagcagcgattttgggggtttattttcacggaagagctggagaactggcattaaaggaacgggcggtaaacagcttttttatttccgatattttttcttatttaaatgaagttttccgggaagtagggggtaatggtggaaagaaaaatatccatatggaaagataattttccacgatttataaagttttgtttgaacttataacagactggaaagttttatttccagtctgttatttttttagggaattttcgaggttttttaacgccaactgatattggtacgaaaattgcttaaaataaatatagcataaaaatagcatttgttttaacataaaaaatttgggggtgaattttgcatgattattggtgtaccaaaagaaattaaaaataatgaaaaccgggtggcgattactcctgccggagttgaggctttggttgcggcggggcataaagtggtgattgaaaataacgccggtcttggcagcgggataaccaatgaagaatacataaaagctggggcggaaattcttccaactgctgccgatgtctttgctgctgcagatatgattatgaaggtaaaggagccactgccaccggaatacccgttatttaaggaagggcaaattctctttacttatcttcatctcgcgccggagccggaacttacccgggctttaatggagaaaaaggttgtagctattgcttacgaaaccattcagcttcccaacggcagcctgccattactaactccaatgagcgaggttgccgggcggatggcggtccagatcggtgctcgtttcctggaaaagcctcagggcggtcggggtatgctattggggggcgttcccggagttccaccggccgaagtggtgattattggtggcggtgtcgtcggtaccaatgctgctaagatggctatgggcatgggagctcacgtgaccattcttgataagagtgccgaccggcttagatacctggatgatatctttttcggcaaaataaccaccatgatgtccaacagctacaatattgccgaagcggtgaaaaaagctgacttattgatcggcgccgtcttaattccgggagcccgggcgcccaaattggtaacggaagagatggttaagaccatgaaacccggttcggttatcgttgacgtggctattgaccagggtggttgcgtcgaaactattgaccgggtaactacccaccaggatccgatttacgttaaacacggagttgtccattatgctgtagccaacatgcccggtgccgtaccgagaacttcaacttttgctttaaccaacgtgaccttgccgtatgctttggctattgccaataaaggctgggagcgggcggtaagggaagaccgggctttagctttaggcgttaacgttttagacggaaaagttacctgtaaagcggtagccgattctttgggcttaccttatactccgctggaagaaatcctcggttagaggtaaaaggggtggataattccacccctttgctatatcattaacattaaaaaagaaaagttttctggtaggtggaaaaaatgcgtccggtatgggcagaggttaacctggaaaatattcggcataatttccgggaagtaaaaagacttgctcggcaggcggaggcgatgccggtaataaaggccaatgcttacggtcacggagcggtggaagtggcaaaagctttaattgccgagggggctaaacggtttgcggtggccattcttgatgaaggaataaagttgagagaagcggggatagatgcaccggttcttattttgggttacactcctcccgaagaggtggaaaagcttttattttataacctgactcctactcttcaccaccgggaattagctttagcgtatcaggaaagacttgagaggcttaagaaaacccttttctatcatctaaaaattgatacgggaatggggagaatcgggttctggtatgaagaactcgaaaagattgaggaagtattaaaattaaaaaatttagaagcggaaggagtttatacccattttgcccgggcggatgagcaagatttaagtttttccaagctgcaaatagagaggtttaacattgtgttaaaacacttaaaagccaaagggattgaggtaaaataccgccatgctgccaacagtgctgcaataatgaggcttcccgaagctcactacgatttggtgcgaccggggattatgctgtacggcgagtatccctccagggatgtaccccgggaacttgcccatttaaagcctgctttaaccttaaaagccagggtttctcaggtgaaaaaagtaccggcaggctttacggtgagttacggtagcacgtacgtaacctccaaagctaccctgattgtttcgctgccgttaggttatgccgatggttattttcgccgcctttccaatcgaggggtggttttgataaacggcaaacgctggtccatagccggtcgggtttgcatggatcaattgatggtagcggtggatgaaaccgaaagggtaaatcccggggatgaggctgttctcttgggaaagcagggagaagaaacgattaccgctatggaaatggcagacctggtgggaactataaattatgaaattttgaccaatataagttaccgggttccgcgaatttatgtgtaaaattcatttataaaaaatatttatggattttgaggctgcaagcctctttttttatgtatttgaaaaaaaaagtcgaacatggtataattttatcgaagcacttcttttttcctgcaaattatcccctcataaattctgccacttcaacataaacttttaaggaagcggttttctttaattagccagaaataaccaataaaaaatgggaggtgatagtatttatacaattgccaagctccactgggcttttccgccaattatcggtggggttgagacgcacctgacgcttttgtgcccggaattaatcaggcgcggctataatttacaccttttaaccggtgcggttaatggtgaacccgaagagttcgatttccacggtatgcgggttcgaaggcatagatttttagatttaaactctctttcaccgcaaattattaaagaaaaccgcaggcaaataaaggatctccttcactcctttctcgatgaagtcaatcccgaaataatccatctccataatatgcattattttagcccggaccatttggagtttttggtggagtataaaaaccaccggaaaaagcctttggttttaaccgcccataatgtctgggaagatgaactttggcaggaaatgcttacttttaaagacgagtgggattacgtcatagcggtcagcgattttattaaaaaagagcttatccgctttggttttgatggtgagaaaattatcaccgttcaccacggaattgataccgaaaaatttaaaccgggtatatcgccggataatccttatgctaagatggagttttttgccgggaaaaaagttatctttcatccggcccggatgagttttgccaagggttccgattatgcggtgaaagcctttgccgaagtgcaaaaactatttcccgataccgtcctggtgatggcgggtaccaagaaaacggtggactggggtggagtccagcaaaaagaagtacaggaaattatgaagcttgtggaagaatatggtctttctgataaagtttacgtccaatttttcaactggcaggaaattcactggatgtacgaaattgccgacatctgcatttatcccagctcctttgaggaaccctttggtttggtaatgcttgaagcgatggcttccgggaaacccattattgttaccaattccgggggtatgccggaagttgttcaggacggagtaaacggttttgttattcccaaaaaagatgccagtgcccttgcccgaaaactaatcttacttttagaggacgacgaattacgccggaggatgggtgaaagcggccggaaacttgctgaagagaagtttacggttaaagttatgaccgataataccgaaaaagtttaccagaagctgttaaaacattaagggatacgggagtggtgtggatggcgcttgatcggcagttagacgaagaccggtttcgaattgctcccaaggaatttcaaccccgggtggaagttttaaaagaaggagaaatgtttttaaccgccctgcccgatggttcaatctgggaaggtgacttaagcggtctcggtttattttaccgggatacccggtttttaaatcggctattaatgtatttagaggagtttgaaccgttacttctctcctctttaattcgggaaagccattttgcccagattgagcttaccaaccgggagtttcatctgccggatggggtcttactgccgcttcagaccatccactttcgtattactcgagttttaaaagatggcctgtatcagcgtttgcgaattattaattttaattcttttccggtgacaattaatctaactttttccgccggtgcagattacgttgatatttttgaagtcagggggacaacgagaaaaaaccgggggcgctttttaccggtttgtcagaaacgtaacggttttacctttgcttacgaaggtcttgatcattattatcgctctactgaccttaccttttatccggagccaaatctggtctgggtggagggagataagggctttgcccgttttaccttaactcttgaacctcataaaaagtactttctttatctacaaattattccctgcattgcccaaaagattgagtgcgaagacgatatatacgtcaaaaaagaaatgagcgttgggttttccaaagcggcaataaatctcaataaggattacctcaactggcagcgtcagtgtacgaaaatagaaaccaataatgaaataataaaccagatgataaaccaggcggtaacggatttgcgggcgttaatttccgaatacccggaaagcggaaaaattatcgaagcggggattccctggtttgccgctccctttggccgggattctttaattacttcctggcagacgcttattttaaatccggaaattgccaaaaatacgctcaggtttttagcccattatcagggcaaggtccatgacccctggcgggaagaacagccggggaaaattttacatgaaatccggcggggagaaatggcgttaaatcatgaggtgccccatactccttactacgggaccgttgatgcaactctctggtttatcattcttttgggcgaggtgtttcgctggacccatgatgaaaagcttttgcaggatttagcggaacctttgaaaaaagctctgtactggtgtgaaaactacggagatatggacggcgatggttttatagaatatttgcggcagtcggaaagcggccttttaaaccaggggtggaaggattcctgggatggagttattgaccgggatggctccttaccggaaggacctatagcactggtagaagtgcaggcttattattatttggcgttactccggggtagtgaactattacaatttttaggagaaattgaagaagcgttgaggctacgccgcaaagctttaaaacttcaagccaaatttatcaaggcgttctggattgatgacgaagattttctcggttttgctttagatggaaaaaagaggcttattaaaaccaccgtatcaaacccgggccatgcgttatttaccggaattctgccgacaaagttagcccacaaagttgcggaaagattgtttcgccaggacatgtattccggctggggtatccggaccatgagtgccaaggagaaaccttataaccccatgagttaccataacggttcggtctggccccatgataactccatcattgcccgggggttaaaggagattggccaggaatttttgttggaaaagcttgtgaccgatttggtggaagcagccaggttctttaattactatcgctggccggaattattttgcgggtttacccgccgggccaacggcggtccggtccggtatccgatagcctgcgacccgcaggcctgggcggtgggaagcgtatttattttgctgcaaagcattctcggtatattttgcgatggcggtgatatcaggatagtaagaccaaatttacccggctggctaagcgaagtgtatttagaaaacctcagggttggaaacggtaccgttgatttagagtttagccggagccggggtaaaacttactgtaacgttgtgaaaagggagggagaggtgaaagtcttgattgaaccgtaggaggtggatagatgagaggtaatcttttggtggtatctaaccggggaccctttaccattgaagaaaataacggtagtttaaaataccgtccggcggtaagtggacttgtatcggcggtccttcccgccgtaaaaaaaatcggaggaacctggttagcctgggcagggagaattgcggagaagcctgcggaagttcaggcggtaattaaagacgagtttcaatttgtggaaatcctcctatccagggaagaagtagaggggtattatgaaggttatgccaacggagtgctctggccgctctgccacctgatgccggaaaaagttaggatgtacgaagaaaattaccgaatttaccgggaagttaaccagaaatttgcccaaaaggctgctaccttattaagaaccgggacgcttttatggattcatgactaccacttagctttaatgccccactttattcgccaaaaaaatccctggcagcgaattgcctttttctggcatataccctttccgccggtagaactgtttaccattcagccctgggcggaagaaattttacgcggccttttaggtgcggatatcattggttttcatattgatgactaccgggaaaactttttacgggcggtggagcgggtattaaagcttccggtaaattacgagtggggtaccgtttattataatggacgagaagtcctggtcaaggcggtgccgattggtattgaaactaaaaacttccaaaaggaagtgcctgaaattactgaaattgagcaagaaatcgcaggattgaaaatctttctgggagtcgaaagattggattataccaaaggtttaaaagaaaaaatccaggggtttgcccgttttttggagaaaaatcccgagtatcggggtaaagttaagcttttacaggtggcggtaccgacccgggaaaatattgaccaataccaaacttatgcccgggaggttttggccgaagccgctaaggtaaatgaacgttttggcgataaccactggcagcccataaagattttaaagcgaaattatagccaggaagaacttatctatttataccgcattgccgatgcgcttgttattacttccctggaagatgggcttaacttggtggctaaagaatatattgcttccagaaaagagccgggagtgcttattttaagtaaacggacgggagttgcccggcaacttaatgctgctcttttggtcaatccctactcgccggaagaaattgctctaaaaatgaaagaagccatagaaatgccggataccctcaagaaaaagagtttttctttattaaaggaacaggttatcttaaaaaacaatgaatggtggctggaaaatttcctgggaaaagaactacggttgatggatacaggttttggcaaatactaccgcaaacggggtgaaaagaaagttggagctattgactaagctttctggccgaaaaatactgctcatgaccgattttgacggaacgatagcggcttacagaaaagacccgcgcaaggtaagtttagccaaagatatggtggcaatcctgcagaaatttacccggcagccaaatcttaaattagcggtggtttccggacgggggcttcaggatttagaaaaaatggtaaatatccggggaattattttagccggctgttttggaggagtatttcgggatgaacagggaaaagttcatacctgggaaaaggcccccgactattttggaccggtggaggagttagcggaatttttttcccgttctcccgtttttaaaggagtttatattgaaaaaaaagaaattgccttaactttacattacaaagatttgggagtaaagaaacggcgggaggttttaaaggtaattgaagaagcccgggaaaaaaaccctatctttaacttccacgtgggagataaaggaaccgaaattatcccgcagggattgggcaaaggatggtttattcaggaaatgttaaaaaaatacccggacttttatccggtgtttttagggaatgactgggtagaccttgagggaattgaagttttaagggggcagggtttagcattttacgtaggggataccccgcccccgggaagtcacgggctttcggggttaaaagaggtgaaaaagctttttaagaagcttttggcagtaaaccaagccgctttaaatgcatcttaatgccgatgatttcccacatccgtacccaggggtcaattttttgaaactttaaaggataaaaaattgaattatcggctatttcttcgatggtatatcccttttgccacaatgttttaattttttcttcccgcagggcgattatctctaaaaaacggtttaacccgggtaaaaagtttttcttttccaccattcctttttcgtgccccgttatgtagtatttgacatcaacttcccgtaaaattttggaagacctgataaactggtcgatatcaccgtcgggagccatataaaaggggccaaaggaagttaaatcgtaatccccggtgtaaattatcccgaggtccgggaaatagggaaaaacatagccaggggtgtggccgggagctttaagaaaaatggttttaattccgacaattttaatttcttctgaagttggatacgcttctttggttttttcgataaccgttacaatatctggacgattgtacggcgaaagggaaggacttttaaaacccttttttatttcttgagcccaccagttcgggtaatctttgccgaaataatgtccggttccaagacgccgagcgaattcccttaaatccgaaagggccggtaagtcttccgcatttataaaaacggccgtggtttttggaaaaaaattaataccccagacgtggtcgtagtgataatgggttaaatagatttcctgcacagatagatttttaagaatatttcctgcgccgggatcgattaaggcctgtcttccgttaccttcgagaagcaggctggtgcagtagggaaaacggctattgttttctccgggaataattttaagtggtccccaatcttccatttttctcccccctcttctttactatcttaacagaaaagaattaatccggctatgccggatcagggagtagagggtgatatttttattatcattgacaggaaaaatggcaaaattaccgaattcttaaagtagtaaataaaatatggaggttattaagaaaaggtgcagggagtaaggcagataaacaaaaaaattttgggcttgtttctttttatgactttcctttttatgcagcctttggcaataaagcaaagcaggctttcctggatgagctgtggggcgagcggaagtataatgtaccgtatttaaccattgcccaaacccgcaagaaatactaaccgtttagcggttgtttttggcgttttaacgttaaattcatgccacttaaagttttgtcattccgtaacctccaattacatgtgtaaaataatgtaagaaaaggagggagcgggatgactcctcgggaaatcgaagatgttttttacgaaagtccggaagttttagatgtggctgtagtagggataaatgagcctttagctaccgaaaatgctgtggcttttgtggtgttaaaagataaagctaaaattgaaactttgtttgagctgtgtaaaacaaaacttcccccccggtatatccccaaaaaaattattccggtagattttattcccaagaccaaaaccggaaaggtaatttttagcgaactaaaagaaatggcattatgaaaaaacgcggcttttagccgcgttttttatcttaccctgaccgcaccagcataacagctggcataataaccttcccttaaggaggagataattacccggtctttgccggaactggcatggataaactgtccgtctcctatataaattcccacgtgattgataaccgatgagccctgagttttaaagaaaactaaatctcccggagaaagttcgcttttatcaatctttttgcccacttcatactgggcgagggaattgtgcggaaggttgatgcctacctggcggtaaacaaaagcggtaaaaccggaacagtcaaaggccgaaccggaacttgccccccactgatagggggtgccgagataactcagtgcgatttttaccacatctccccgcccttcaccccgggaaacttttttagtcgttcgggctttcgggcggggggaattgcgggaggtggttttcttaaccaggagtttttgcccgatactcagtttttcggattttaaattgtttaaacgcttaagctcatctaccgttaggttaaactttttagcaatatcccagagggtatcgccggctttaactatgtaaaccgaactaccgctgctggagcgggaaactgccgtagctgttgactttccgggaatcactaatttttggccgggctttaaagcttccgattttaagttattggcttttttaatcgcttcaacggtagtgttgtaccgccgagcaagtaaccagagattgtcgccgcttttcacggtaatagttgttgcccaagccgatgattgcagtaagaaaaccgataaagttaaagttgcaagggattttttcaggttcatggccacactccttaaaagttattaaaaacgcacctaaaactgattattctacaaaaaagccaaaaatcctgcataaaatgaccaaaaattaaaaaaggaattttacgaggtttggttgtataataagtaagacgacaaataaattctggcggggggttttgtggtgaaattaacagaaaatgctctaaaagttttggaagcaaggtatttggcgcgcaatgagaagggggaggtaattgaaaccccggaagaaatgttttggcgggtggctcgggcgatagcgcaggcggaaaaaaattatgcggaaaatgatgaagaagaaattgcccgagaattttataattttatgaccgcgcttgactttttgcccaatacgccgaccctggttaatgccggccgaccattaggacagctttcggcctgttttgttttaccggtgggcgattcgatggaagaaatctttgatgcggtaaagtattctgctttaattcataaaagtggcggaggtaccggttttagcttttcccgccttagggccaaaggggcccgggttcgctctaccggtggtattgccagcggtccggtaagttttatgaaagtatttaatgccgccaccgaagcggtcaaacaggggggcgttcggcgcggggcaaacatgggggtgctccggtgcgaccacccagatatcctggaatttattactgccaaagaagacaacagggatattacgaatttcaacataagcgtcgcgctgaccgataagttcatgaaagcattggaagaagatggagaatacgagttaattgaaccttctactggagaagtagtgggtagacttcgggcccgggaagtttttgaaagaatagcgagaaatgcctggaaaaatggcgagccgggggttatttttattgaccggattaacgcggcaaatgtcgttccggagctgggggaaattgaatcaaccaatccctgcgtaaccggagatacccttgtctttaccgataaagggttaattgaagcaagaaagttagaagtgggaatgaaagtttggagcggtgatggctggaacgaaattaaagaagtaattaacaatggcgtgaaaccggttttaaaacttaaactgaaaaccgggttggaaattaaagtaaccgaagaacataaaatttttaccggtgagggctggaaagaagccaaggatctaaaagtaggcgataaactttatttaccggtttcttatcctgaactggatttcccggtaaaagaagaaaatgatttttatgagtttttagggtatttcctgggagatggttcgttaagcgtttccaatcatgttagtttacatgtgggaaatgataaggaattagctttatacttcaaagaaaaggtagagaagtatgctggtgcagcttatttaattgaaagagacgggcaatatatcatcgatgtccatcgaaaagagtttgcggaaaagataaagaaaatttttggtatagaaatcaccgacagcaaagaaaaagatattccctcttccttgcttgcggttaatagcgaagctatgaaagctcttttacgaggtctcttttctgccgatggctcggtttatgatgctaacggttcgattactgttgccctgtcgtctacctcttatccgttattaagaaaggttcagattttactgttatcccttggaattccatctacccttaccggtgaaaaagaccaggacgtaaaaataattaagggcaatgagtacgaaacgctaccgacttaccggttaattatttccggagaacgggcttcgttattttttaacaagattggcctaattggggaaaagaaaaagaaatttttagaattaatggctgggaaaacgacctactcgacattaaataatcatctctaccaggagatagtaagcatcgaacctgcgggggaggaagaagtatttgatataactgccccaccaaaatatacctggatcaccaatggcatattgagcttagactgcggcgagcaacctttactgccctacgaatcctgcaacctgggttctattaaccttgccaatatggtaaaagacggagagattgactgggaacatttggaaaaaactgtgaaactggcggtacgtttcctggataatgttattgatgttaaccattaccccttaccggaaattgaaaagatgaccaaaaagacccggaaaattggtcttggcgtgatgggttttgccgatatgttaattaaattaaacattccctacgattcggaagaagccctgaatttagccgataaagtgatggagtttattaataaaaagtccaaggaagcttcggcagaactcgcccgggttcggggtactttccccgcctggaaaaagagtgtctgggctaaaaaaggattaaaacttagaaatgctactaccactacgattgctcctaccgggtcgataagtataatagccggggtatcgtcgggaatagaaccggtttttgccctggcgtttaaacgccatattttggaccgaaaggacattgtggaagtgcatcgcctgtttgaacagcacgccagggaaaacggctattacagtgaaaagctcatgaatgaggtggccaaaaccgggcggattaccggtattgccggggttccggaagaggcaaagagacttttcgttactgccttggatattgccccggaatggcacgttaaaatgcaggcggtattccagaaacataccgataatgccgtatccaaaacgataaacatgcccaattccgctacggtggaggacgttaaggaaagttaccttttagcgtataagctggggtgcaaggggcttaccgtctaccgggatggcagtcgcgaggagcaggtgttaaatgccggccttaacgaaactaaaaaagacgagaagcccgaagagttaaaaacttataaagttgtaccccggccgcgaccaacggttacgtacggaataaccgaaaaagttaaaattggctgtggcaacttatacattaccgttaaccgggatgaacagggaatttgtgaggtgttcaccaacctcggacgggccggaggatgtccttcccagtcggaagcaaccagccgcctggtttcgttggcgttgcgctcgggaattgatgttaccgagataatcgggcagttaaaaggtataaggtgtcattcaaccttaaggcagatgggtaacggtaaggacatcaaagttttgtcctgtcccgacgctattggaaaggccatggaaaaggttttaaaggatgcttacggttttaaaggtaagatagaagtagatgcaccgccggtggtgatcagtaacgagggggatgtttacattcccgaagacgacggcgaaaggaaaaatggctactgtcccgaatgccacagcaaattagaacatgaaggcggctgcgtagtttgtcgcaattgcggttattccaaatgcggttaaaaagccttgcagcttttgctgcagggctttttccttttttgcattttttgaggttgatatgtccaaattaataggtgaagctgaaatgtttggttatggcaaaaaaccagtgtaaaacattaataaaaaagtttgtaatgatagacaaagaaggagtttagtaacaaacttaataaaaaaaataaaaaaattttttcaattgcggaaaagttagcaggaaaatcaaaaaaaagagcgaatataaaataatgtcgaaaaaagacgagaatcctgaaaaggcaatttgtgaatatttatacaaaaacatttaaaaaggtttttatatgttgcggaaaggaaggagaattcctgatgtctccgggtaaaaccttttttacaattggtgatgcggcaaagctaattggggtggtgccagcaacccttagaaactgggaaaaggcgggattggtaaaaccgggccgacaaaatgggaactaccgtatttattcccttaaagatattgaaaggctcaaaaaaattaagtacttaatgcgggttaagggttttaatatcgttggagtgaaggaatacctggccgcgcagggggaagaattgccggcagaaccggttaagattgagaaaaagggaccgaggatagcggtcgggcaaaaattaaaggcgcttagagaaaaaaagggtcttaccctggaggaagtttcccagggaactggagtttcggtttcgtatttaagccgaattgaatcggggcaagtaaacgtttctatcgctaccctccagaaactcgccaccttttacgaaaaaaatctcctgtatttttttgagggaatggataccaaagagcaaaaattggtccgggcgggcctaggtcaggtgctggaaactgacgaagaggggattaaggttgagcttttgactgctttaaatgaaccggctatggagccgctcctttacaccgtagctccgggggcgggaagaaatgaaaatatttcccatgaaggggaagagtttgtctacgttttaaaaggggttttagaagtgtggcttgatgaaaccgaacgttacgtggttgggccgggggatagcctttattttaaaagtacccagcaacaccgttggcgtaatattggcgatgaagaactggtagccctctggattaatactccgcctaccttctaaaagggttataagcccgaaagggctctaaatacctaaaaaacttaaagggggttttaaaatgggttttgatttggttttaaaaaatgccaaaatccctcaaggcaaccggactgtggacacccacatcctggtgaaggacggtaaaattgccggttttaccaatgaccttaccgggattgaggttgccgaagtaattgatgctgaaaataaccttgtattgcctgggtgcattgactcccacactcactttaatgatcccggctttacccaccgggagaattttgctaccggtactcaagctgctgcggctggtggggttacaaccatcattgatatgccctgctgtagcataccgtcggtaaggagtgtggataaccttgaagcaaagttagaagtaatcaaggacaaagcgtatgtagactatgccatgtggggtggggctaccggcgaagatgtgcggaacaatgccctctacaacattaaagaacaagccgattatggagtagtagcttttaaagtttacatgactccatcagttccaacttatccgccggcaagcgatgcggagatgctggaaattttccgggaagtagctaagaccggactacccgttggcattcacgcggaaaacttggacctttgcacttatcacgttaacaaattaagaaatgaaggccgttttgatgggccggcctgggcggaagcacggttggaacttgcggaaaaagttgctattcaaatggccattagttttgcggaagaaaccggtgcccggttacatatcgtccacatgagcaccggcatcggtggtgtgcttgtaggagaagctaagaaacggggtcttgatgtaaccgccgaaacttgtccccactacctggtcttaaatgcctatgaatcaatgaccaaatggcgtcaatttgccaagattgcaccgcctttaagaactaccagagacaatgaaatgctctgggaacaattagctgatgggcgggtagactttattgctactgaccatgcaccttatgaaattgctaccgaaaaagaagctgaaggcatggacatctggacggcgttcccggggattccgggggtagaaaccatggtaccgattattatcagcgaaggttataataaaggacgtctttccttatcccggttagttgatgttctttcccggaacgcagcaattcattacggtctgtatccgaagaaaggtgccctggaaattggctccgatgcagactttaccgtaattgaccttgactatgaatggaccattgataaagataagatgtacaccatggccaagtacacgccgtttcatggtatgaagcttaaaggcaaacctgttaagaccatcgttcgcggtaaactcgtttatgacgataagaacggtattgttggtaagccaggatacggtcaattcgtaaagcggcaaacgatttctaaattagaacgctggattaagttttaacctgtaaaaaggttaaaaatatcattacgaattatcaaaggaggagaaaatatgaaaggtgacagacactgtatagttatcattgacatgttaaacgacttcattggacccaatgctcctttaagatgccccgatggggaaaaaatcgttcccaacttgcaaaagcttgtagaatttgcccacgaaaacggtattaacgttgtttttgtgcaggaagcacaccggaaaaacgatgctgactttagagtacgtccggttcatgctgttaaaggtacgtggggttctgactttattccggaacttcgtcccgatgaagaaaaaggtgattacattgtgcaaaagcgccgtcacagtgcttttgcttacactgacttagacctctacctcagagaagaaaaaatcgacaccgtagtagttaccggtgtatggaccaacgtttgcgtaagaagcaccgcttccgatgctctttatcatgcttacaacgtaattgccatatccgactgttgcgcttctgctaacgaagaaatgcatcaagcaggcttgagagacatggcgttgtttgccgaagttatgactttagaagaatacatgaaagaatggcccaatcgggaaggtgccaagaagtaactgtcttttaagggaaaggtctaaattgggcctttcccgtctttacattctaaggaggcttttttaaatgcgcattgtagtaggggtaaccggggcaagtggggccatttacggctatacgctaatccaggtactggcccagatggggattgaagttcatgcggtttataccgaaatgggtgagaaagttttaaatcacgaatgcggtgttgatttggcggaagtcgctaaatatgcccggctgtaccataattccgacctgtttgccccgattgccagcgggtcgtttaaaacccaggggatggtggtggttccctgctccatgcataccctgggagcgatggccaacggtacgggagaggatttattaaccagggccgcggatgttactttaaaggaaggtcggaggttagtagttgtaccgcgggaaactccggtgaccgttatacatctggaaaatatgctccgcttgtccagggtgggggcagtaattttacctgcttctccggcgttttactttggtccccagaccttaagcgatttggtggctttcataatagggaaaattttagatgcccttgcaattgaacacaatttgtttaaacgctggggggagtagtacgagaggaggttttaacttttggcagcatcgctgaggagttttttagagcaattaaaacggcaaaactcattatatttagtgaaaaaaccggtaaaccccagatttgaactgggagcactcctgaaaaaaaccaagggaactgttcccatgttttttcaaaacattgaaggctacgatgtaccggcggtaggtggcattgttggtaccagggaaaattttgctcaagctttaaggataaacaaatccgagttgttagccaaaataaccgaagcaatcactaatcctggtgaaacccggttactgccgtccggtccggtacaggaaaatgtcttgaccaaaggttttgatatcggaaaaatgtttccaattcctacttttcacgaaaaagattccggagcgtttataacagcgggtatcgttgtagccaaagatcccatttacggacggcgttttacctctattcgccggatgcagttaaacggacccaacaacttgagcattttaattgaatcgccggggttaattgaacaatactatgaatttgaaagacgtggccaggccatggaagtggccatagttttgggtgttcacccggccataactttatccagccaacttccgacccaaacctttggtttagataagtacaatgtggccagccggctcataggcgagccgcttccggtggtaaaatgcaaaacaattgatttagaagttccggccgatgcggaaatagtgctggaaggacggatgttaccgtatgttcgtcatcccgaaggaccctttggcgaattaatgggctactacggaccgcaaacaatgcagccggtggtggaggtcaccgcggtaaccttcagaaacaacccgattttccaagttatcttcccttctagctacgaacataaattaccaaatgctttgatgcgggaagtagtcttatttaaccacgttcgccatgtggttccaacggttcaagatgttcacctaaccatggccggcggtggacgctgccatgcgattatttccattaaaaagacggccgaagggcaaggaaagcaggcaatttttgcagctctggccagcaataaggatgttaaacacgtagtggtggttaatgacgatgtagatatctttgatccggaagatgtagaatgggccattgccaccagggtgcaagcggatcaggatataataattatccccggggcgcaggggacgccactggagccatcccacaatttaagaggggtatcggccaaaatgggaattgatgcgacctatcccctggcggaagaagaacgatttgcccggactcagattccgggatatgaccaaatccggttggaagattacttaaccctggactggtaggaggtaatgtttaatgggtaatgcaattggctttgttgaaacccgggggcttacagcagcaattgaagcagcggatgcgatggtgaaagcggccaatgttcgaattattgaataccgggtggttggctcaggcctggtgaatattacagtgcaaggagatgtagcggcggtaaaagcggcggtggatgccggtgtggcagcggcgcaaaaagtgggagaaatagtatcctttaacgttatccccagaccccatgaagaaatgctgaaggttatacccgtgatataaaggggtgaaaaagtttggaaaaccttgtagataaaattgtgtctgaggttttaaatcggcagagccgagaaattactacgattgttagccaacctaatataagccgtcccaattatcagcgggaaaaaggaaaggaacggcttttaggaattaaagcaacggaaagtagcaataaagcaggtcaatcctttgttcctcagttaaatcccagcggaaccctttttaccatttccatgaaaccaccggcgaaaattaatactggatacacgcccgtggacgagcaaaaagaagttaaagctgaagttaggaattcggaaattacggagaaaagttttgggcaagcaaaatttatcggggtttcggcgggaaacaccgttggttacgtaattcccaatcttgaaccggggcttagccaatacctccaggctaacagaagcttaagagctattggggtaattagctcccgggttggggctgcggcgcaaatcatggcagccgatgaagcggtcaagaagaccaattccgaattaattcggttagagcttgcccgtgatgaattaggtggtccgggacatggagtatttgccctttttggggcagaagatgtggcagatgttatccgggcagtggaaattgccctcaaggccacggaagagtactaccagaacataaaaaatacgccggcaggaaaaattgaaacccattacacggctcgcgcagcggcagcattaaacaaggcttttggggcgccgttaaatcaggcctttggcattattataggggctccggcaggggtaggattattgatgagtgataccgccttaaaaactgcccatgtgaccatggtatcgttctgggggccctcggtagttcaggcttttgccaacgaggtatggtttacagtaaccggcgattcagcagcggttaaaaatgccttagaagcagctcgggaagttggattgcaggttttggcggaatttagggcttaaaggaggtttattcgatgaataaagcccttggtctaattgaagcaattggttactctaccgctatgacggctttagatgctgctgtaaaagctgccaacgttacctttttgggctttgaacgggttataggggctggaaaaaaaatttccgttaccataaagcttgaaggggaggttgcggcggtaaaagctgcggttgatgcaggtgttgcggcggctcaaagagtgggcgaagttttaacttcgcatgtaattcctcgaccccatcaggagttagataaaatcatttttagcagtgaaacccaagaatcgttgttaaagcctaaaaatcctgcggaaaaaaataaggataataaaaaatctaagtaaaaattttaaggaggtaatttaatcatgggtgaagctttaggtttaattgaaactaaaggtttagtggcggcgattgaagcggcggacgcgatggtcaaggctgccaatgttactattgttggctatgaaaaaattggctttggtcttgtcaccattatggtgcggggcgatgtaggtgcggtcaaagctgctaccgatgccggggctgctgctgcccagaaggttggcgagctggtagcggtacacgtcattccgcggccacacactgaagttgaaacgcaaattttagccaaaattcaagggaaatagtccgggagtgatcccggtactatcccctgccttgttaggaggggttaggtggagctcgaacaaaaacttaacttgttaaatgatttaattgtcagagaaatagtaaatccgctgccaccaccctataaagttggcgttgacctcggaactgcagatatcgttttggtggtcaccgaccaggaaggaatacctgttgctggagcattaaagtgggccagtgtggttaaagatggcttggtggtcgattacatcggagcaattcagattgtgcgggaactaaaagccaaagtggaaaggcttttagggagtgaactttttcaagcagccacggccattcctccgggaactgtaggtcggaatgctgaagcttgtggtcatgtagttgccggggccggattggagctggtaacactggtggatgagccggtagctgccgcacgggcccttgggataaatgatggtattgtagtagacataggtggcggtaccaccggtattgcggtaattgaaaaagggaaaattaccgcaacctttgatgaaccaacaggaggaactcatctttccctggtcttagcaggaagttacaagattccttttgaggaagcagaaaccatcaaaaaagattttagccgtcatcgggaaattatgccggtagtccgtccagttattgaaaaaatggcgcttatagttaaagaggtaattaaaaattacgatcaaactttaccggtttatgtggtgggtggtactgcttacctaactggttttagcgaagagttttccagatttcttggaaaagaggtacaggtacctatccatccgctgttggtaacccctttagggattgcgctttttggataggggtgaaaaaatgtccatttatcttactgcaatgaaaaactatttggagcagcaaaatagcttaaacagttcaaagccaaaagcactaattttggttgctggagcgaccggtggggcgcaagaaggctttcaagctttagaacgtttaagggaaagctatgaaataatagttgtagccagtcaagcggctttggatctttacggtgaagaaaatcttaaatcccttaccggaacagcaaaaatctaccagggtaaggagtttaaaatttatgactttttaaaagttgtgaccatagtgtttttaccggtggtgtcttccaacctggtgggcaagttagcccatggcatttatgatgaaccgttagcttccttaatttttcatgccaagcttgcgggcaaaccggttataggtgttgtggatggagctttacccgatggtgatggctttaaaagccggggatttaccaatccccctccgggtctggtaaagcttattaatgaaaatatcgaaaaactacgggcccaggagatctatctctataaaggtaaaacgattttagaaaagctttctccctaccttggaccgcaaacagcagaaacttctgttgtttcatcaaagacgggagttactttaaataaacgggttattacccgagaagatcttttagaacttgccaatcaaactattactgtgtcacaaaaaacaattattaccgaccttgcccgggaatatgctgtccaaaataatataaaaattaattttgctgaataggcggtgaggggatgttactgggaaaagttattggtaacgtagttgccacgcggaaagatgaaacattggtcgggacaaaaatgctcattaccctgccggtagacttagatggtaatcccgcaggtcagccgtttgttgctgtggatacggtgggagctggagttggcgagttggtgctgtatgttaccggaagtgtggctccctttgcggtacgccggggggaggtacctatcgatgcggcgattatcggtattgtggataagcttgaatggcaacgaagttaaagaggaggttttttatggatgcccaaacctttaagaccgcaattgtccggcgtcgcttagttgatgttttaatgaatccggaattaaaagcgacgttggtcttaaaaaacggtctggtaatcaatgttgtaactcgggagatctatccggcagacgtggcagtttacgatgaatacattttaaaagtgggagatgcttccgacctaattggcccggaaacggaagtggtggatttacagggaaaatattacgtatctccaggatttatcgactcccacatgcattttgaaagcagtatgctaaccatttccgagtttagccggttgtctattccttcgggaaccactactttagtggcggacccccacgaaattggcaacgcgctgggacctgttggtattaaagctatggccgaagaaacaaaggtagttcccaacagggtatatttggtagtgccggctttaactcccgactgtccgggattagaaaccgcgggctatgatattacttccagggatatgccggaaatactaaattaccccaatgtcatcggcatcggggaacttcagggcttttccaatgctaagtatgtttataaatacaccccggaaattattaccgacttaattgcctcaacaacctatgccaagtccattggcaaaatagtggatggtaacgctccggagctttttggcagcgaattagctgctcatttaattgctgccggaaccgaggcttcctgtcacgagaccaccaccaaagaagaatgtgtggaaaaacttcgctacggtatgtatgttttcatgcgggaaggttctacccagaaaaacatggccgaatgtatccgggcggttaccgaggaaggtctggattcccggcggttaattggggctaccgatgatatggtggccgaggatttagccaaaaatggccacatgaactgggtagtagcccggatcattaaacaagggattgatccggtggaagcaatccaaatggtaaccattaacccggctacctactttggcttaaaacacgttggggttttagctccggggaagatggccgatatcgtggttatttccgacttaatggacatgaaagtggaaaaagtttatatcggcggaaaattagtggccgaaaagggcaaaatggtagttaacatcccgaaatacacctaccccgaagaggtaaaacattcggttaagtgtaaaccggtaacagctgaagccctggaaatcaaagctactggtagtaatgcggtagtgcgcaccattgggttgattcccgaccagaaccttaccgagtcctttgaatttaccgttccggttagtgggggtgtggcacaaccggatttaacccaggacgtactaccgattgcggtggtggaaagatacggacgaaatggcagtattggacgggcttttgttagaggttttgggttaaagggcggtgcgtttgcggaaagtgtcagccacgatgctcacaacatcattgtggttggaaccagttaccaggatatggcgttagcggttaaccgggttattgaaatgggcggtggcgtggcggtggtgaaaaacggcagggttttaggcgaccttcgcctgccggtaggaggtttaattaccgacgagttagatggctatgaattatctcggaagattgccgaactccatcgtttaactgccgtggagcttggttgtaccgttcatgcaccgtttatgcatctgtcgtttttagctttgaccaccagtcccaagtggaaaattaccgaccagggtttaattgatgttaatagttttgccatcattccgccggttaagtaaggaggggcacttatatgcaaaaggttgattattttcgacccgaaaccatagaggaagccctggagcttttagccgctggtcgggaagagtataaaattctcgctggcggtaccgacctggtgcttcatttacgggagaggaaagttagtcctaaggctttggtggatatcactcatatttctgctcttcggggcattagagaagaacaaggaaaaattattattaaagcggcaacaacctttacggaagttgccacctcctcaattgttttagaaaaaatcccggcccttgccgatgcctgtaaagttgtgggctcaccgcaaattcgcaatcaagggaccattgggggcaatatagtaaacgcctctccagccgccgattcggtaccggcgttggtgctgtttgatggggtagccaaacttaaaagtaaaaggggtacccgggagattttacttaccgagcttctcaagggagccggaaaaacagcaattgaaccggatgagttgttagaagaggttattttaacgccgtatccaggaagtgtcagcggtttttacaaactcgggcgacggaatgccctggcgatatcgcggatttctggagcggtggagcttgtttttgccggcagcaaaattgaaaaggcaagagtggccctgggttcggttgctcccaatccctttcgggcagcagaattagaacagtttttaagcggtcgggaatttaacgaagaaactaaagaagagcttatcgttcttgccaaaaagttggtggcggataagcttggcagtcgtgcatcggcgccctacaaacgcgaagcgattgccggagttatgcgggaaattttaaatctcattgaacagcgccgggggaggtagcggccgtggagatgaaaaagctttcccttactgttaacggaaaattaattgaaagggaagtaccaaccaacatccgccttctcgatttccttagagattacctacacctgaccggtaccaaggaaggttgcggtgaaggagagtgcggtgcttgcaccgtattactggatggaaaaccggtcaactcttgcttggtaatggcccattcggctcacgggcgggaagtgattaccattgagggcataggtacaccggataaacttcatcccattcaagaggcttttttggaggcaggagcggtgcagtgcggttattgtactcccggaatggtactggctgcctatgctttattaaaagaaaatcccaatccaacccgggaggaaataaaagtggcaatttccgggaacctctgccgttgtaccggttacaacaaaattgttgatgcggtggaacttgctgcccgaaaggagggaaagtaaatgcaggagcggattgtggggcaatctccctggagggtagatggcatagctaaggttaccggaaaagcggtttttccgcaggatatataccttcccggaatggtatacggtaaaaccgttcgttccaagtatcctcatgcaaaaataaccaaacttgatacttctaaagccgaggcgctaccaggagttttaaaagtattcaccgctaaagatgtacccggtcataacggtcacggggttttacatccggatatcccggtttttgccgacggtaaagttacttccataaatgatgctatttgtctggtagtagctgaaactcaagatattgccgaggaagcggcgcttttaattgacgtggaatacgaagaattgccggcggtttttgatccccgggaggcaatgaaggaaacggctcccaaacttcgtgaaaacggtaacattgcttatcacttaaaaatacgcaaaggggatgtggaaaagggtttcgcccaggccgatgtcattgttgaacagagctttaagacgtccatggtagaccaggcgtttttgcagccggaagcaggagtggctacggttgacgaacggggacatattgttatttatgttgccacccagtatccccactgggatagaacggaaattgcccgggccttgggggtttcacagaatatggtcagagtagtgaccaccgctgtgggtggtgcatttggcggccgggaagacatgacggtacaaattcatgcctgcctggcagcgatggtattaaaacggccggtaaaaattgtatatgaacggagcgaatcttttaaagcgcatagcaaacgccaccccatgtatatggattacaaggtgggtgcaacccgggatggtaaattggtggccttagaggcgacgattatcggggatgccggggcatacctttcctggtcgccgaacattttgaggaaagctgcggtacacgccaccggtccgtattatatccccaatgttaaagttgactcttatgccgttcacaccaacaatccttttaccggagcaatgcgcggatttggtgcggcgcagcctccaatggcttatgaagctataatggatatgctggcggaaaagttaaatcttcatccgtttactattcgctggcggaatgcctttgaacggggttcggaaacggccaccggtcaaattttggatatgagcgttgggctcaaggaaacgatgcttgaagccgccaggcattttggctggaacgtcgaagagctgaaataaggaggtgggagcggtgaaaaaacggggtatcggaatggcttcaattttttacggtaccggttatggtaacggctttcctgatgtctccagtgcagtggtggaaatccacgatgacgggagtgctaccgttttaaccggtgctgcggactgcggtcagggttccaacacggtgctggtccaaattgctgcagaagaactggggattccaattgaaaagattaccttaatttcggcagataccgactgtacgccggacgccgggactacggcagctacccggcaaacttatacctccggcaatgctgttaaattagcagcggctaaagcgaaaaaaattcttttggattttgctgccggagttttagcggttaataccactgatggtcttgatattaaagacggttatgtttatgtgaaaaccttcccccaaaagcggatatctgttgcagagctggccagccatgctcgttttaaaggtaaccgcttaattggggaagcaagctttaccacccattccaccatggttgatccggaaacggggcagggagctccctattacccttatgcctttgctacgcagattgccgaagtggaagtggatactgagaccggtaaagtggatgtaattcgggttgtagcagcacacgatgtaggtcgggctatcaataagattgctgtggagggccaaatccaggggggtgtggcccagggggtgggctgggccttaaccgaagaagtggaactgaaaaacggccaaattcaaaaccccagctttaccgaatatttgatacccactgctttagacataccggaagtaaccccggtaattgtcgaaacttatgaagaaaccggcccttacggggccaaaggggttggggagccggcaatgctgcccacaatgcctgccatcttaaatgctatttacaatgcggtgggcgtcagaattaccgaacttccggccactccggaaaagatcttaaaagccctaaaagaaaaagagcagaaaaatgcttaactttgccggttaccaattaagttatcccgtgtggttaaccggaggcgggggcaaaacatcgctaatgtattatttagcccgcagtcagaaaggtccccttattcttaccacttctacgaaacttgcttacccgccccggaaggaactatccttttaccagttacaaaaattagaagaagcattaccactggtaaaagacgaaagaaaaatattagtaggaagccgggtagaaaaggaaaaaatcattggctttagcccgaaagaattagacgcattttaccggcagtacaagattccgcttataatcgaagccgatggcagtaaccgtcggccgttgaaaattcactggtcccatgagcctgctctgccagaagttccggagacggttattgctgtggtaggattatctgcactaaataaaccgtattgcggtgagtatattcaccgggccgaaggaatcccaggaaaaaccattacgcctgaagtgctgtatcagcttgttttgctaggaaaatattttgctccgaataccaaaaaaaaggttatctttctcaatcaagcagatgctgtagataataaacagttaatgaaggttctgtccctgtttaaaagtagtggtgttaacgtaacttacggatcgctcagggagggttacatcttgccggggtagtgggggttcttattttggccgggggaagttcccggaggatggggaaggacaaattgtcattaccgttatttggcaaaacgatattggagcaaaccgtcgcaatataccgccgggtttttgccgaagttgaggtgataacgaaggataggatcggtgaaagctttgctttagaaggaatgggagggactttacggggagcagctcgactactcccggaccactggcagggtgtggtgatagccctgggtgatatgccgtttgttggaattaatagcttacaggctctatccagagctatcgcgatgaaaccagaagaagtatggtgtttaagttatcgggggcgtaggggacatccggtttatctacccagaaaatatttttcctatttaaaaaggcttaccggagacactggtttacgggacttacttccggagttaagtcctaagtacatcgatacggaggattacggtgtgctttttgatatagataaatccgatgattaccttccttttcagcggcttgtagtggtcaaaggcgccggagacattgcaacgggcataatttggcgtttgcatcaagcgggatttaaagtagtggcaacggaactttccaaacctacggcaattcgtcggatggtagcctttgcccaggcaatatatacgggagagcatacggttgaaggtattactgcacgccggtctaacctttttgaggttccaaatttactggtaaatgattttattcccgttatccccgatgaagaaggtattgtggtaaaagagctaaaaccctgggcggtggttgatgcgcggcttgccaagaaaaacctggggactaaaaaagaggaagcggaaattgttattggtgttgggccaggttttactgcgcccgaggaagtacatgcggttattgagacaaaacggggacattacctgggacgtgctatttatcagggttcagctttgcccaataccggtatccccggcgaaatcgggggacacaccgttaaaagggtggtttattccccggggaggggtaaagtttgctggtattttgattttggccaggaggttaaagccggtgaggtaataggaactgtcggtgaaaagcaaattgttgctgcggtttccggggtaatccggggcctcattcacccggaagtctgggtggaggaaggaatgaaaattggcgatattgatccgcgaggaataaaagagtatgcgtttaccatttccgaaaaagcgctggcgattgctggcggagttttagaagtgcttttaaagctgggtaacaccagcttaaaataaaaaaattaaaagaaggaggaggataagtatgaataagtacgttcatgcagtacctaacttttctgaaggacggcggaaagaggtagttgaagccattgtagaccaggtgagaaacgtccctggagttaaactaatcgggtatttccccgatgccgactttaaccggacagtggtggagctgattggtaagcccgaacctttaaaagaagctttaattaacatggcggccaaagccattgaattaatcgatatggaacagcaaagaggtaaccacccgcgaattggagcgcaggacacaattcccattttccccatgagaaacattactttggaagaatgcattcaattagctgaagaaatcggtgtagaattaaataaacgtaccggtgtgcctattttcttctccggggaaaatgcccggattcccgaaagaaaggcccttgactttatccggaaaggtcagtatgaaggtttacgggacttgctcctatcggaaaatccggatcccaagcgtctaccggatatcggtgatgtcaaagagtttgtccacaaaggtggtaccattgttagtgctggaactaacccgttagtggcgtttaacgttatcctcggaaccgataacctggaaattgccaagcaaattgccaaagccgtaagaggaccttccggtggctttacctcggtgcgggcggtagccttgaagtttaccgaaagaaatcaggtggtcgtttccatgaacatgtttgaccacgaagcttgcccactttatcgaacttacaattttgtaaaatccgaggcagcccggtggggtgtacccgttgttggcactgaattaattggtaccgtgccgcaggaagctttggttcgggtagccgagtacttcctgcagttagaaaactttaaccgcgaccaaattcgggaaaaccacatacctgacttactgtaagaaaaccgggcagggtttacccctgcccttcccctaattaaacaggaggtgtaataatgctaacggacttgtccatacgtgggtttataatggaattagcttcttcttctccagcacccggtggaggcagtgtttcagccttagccggagctaacggtgctgcccttttaaatatggtgttaaatttaacccttggccgggaaaaatttgccgacgttgaagcggaacttgctcctttaaaggataaaaccgaagctttatacgaacgtttggttaatttaattgatatcgataccgaagtttttaacgaagtaatggcggcgtttaagcttcccaaagataccgaagagcagaaaaaagagcgttcggtgaaaattcaagaagcctataaaaaagcggccgacgttcccttggaagtagccgaaaggtgcctggaagttttacgcctgtgtccaattattgctgaaaaaggaaatcccaatgctctttccgatgccggtgttgccgcgcaaatggcttatgcgggccttgaaggggcagttatgaatgtgaaaattaaccttagttccatcaaagatgaggagtatgtagccgctgcccgagaaaaagtagcagctttcttaaaagagggtgccgagattaaagacagggtagccaattatgtaaatgaaaaattataaacaaaattataaagcataaaggaaatcaattctacaaaatgcgacaaaaaaatattttttctgaaaattaaagaaggaattttaaaatccgtgtcgaataagtatttttagaaaatgataatgcaaaagataagaatgttaaagtgaactttaaagaattaactgaaaaaaatatgtaaattgtttttataaggttatgggtaataacccgcaagggttattatatatggggcaccggaggatttataaaaattattaagaaaggggtatggttatggcatcaaatcaaggagtgctcgaacgtattttcaagttgagccagaaggggaccaacgttaaaaccgaaattttagctggtgttactactttcgtgacgttggcctacattatctttgttaacccgaacattctggccgatgccgggattcccaaagaagcagccattgcggcaacaatttgggctactgcagtggcgacaaccctgatggggctctgggctaacttcccggtggcggtagcacctggaatgggtctaaacgctttctttgcgtactttgttgtggctcagttaaaactaccctggcaggtaggtcttggtgcagtatttttctctggtattttcttcttaattttaaccattggcggtatccgtcaggcaatcgttaatgcggtgcccaataacttaaaagccgctattggagttggtattggtttattcattgcatttattggattaaaaaatgctggtattgtagtggcagaccaagctacatttgtgactttaggtcatcttaccaaacctgagcctttgttggcaattgtcggtttaattttaacagcggttttactgtcccggaatgttaaaggagcaatgttaattggcattataactactaccattttaggaatgatttttggtgtagtaccggtgcccaaagggattagcggaattatgagctttaatatgccgagccttaagcctacattcttacatcttgatatcgccggtgcctggaagtttggaatatttaatatcatctttaccatgacaatggtggaactttttgacaacatgggtaccttaattggattaacccggaaagcgggcttaatggatgaaaatggcaagatcgaaaacttggaccgcgctcttaccaccgacgctattggcacgattatcagtgcgattcttggtaccactaccgttacttcgtatattgaaagtgcagcaggtattgctgaaggcggtaaaaccggtttaacggcaattgtcgtggcaattctctttgttgtggccttaatcttcgcgccgcttatcggattggtaccagcatttgcaactgcaccagcacttattctggtaggtgctttgatgctggcggaaatccgacatgttgaatttgacgactttactgaagcattcccggcctttatgaccattatcatgatgcctcttacctacagtattgcaaacggttttgcctttggttttgtttcgtacacattggtaaaagctttaaccggtaagttcaaggatattagctgggtaatgtggattgtttccattgcttttgtcataaacttctacatgcggctccactaaagaaaaaataagctcctgcaaggaaaggccaggcgtaatgcctggtctttaatccttgtgagaaaagttgcaaatttaatttacaatgccaggcccaaactgttttcaagggagtgactgccatgtcaattttaattaaaaacggaacaattgtaacaatgaacgaaaaacgggaaattttaaaaggcgatttatacatcgagggaaatatcattaaggatattggcccttctttagatgttcagacggacaaagttatcgatgctgccggcaaagtggtgattccaggtctaatccagacccacattcacctctgccaaacccttttccgggggcaagcggatgatctggaacttttggattggttgaaactccggatctggcctttagaaggaggacacgatcccgaatctctgtattattcggcaatgctcggaattggcgaactgtttaaaggcggaaccactgcaattgtcgatatggcaacggttaaccataccgattctaacttccaggccatttatgatagcgggattcgggcgatttccggaaagtgcatgatggattacgggacggaagtacccaagtccatgcaggatactaccgaaaatgccattgatgaaagcgtgcagctcctggaaaaatggcacggcaaggacaacggccgcatcttgtacgcgtttactccgcgctttgcggtttcctgcaccgaagatttattaaaagaagttgtcaagttagctgagcagtacaaagtaagggttcacacccatgcttccgaaaataaaggagaagtggagcttgtcttaaaggaaagaggcatgagaaacgttctgtacttagaaaagttagggatgacggctccaaacctgatccttgcccattgtattcatttagacgaacgggaaatgaaggtcttggctgagtccaaaaccaaaattgcccactgcccctcttccaacttaaaattagcatcgggcattgccaaaattcccgagcttttagaaatgggcgcggaaatttccatcgccgccgatggcgctccgtgcaacaataacctggatgcctttattgagatgcggatggccgcactgattcaaaagccgttctacggtccaacttcaatgcctgcccagaaagtttttgaattagctaccattggcggtgcccgggctatgggtctggaagaccaaattggcagcctggaagtgggtaaaaaagcagacgtggtcattgtagacctggatgaaatgagaacgaccccaaacgaaggggtaaatatatacacccagctcgtttatcaagcccagagcagtaatgttttaacgaccattgttgacggtaaaatcgtaatggagaaccgggtcttaaagaccatggatgaggtggaagtacgccggaaagccaacgaaagcttaaaacgagtagctgaccgggttggggttagcttagaataggtgagagcgatgaaaccgataaaggatttggtggaagtagcgttggggaaaaagcctgcggacctggttttaaaaaatgctcaagtgtttaatagctttacgggagagtttgttaccggcgatgtagcggtggtggctggctacatcgccggcactggtgaatatgaaggaaagactacctacgatttacagggagcgtatgtcaccccgggattcattgacgggcacgtgcacattgaaagttctatggtggcgccggcagagtttgcccgggcgttggtaccggccggcacccttacagccgtggtggatccccatgaaatagccaacgttagcggaactgcgggaattcggtacatgctggaagcaagcagtaatcttccgataaacatttatctgatgcttccttcatgcgttccggcaacttcgctggaaacggccggagcagtattaaccgcccgggagctttcggaatttatcaatcacccgcgggttttagggttaggggagctgatggattatcctggcgtcttaaatactcatgaggaaatgctgaaaaaattagctgtgacagaaggaaagctaatagacggccatgccccggggatttccggaaaagagcttactgcttatatagctgccggtgtaaattcggagcatgagtgcaccaccgctgaagaggctcgggaaagattatcccgggggatgtacttaatgctccgggaaggttcggcgacgaaaaatttattggaccttttaccggcggtagaccgttatactgcttctcgctgtttctttgttaccgatgaccggcatccggaagatttaattaaacttggttctattaatcacatggttaaattggcggtttcggctggagcggatttgccaacggttttgcagatggcaaccatcaatgccgccaattactttagactgtacgacttaggtgctattgctcctggttatcgggctgatattttagtatttgaagatttacaagaattcaagcccaagtatgtgtttaaagatggtaaattagtagcggaaaacggaaagccgctttttaccggctatccggtggacgaccgggctgttcggaatacgatgcgcttaaaagaaatcaacccggaaaaactaaaaatacctgctaaatccaacagggcccgggtcatagggttaattcctcaccaaattgtcaccaaaaagttagaattagaggttccggtggagggaggatactttaaaacttcaacggaaaaggatattgccaaactggcagtttttgaacggcacaattataccggtaatgttggggtggggttaatccacggcctggggcttaaaaaaggagctattgcctccaccgttgctcatgactcccacaacttggtggtagccggaatgagcgatgaagatattattgccgcggtggaggaactaaagcgcattggcggtgggctcacggttgttgccgatggccaggtcttgggaagtttgccgcttcccattgccggtttaatgtccgaccgcaccctttatgaagtccaggaagaactggagaaacttcaccgcatagtaagaaaccttggcgtttctgaaaattacgacccatttatgaccttagcctttttaagccttccggtgataccggaattaaaacttacggacctaggtttagttgatgtctctactttttcggtagttcccgtatccctgtaaaaggacggtagagaaaagatggatttactggatatcatagggccggtgatgattgggccctccagctcccatactgccggagcggtgcggttagggagggttgggcgccttgtcttgggggaggagccaaaaaaagctaaaatctttttgcacggctccttcaaagaaacgtaccgaggccatggtaccgatcgtgctattattgccggtcttttgggctttgataccagtgatccccgtattcgggaaagcttgaagattgccaaagaacgcggtttaaactatgaatttttgccaatagatttgccggaagctcaccccaatactgcttacatggaactctggggggagaccagcattgcgagggttactggaagctcgattggtgggggagcggtgttaattaccgatattaacgggtatccagtcaggattacggccaaatacccaacattaattgttccccataacgatcagccgggagcagtagccaaagtgacgtcggtaatagcatggcacggtataaacattgcccaaatgagtgtggctcgccaaaaaaagggagcggaagccctgatggttattgaaacagaccagcccattgacgaagaaacctgcaaagaaatcaaaagactgcccggaattaccggtggctttatcattccacccctttaaggaggaagccgatgtatttagagtcaattgagcagttaattaaaattgcgaaggaaaatggccaaaccttggggcgcatggccttaatcttagaggccaaagaccgggaagttccggaagaacaacttttaaatatcatgcgtgaaagacttcaagttatgcaatctgcggtgacagaaggccttcagggaaatcgttcggtgggaggtcttgttggggggcaggctttaaagtatcaggcctggtttaattccggtaaatcattagcttcgggggtttttggtaaggcaataacctatgctttggcggttagtgaagccaatgcttcgatgggattaattgtggcagcacctactgccggttcggcaggggtgataccaggggtgcttttaagtataatggaagagtatgaaattcccgaagaaaaagttatcgaaggtttgtatgccgccggggcggtggggttggtgatagcttataaagcttccctttccggagcccaggggggctgtcaggcggaatgcggttcagcggcagcaatggcggcggtggcagcaacggaacttttagggggaagccccgaacaggccgcccatgccggagccattgccctgaaaggtatgttagggctggtttgtgatcccgtggcaggtcttgtggaagtaccctgtgtaaaacgaaatgtctctgctgcagtgcaggccttagcggcggtggatttggctttagccgggataacatccgccattcctttagatgaagttattggggcgatgggggaaattggccgggagttaccgttatcccttaaggagactgcccgagggggacttgcagcaacccctaccgggaaggctttagctaaaaaaattttcgggcgaaaggaggaaaaaaatggcgaaaataattgatttatcccaggaaatttatcagggaatgcctgtttttcccctgcaccttactacgtacatcttccaaaacataacccatgaggagagtattaaaaaaattggctttccctttgctacccgtaacttactgatgaacgaacacggaccaacccactgtgatgcggtgtacgagtataatcctcagggtccaaccatagataaaatgccattggagtatttcctgggtccggcgatttgtcttgatgtatctcatgttccgtacgagcgctacattgaaatttacgatttggagggggcattacggaaacacggacttaccattgaacgtggagatattgttctgctttataccgggcattataatcgcaactacggcacggataagtggctaactacctattccggtttaagctatgcggcggcggaatggctggcccaaaagggagtagtaaatattggggtagatgctccggctattgaccatccagacgatcccaactactccggtcatgcggtttgtgcgaaatacggccttaccaatacggaaaatttagccaatcttgataaagtggccggaaagcgctttttgtatattggtctaccgttaaaaattcgggatggtacaggctctccggtgcgagcggtagctttgttaaacgaataagttatgaatacaaaaaacatgcaaaatccccattgacaaaaaaatattaataaattattctctaagtatagaaatgcatagttgggcacaagggtgtgtccgcttcctaagttagctggcaatggtgccttatttaaggcgccattttctatttttgggacggtgacagaatgtttggtgcaactgtgattattgcttccgcggacagcaattttcggcaaatggtcaaatcagcggttaaaaatctcgactacattgtggtgggcgagtgcgctgatgggccgaccgctctaaaaatggcccggaattttcaaccggatatgtttatcattgatgatcacctgataggtgttcctggccgggagattgctaaaatcctgtcttttgaccgccagtgtgcggtagttttagctatggagtttgaaattgataaactcgatgagtttttaggagaaatgggtgtggttggggttgtgattaaacccttagaagaagaacagttaatcatgaccgtccaggtgaccgaacataattaccagcggattaaagaattagaaaaagaaattgaaagtttaaaggatgccttagaaaccagaaagcttgtggaaaaagctaaaggaattttaatggaaagcttggggatttccgaaaaagaagcgtttaggaagattcaaaagcaaagcatggataaacggatttccatgcgggcggtggcggaagccatcatcttagcgtatgacgttaatcaaaaaaaataaagggggattttggatgagttacaccaaaaacgatattatggatatggtgcgggagcaaaatgttaagtttatccggctccagtttaccgacatttttggggttctaaaaaatgtggccattccggtagaacagttagaaaaggccttaaacaacgagctaatgtttgacggctccagtattgaaggttttgtccgtattgaagagtcggatatgtatttgcgtccggaccccaatacttttgccgtatttccctggcggcccagaaacggtgcggtagcccggctgatttgcgatgtgtacaatcccgatggtactccctttgagggcgacccccgctatgttttgaaaagagctttggcggaagccaaagagctgggttacaccatgtacgttggtccggaattagagtttttccttttccaggtagatgcagaaggaaaacccaccctggtgacccatgacaatgccggctattttgatttaagcccggtagatttgggcgaaaacgcccggcgggatatggtgttggctttggaacaaatggggtatgaagtcgaagcatcccaccacgaagttgctccgggacagcacgaaattgactttaagtattccgatgctttagatgtagccgataaaattgttacctttaaagtagttgttcgttccattgcccaaaggcacggacttcatgcaaccttcatgcccaaaccgctttttggggtaaatggttcgggaatgcacaccaaccagtcgctgtttaaagacggtcaaaacgctttttatgatcccaatggggagttgcaattatccgaaaccgcttactactatattggcggtattatgaagcatattaaagctatcactgccattgccaatccggtggtaaactcctacaagcgtttggttccgggctatgaagcaccggtttacattgcctggtcggcaagaaaccgtagccccttaatccggattccggccaaaagaggctcctctacccggattgaattaagaagcccggacccgtcggcaaatccgtatcttgccttagcggttatgcttaaagcgggcttggatggaattaaaaataaaattaagccaccggcgccggttaaccaaaacctttatgaaatgactgctgaagagcgaaaggctctgggagttgataccttacccggtagcttaaaagaagccattgattgtcttttagaagataaggtaatccaggaagctttaggtaaacacgtatttgagcggtttgtggaagctaagttaaaagagtgggatgagtaccgggttcaggttcacgagtgggaagtgaaaaaatatctcaccatgtattaaaaaggctgcctgatttaaaggcagcctctttttttatgttgttttttagtatattatatagttaaattatagctattttttatatctggtgagaaaaatgccgaaaacgattaaataccgtttaattttctttctaaccctgacaacggtaattgtgggaattatcagttttggttttacccactatcgcgaaataaaagtggctgaagaactggggcttagtgcgtcccgggagctggccaatttatttagggaacaaattaataacttggctaataaagcttatgcagatatctggtggagttatgatttggcggagggtcttttaaaaggtctaccttccaatgagtattaccgggaaattgaaaacaaaattattaaatccttggcagcccggaaaggttttatcgaggttatcgatgaccagggcaatgttatttacagtcaggggctaaagcttgctccggcgtattttaaatatttggtatataagcctgcaatgatgggcagtgtttctggattttatgaaatcgccgaccttttgggaaaaaagcatataacttatctcagggctgagcaggttttaaatgaagaagggaaacctctgggagtaatagttgtcggatacagtttggaggaaaaccaggtcctctttacggagttatttacccaggaattgcagaaacaaaaattattgccgggtgtaatcctgtactggaaaaataagcctttatggcattttggagatgtcagatttgaaccgcttctcggagagcagattaagaaactgcaaaaggagaacatgttgacggaaattcggataattgacggtaaaagattttacgtttcctatctaccgctggaaaaccgcaattcgagtttactaacattgggagtatttttacctgccgatttgttggtcaggccttatagaataagtttttggcaggggttactgatttatatcgtcctgctgggtttactggtggtactggggatttatgtaatcatcggtcgccaattggaaaagcccttaaacgagttaatggaggtacttatcggctggattgaggggaaggatctaaactttacggagtatcaagaaaaatatccggagtataaaaagctttttaagcgaatttacgacttaaaaactaccaaagaaaaaatagccaatcaatggtaccggctggccgaaggagtttataatttaggcgaagcggccaatgacggagatttggtcaaagagctggtttttcatattaaatcactggtagaagtgaagggaataaaaatactcctgaaaaatttgaaaagcgacgaatattttcccctttatacagaagggcaggtggcaaccgggcacccggcgttttgcccggataacggggaatatcaagacggtacttactgttaccccattaccctgggaagcgagaaactggggtttattattattgcggccgataaggataaacttaccgaggaagcacgggaatttttaaacaacttgatcctaatgagcggacctctggtaaagctttaccttttaaaaaattacctggcggaaatttcgctgcgagatccgctaacgcaggcgtttaaccggagatttttggaagatgcgattttggaaaacagggattgcaattattcccttattttcatcgaccttgataagtttaaagaaattaacgatacttacggccataatgctggcgatctggttttaattaagcttacccaaaaaattagggaaaatttaagaagccaggaccaggtaatcaggatgggtggggatgagattttaatttaccttcccaatacccctattgaactcacccgggaaatagccaaccgcataatggaattaattagaaaggaacagtttacggttatgaaagataccaaaacggttaccttcaatgtttcggccagtatgggtatcggaagctgccgggaaggagaaagttttgaggaagttttagcgcgggtggataaagccctttaccgggccaaagaactgggtagaaaccaaattgtggtggccgctgattaagttaatgtatacaagatattttttgaattaaccttgtcataaaattaaatattcattataattttactacaacttaccggcacaacggcgtgtcggaaatgcagggcattggcgccttcctatctctctgtaggtattcttgtgcctatagaggggggaaggctttttaatttatagatgggaggaaatggaaaatggaccggacttttgaacggatcccttccggatgtgccataagcggtatcatgagtgttacgggtaaacgaatttcgggagaaaaaattattgcttcgatttccctgatgcatgaccggagtaacggtttaggaggaggttttgccgcttacggcatttatccggaatttgccgaccattatgcctttcatttaatgtatcagtcggagaggggtagaactttaaccgaggaatttttaaataaacattttatcattgagcgcggggaaccaatcccaacccgtccggttgcgaccattaccgatcctccacttttgtggcggtatttcctaaaggtaccggaagagcgcctttacaaaaaccacgaaccgatggatgaacgggattatgtggtggaaaaggttatgtacattaacgacaacattcccgatagttatgtggcctcttccgggaaaaacatgggtgcttttaaaggagtcggctatcccgaagacattgggcgatttttccgtttggaagagtatgaaggttatttgtggacggctcatggtcgtttcccgaccaataccccaggctggtggggtggagcccatccttttaccctgttagactggtcggtggtgcataatggcgaaatttcttcttatggcataaataagcgttatcttgagatgtttggctataaatgcaccttaatgaccgacaccgaagtggttgcttatgcagtggatttattgcaccgccggcacgatttacctttagaaattgtggctaaagtgttggctgctcccttttggaaagatatagagaagatggaggaagaagatcggaaactttatacggccctacggcaggtgtacggttctgcccttttaaacggaccctttagcatcatcgtagccaacagcaaagtgatgatgggcttaaacgaccggattaagcttcgacccatggtctggggacgacggggtgacttttattacatggcttccgaagaaagtgccatttatgaaattgaaccggctttagacgaagttcatgtgtctaaaggcggtgagccggtaatcgtccggctaaaggagggtgaataaaatggcgaacttaatacctccccgctttaaagtagtaattgattatgaaagatgccggaaatgcaaaagatgtgttataaactgcggttttggcgtatatagttttgctgacagggttattcccgatcataaaaagtgcgtttcctgccagcggtgcgtggctttttgtccggaagaagcgataacgatcattgaaaaccccaatgtttttcggcccaatagctactggacgatggaagaccggattaatattatgaagcaagcttcttccagcggtatgcttttaaccggtatggggaatgaccggccttataaaaattactttgaccatttgttaatcgatgcctgccaggtaacgaacccgtccattgaccctttaagggaaccgatggaacttaccacttaccttggcaaaaagccggatgcggtaaaggttaaggtggaaaacggtaaggtaaaacttgatacccaaattgcgccgcaaataaagctcgatactccgattatcttttctcccatgtcctacggttcgattagtttgaatgcgcacaaagcgttggcccgggcggccaaagagtgcgggattttaatgaataccggtgaaggtggtcttcataaagagctgtatccttataaagactggataatcgtgcaggtggcatccggccgttttggggtaaatcaggagtatctcgaccattcggcggtagttgaaattaaaataggccagggagcaaaaccgggtattggcggacaccttcccggggaaaaggtaaaccgggaagtttcggaaacccggatgatacccgaaggtaccgatgccttaagccccgctccccatcatgatatttactccattgaagatttagcccagcttatctatgccttaaaagaagctacccattacgaaaaaccggtttcggtgaaaattgctgccgtgcataacgtggcggctattgccagcggtattgcccgggccggagccgacattatttatatagacggtttccggggcggcaccggggcagcaccaactgtaatccgggatcatatcggcattccgattgagctggccattgcagcggtggatgaccgcctgagggccgaaggtattagaaacagcgtgtccatagtggcagccggcggcatcaggcattcgggggatgtagcaaaggccattgctctcggagccgatgcggtggcaattggtaccgcggctttaatagccatgggttgccatgtttgccagatgtgtcacaccggtaattgttcctgggggattgccacccagcggccggagttgacccagcggcttgaccccgactgggctgctcagcagttaatcaatctcgtaaaaagctggtccttggagttaaaagaaattttaggagctcttggattaaacgctattgaaagcttgaggggtagccgggagaggttaagaggtatagggcttaccgatactgaactggccattttaggcgtaaaacatgccggaaggtagggtgattgctatggaaataaacgcaaaaggcatgtattaccgggatttaaacaatcttttgagggaaaaagtggccgagggagtaaccgaatttactcttcaggggataaacggccagcggtatctcggaacgggattaaaaggtaaagttaaaatagaagtatatggtactccggggaatgacctgggggcgtttatggatggaccggaaattatagtttacggtaacggtcaggacggtattgccaatacgatgaacgatgggcggattgtggttcacggccatgcgggggacgtcttgggctacggcatgcgagggggagagctttacatccgggactcggtgggttaccgggtgggtattcacatgaaggaatataaaaagcaggtgccggtaatcgttgtaggcggtaccgccggggccttttttggcgaatacatggccggaggaattctggtggtgctgggtttaaataaaaaagagggagagccgctaaccggggactatcttgggaccggaatgcatggaggggttatttatctaagaggagaagtggaaaaagatattttaggaaaagaagtggccgaatttgaattaaccgaggaagattacaaaaggttaaatcccttactggagaattatgcaaattttttcaatgttcccttggacgaaataaaaaaagttccctttaaaaaattggtaccggtttcccatcggccttacggcaaattgtatacttactaaccgcaatgcataactgcttgcggtttttactttttttattataagatattgaaaaaaagctgagggatttgttttggaaaatttgaaggtggttttggggatcagggattatactgagagaaaaaggtttaaggaaatattaagaaccatgggagttttaatagtaggcgagggagaggaaatccgagctctgataaatttatcctcccgggtttgtcccgatttagtaatcttggacgaaaagctggggactaccaaaacccttccctataccaaaatattttatgaaagccggctgtgtccggtaattttgtatgtggagcaactggagtgggaataccttgaagatttcaaaaaaggccctactttaagcctattggtaaagccggtaacggcgttaagcttaatgggagcaatttataccgctttgaccaactttaacacttatttagacctggttgcccagaaagaagagatggaaaaacgtttagaggaaaggcggttaattgatcgggcaaaagcgctactgattcgctgggaaaatttgacggaagatgaggcttaccgttatcttcgggaggaaagccgcaggcagaatatttccatgggcaaggtggccaaaaagattattgaaaagtatacataattcaatttgagaaaatattgtaattgagtaagatattttgtaaaataagtggcgagtttaggttaaaaaagccatagtttggggcgatgaagtcccgcaaggaaaggtttttacctttctttgtggggcttttgtatttttggagggataaactaatggaacatatggagtttctcgaacagttaaatacttatagcataaagtttttacggctgcagtttgtggatgttgccggaaatttaaaaaatgtggcggtaacttcggaaaatgtgggggaagtcttaaaaaaggaaatgacctttatccataatggggagaaggtcttgtttgaaccggatttagaaagtctaacggttttaccctggcggccgcgggaaggggcggtgggaagaatctatggtaatttgctcctcccgaatgatgaacaaaagataatttgcccgcgcaaattttttacccggtttaatttaccccttgaggtagcggtagaattttccttttatcttcaggaaaaagttcaggagaaaacgccggtagatcatgccgggctttgggacgtgtctcctctggatttgggagaaaatttacgccgggatgtggttttaactctggagaaaatgggaataggggttaaatattcgggacatggtgctcatcccggggaacaggtactcgggctaaaaccggttaaggggaacaagcttcccgatattttaaccaccgccaagtttgtggtccgaacaattgccgagcgccacgggcttaacgcttcctttttcccgtaccatcataaaaagcccgggctttcggttaaatacacctttttgggagaaaaagaagagacggaaaagctttatcaaaaaatcgttaccctgttgcccgaggcggaaataattttccggccgttaattaacgattattacggttatccgcaaaaaccggaaaactttattttttatgatggagaccatatagttttgacggtaagtcctaaagccaacccctatttagttttaagtttactggcgatagaaactaatgtaaatgctcaaaatccagttctggccgcggattttgggcaggctttacgccgtttttccgaaagtaccaaattacgggaattttttggtgaactattctggcggtacttaaaaataaagcaaaaaagctatttcgatttttggtcaagggttcatgaggaaggcgataatggagattaataaaaaattttcaataaaactttaaggaggggttacttatgacttttagccttggcttaaatggtaccgaggccaccaggaccaagaggcgaaccggaggggattttagtccctacagcgggatgtgcgttacctgtcttgacgggtgcgtgggctactgcgaaatcgccaaatcggccatccgcggtaaagaggtgatttatccgcagccgttcgggactaccacttccgcctcccagaaggactacccggtcgattattcccactttaatattatgggtacggcggtaggggctgtcggcattgaagctgacccggataaagcgattttcccggcagccaacattgaaaccgctattggagctaataaagacattaagtgtcgcttcccggcggtgattgcgggtatgggttccaccaatgtggccgccaataactgggagcatttagcggcgggagcggcattggcgggagtacccatcgttattggggaaaacgtttgcggcatggatccggatttagaactggaaaatgggcgggtaaaacgttccccggctctggaaaaaagggttaaagcgtttaccgagtggtatcaaggctacggaattgttgccgtccaggcaaacgtggaagatacccgtttaggggttcaggagtatgctatagaaaaacttggcgttgaagcggtagagattaaatggggacagggtgccaaagatattggcggtgaggttaaattaaataccctcgagcgggcactgcagcttaaaagccgtgggtatatcgttctgcctgacccggaagatccggctgttcaggaagcttacaaaaaaggagcttttaaagaatttgaacgccactcccggattggcatggtagatgaggaaagcttccacaagcgggtagaggaattgagaaaagctggggctaaatatatcttcttaaaaaccggtgcatacagaccggcggacttagcccgggcggtgaagtttgcgtccgatgccaggcttgatttattgacggtggacggtgccggcggtggaaccggaatgagcccctggcggatgatgaacgaatggggtattccgactgtttacattcaggctttgcttaccaagtacttagatcgcttagccgaaaaaggagcatacattcctccggtagctattgctggtggcattactttggaggatcaggtgtttaaaggtattgccctttccgcgccccacgtcaaggtagtgggtatggcccggggacctttagccgcggctatggttggtaaaaccgtgggtgagcgggttaaagccggaaaagtacctaccgaataccaaaaatacggtgaatccttggagcaggtgtttatctttgccgaagaactgaaaaataaattaggtgctgatctatttgctaagcttcctgttggagcaattggtgtttactcctattttgaacggatggcccagggattaaagcagttcatgaccggtgcccggaagtttaacttgaacgctattacccgggatgatgtagcggctttaacccgggaagcagcagaaatcaccggcattaagtacatcatggacatcgacgccgaagaggctatgaaaatcttgggctaaatgcctaattcagggacggttctatttacgtttatacgcctaaaaaagaaccgtccctctttttggcggttgtatggatactggatacataaggagtgaataaaaaattttggcaaaaatatgttataataagtgcaaattggggtaaggaggttaaaaatgagtcctaccaaagaagatattttaaaaatagttgaggaaaaaggaatacgctttataaggttgcaatttaccgatatttacgggattcccaaaaatgtggccataactgcggagcagttagagaaagctttggatggggagttaatgtttgatggctcctcgattgatggttttgttcgcattgaagagtcggatatgtacttaaagcccgacccttccacttttatgattttgccctgggcggaccagcggtatgcggaagcgagattaatttgcgatatttatacctatgatggaaagcctttttccggctgtccccggggaaatttaaaaagaatcctccaggaagcaaaacaaatggggattgatgaaatgtacgtggggccggaagcggaatttttcctctttcaaaccaaagaagacggtacgcttactactgttacccatgatgaagccggttattttgacctggctccggtagaccggggagaaaatgcccggcgggatatggtactggctttggaacaaatgggctttgaagtggaagcttcccaccatgaagtggctcccggtcagcacgagatcgactttaaatacgactcggcggtgcgaactgccgataaagttattaccttcaagacggtggtacggaagattgccaaaaaacacgggttacatgctacttttatgccaaagcccgtttacggcattgccggttcgggaatgcatttaaatatttccctggcggctaaaggacaaaatatcttttacgatcccagtaccccccatcagttaagcgatatagcattgtattttatcggtggcttattaaagcatgcccgggcaatttcggccataaccaatcctctggtaaattcatataaacgactggtttccggatttgaagcaccggtctatattgcctggtcgtttagaaacagaagtcctttaatacggattccggctaaaagaggaccctctacccggattgagttgagaagtcctgatccctcggccaatccttacctggcatttgcggtttgcttaaaagcaggtttggacggcattaaaaataaaattatgccacctcctccttgcgaccggaatatttatcatatggatgaagaagaaagaaaagcttggggcattggtaatctacccgccagtttgggcgaagccttaaaggagttggagcaggatgaagtaatccgcgaagctttgggggaacatatttttgagcggtatatggaaggtaagcgcctggaatgggatacttaccgcatgcaggttcatgaatgggaattaaaggaatatttagtgaagtattaaagcgggctaagcccgttttttcttaattttaaaagtctaaaatttcacttatctcaaaaaataaaaatttttgggtaaatttgtgatataatttattatattagagcacaattaacaaacattgttggggggtttagaatgtacgacgtagcaattttaggtggcggccccggtggttatgtggcagcaattagagcagctcaactggggttatcggtagtagtagtggaaaaagatgaactgggtggtacctgtttaaatcgcggctgtattcctaccaaagctcttgtctctacagcagaacggcttcatcaaataaaaaattccgccgcttttgggattgaggttaccggttacaattttaattttcaaaaagctgccgaacggaaaaaccaggtggtagaacgcttggttaaaggaattcactatctttttaagaagagcaaaattaccttgattaaaggaaccggcaaattaaccggtaaaaatgagataacggtcgaaacttctgatggcctggaaaaggttgaagctaaaaatataatcttagccactggctcaaaaccggcattaatttcagctcttggctacgatggggaaagggttattaccagtgatgaagctttaaacctggaaaaacttcccgcggaaatggtcatcattggtggtggggtaattgggtcggaatttgccactattttttccgaaatgggtgttaaagtgaccattgtggaacttttgccatcaatcttggcaaataccgataaagaggtaagccgttatttaaccactttatttaagaaacggggaattcaggttaaaaccaaagtagcggtaaaagaagttaaaaaaggtgaaaaagttacggtggttttagaaaacggcgaggaacttgttaccgacatggtcttaatttccattggccgcgtactaaataccaaagacattggtctggaggaagtgggagtagctctgggtcccaagggagaagttttagtggatgaatatttaagaacaaatgttgaaaacatctatgccattggcgatataaccagtaaaatgcagctggctcatgtggcttcggctcaagggatccgggtggtggaaaatttagtgggtgaaccccaaccaatgagttacgatgtagtccccggttgtatttttactttaccggaaatagccatggtgggtttgaccagccaggaagcggaagaaaaaggaattaaaattattaccggtaaatttcccttccaggcttccgggaaagcggtggcgatggaagaaacggaaggttttgtgaaaattatcgctgacttttatactcaccggatcttaggcggacatatagttggacctcatgcaacggatctaattggcgagatagctttggcggttcagaaaggactgaccctggaggaagttgcccataccattcatgcccatccgagcttacctgaagcggtgatggaagcggcggaagcggctttaaatagagctattcacatttaaagcaggacgggagggcttttatgaaaaaaattacagtcttttggggttgccaaatccccggtcgcctgacttttctggaaaaaagtacccgtttgggacttgccgctttgggatatgaaattaacgatattccggagttcggctgctgtccggaaaaaagtttaataaaaaatgaagatgagaagctctggcttttaactgctgctcgcaacctggctttggcggaaagggaagggtatcctttagtggtagcctgtaacgggtgttcttctaccctgaaaaccgcttatgtaaaattaaaagggaaccccaagcttttagctgaggtaaatgagaagctttgggaattcgggttaaagcttgggggaagtttaaaagtataccacttaattgaatttttagccgatgaggtcggggcgggggtaataaaacagcgggtgcaaaaacctttacgcggtctaaaaataggggtgcatcccggttgtcaccagaaccggccttccccggcggcttcctttgaagatccgttaaatccacgaaaatacgatatcctggtacaagctttaggggccactaccgttgaatatcagtcaaagttaatgtgctgtggcaacaacttaactttagcgggaaaattagacgacggctggcggatggcccgggtgaaaattcaggagcttaccaacctcagagccgatgctttaacggttacttgcccggcatgttttatgcagtttgaccagaagcaggcgctttatgcccggcagggagatattcttaatttaccggttttgacttacatggagctgttagctttagctttagggattgaggcggaagagttaaatttaaaagaacatcgggttgacccatcccccgtcttacgaaaagcaggaataattaacgagccccttccctttaatgaagaagtgctaaaacggtgcttaacctgcggtgcctgtgaatacgattgtccttcagctcgcacgggagtgatgtcgccccagggaataattaagcggtttttaaacggagagattgaagaacttattaattcttcggaaatatgggaatgcgttgaatgccatacctgtttggaatactgtccgcaaagatttggcatggaaaaggtgtttacctggctaaaacaccaggcgatggttagggaaacgtatcctaattccttgaaatcgggttatgaaatgtttgtaaaaaccggcaggctggcgaaaattgatgaccgtcagcgacaaaagctgggacttccttccctttcctcccaggaaccgaggcaatttgtagaaaagctgctgtagcctttgtttttctcgctttttggtgtataattaggaagggcggcatcacgtttttaaggaggaatagttaagtggcgtcattaaaaaaagttgtggtggctgtaccttcaaatcttttggaagaagttgataaaactgcggcgttggagaaaatcagtcgaagtgaagttgtccgtcaagctttaaagttatatttggatgaaaaaaaacgtaaaatgttaagggaagagatgattaagggctataaggaaatggccaagatcaacctgaacttagctttagaaggtttttattacgaagcggacggttatatggaggttaaataatggagatcagacggggagatattttttacgcgaatttaagccccgtagttggttcggaacagggcggtacccgtccggtgttaattttgcaaaatgatatcggcaatttgtacagcccaactaccattattgccgcaataacttcccaaattaacaaagccaagctgccaacccatgtagaaatctcggcggaggaatccgggttggaaaaagattcggtaatattactggagcagattcgcaccatagacaaaagccgtcttaaagaaaaggtttcttcattaaataaggaattaatgcggaaggtcaatcaagcactggaaataagcctcggactggtggaaatttagcctttttccggggctttatttttttagggagggggccccatgtatataggaattcctgtctggccggaggacggtttttataaaatccgccagagttacgtgcaaaaaatactaaaaacaggggctaaaccattttttattctcccggagcacgatttagccggggtatttaagataataacgggagttttaattcccggaggtggggatatcgctccggaattgtttggtgaagaaccgcggccggaaattcgaagttacagcaggcaaaaagacttatttgaaattaaccttattaaagaagcacacaaacacgcgttaccgattttaggaatatgtcggggcatgcagttaatcggggtagcttttggggccggtatgtatcaggacctttttacggaaagaaaaggagttttggcccatgagcaaaaagccccgccgcaagagccaacccacctgataactttaagccccgagggacgtttaagggaaatttttggcgccgcaagggtgcgggtaaatagctttcaccaccaggcattaaaaaatgccgggacggttcttagcgttgaagcggttgcggaagatggggttattgaagcaattagtggaccgaaaattttaggagtgcagtggcatccggagcttttagaaagtcatgatggtttatttttctggcttataaaggaaggaggagctaaatgaaggttttaaaaaatggggttatcgttttggcttccggtgaacagcttaaaggagaccttttaattgatgacgaaggaaaaattgttaaaatcggtgaagaaatttttatcgatggaggggaagtaatagaccttaaagggcagtacgtttacccaggtttaattgatgctcatacccatatagggttaatggaagaaggaatagattttgtgggggaagatatcaatgaatattatgacccggtgactccccaggcgcgggccattgatggtatttacccttttgatgtagcttttcgcgaagcgtatcaagagggggttttagccgtcggggttttgccgggtagcagtaatcctgtggggggtaccggttatgccctttctacccggggaaagaccgttgaccggatggcttttggaccatgcgggctgaagattgcctttggggaaaaccctaaaaaaaattacgcaggccagaaacgtttacccgccacccggatgggtacggcaatgctgattcgggaaaacctgctttacgcccgggagtatttaaggaaaaaagaaaagggggaaaaggtggagtttgatttaaaaaaggaagcgtttattccggtgctgaaaagggaaattcctttaagggcccatgcccaccgggcggacgatataatgacggcaatccgcatagcccgggaagttgaagtagacgtagtgatcgaacactgcaccgaaggtcatttaattattgaggagcttaaagaagcccgggtgccggtggtggtagggcctaccttaaccggtcgttcaaaatacgaattaagggagcttggctgggaaactccggtaaacctaataaaagctggagtaaaaacggcaataatgaccgatcatccggttatccccttaaaatacctgcgtttactgggttttcttttacaaaattacggactgacggagaaggagattttgccgttatttaccaaaaatcctgccgaaattttgcagattaactcctttgttggcgatataaaaccgaatttgtgggccaatttaatcgtgacggaaaagccgctttttgcactgggaaaaatatcgatggtattttttaagggtgaaaaaatcgtcggataaggtagaaagaaaacgacaagttttttaccagaggaaaaggattttttatatctttgacgaaaaaagtatatggtaataaatggggatggggggaaacccgtggatatcatgcaggttttggttgccgatgaccagccagggatcagaatgcttttaaaaattattttggagcagatgggctttggggtacatgaagcaaaaaacggccaggaagcagtggaaaaagctctaaatattcgaccgggtctaattattatggatatgcgcatgccctataaaagcggtgatgaagccattgcggaaattcactcttttcttccgcagacagattttattgtaatgactgcttatacagctcccgaagtgttggaaaggattgatagaaaaaaagtttttgaggttgttgccaaaccttttgatgttgaggagtttaagatgatacttaataaatacctcaaagaaaaatttccctggaaatattcttttgtgtagaaatctttctaaatttaatttaaaatgaaggaacagggggagtggtgttatgggagatattaaatgcgcgaactgtgagctttgcggtcgggaggtaccagcggatttaatgtgtactttgatcttaaccgatgaaaacaaggtggaagaagcctgctggtgcatctgtcccgagtgccgggaaaaatttaaaaagaatattgcggaagtttataaagcgcttttggagaaataaaaccgggtttagttcccggtttttttgttgtttggttgatttaccagaatataaaagctataatgtttttgaattctctgcaaaaggaatggggtttaatggttgagcttataagcaagacaccggaaaaaaccaaaaatcttggagaatatatcgggaaaaatcttcctccgggaagcataataattttaagcggtaatttgggagcgggtaagacccttttggtatcagggattgtggcaggacttgggataaaagccagggtaaaaagcccaacttttaaccttgttcacacttacccgggagaaaaaggtaacgttaatcattttgatttgtaccgaatttctgcccaagaattttttgctctgggtatggatgaatatttcaccgattatgatattaatcttttggaatggggagaaaaaatagaagaggagttaaagaaagattatttaaaaattaccatggaaaatatcgcagaaggagagcggaaaatcaaaattgaggcttttggcgaaaagtttaacgaattaatggaggcgctaataaaatggagttagccgtagttgctgctaccagaagtatttccctggctttacgaaaaaatgatgagattatttttgaaataaatgaccggttaaaggaaccccatgcggcaggtttaatgcccttaattgattttgcgttaaaaagggtttcggctaaacctcaagatttaaccgccatttacaccgttctgggacctggttcctttaccagtttaagaattaatcttgctaccactcttggattggctcaagctcttggtattcccgtttatgctaccgatactttacgcttaattgcggccaatgccggagcttaccggggggaagttatggttttaatggaagtaaaccgggaagaagtatattttggacttttttacaatgattttgtgcccaaaccactggagcagcttaaagttatcaccttaaaagaagcccaggagaaagtttacaattttaccggattgttaatcggcgatggagtggaaaagttaggagagattccagaaaatttaatctatctgaaaaaggcaagcgaaccaatagccagcaatttattttttctggatttagagttagtaaatatcttagaggtaaaaccgctctatttaagaaaatctcaagcggaaatcgtgcgggaggcaaggtgagtttaaaattggagttaaaacttatggaattaaaagacctccctcaggtgttagatattgaaaaactgtcttatacaaatccctggagtaaggcaagtttcatgtacgaaataaccgaaaatccgttagcaacttatctggtagctcgtgagggggataaagtaatagggtacgggggtatctggattgtattggatgaagctcatataactactttagctgtccatccggcttaccgcagaaacggggtaggaaaaagtttattaaatgcgttacttgatgtggctaaaaatagaaaggtgagaagtattattttagaagttcgcgcttcaaattttccggcacagaacttataccagaagttcggttttaaaccaataggaattagaaaaaaatattattcccgtcctgaagaagatgccattgtaatgagccttgagttaaaggaggattattaattgggtaaggttatcttaggcattgaaacatcctgcgatgagacggcagtttccttagtggaagatggtagaaaggtgttaatttctttactttcttctcaggttgatcttcaccggctgtacggtggtgtagtacccgaaatagcatcccgcaggcatttagaactgatttttcccctgttagatgaagcctttcggaaattccccagggaaaagatagctgcggtagcggttacgtacggtcccgggcttgtaggagctttactggttggcctttcggtagccaaaagtttaagctatgccttaaacgttccgttaattggagttaatcacatggaagggcatatttttgccaattttcttgaagatgcaaatccggtttttccggcactggtgctggtggtttcggggggacataccgatttaattttcatgcggggcttcggggattacgagcttttgggggaaaccattgacgatgctgccggggagtgttttgataaagtgggccgggtattaaacttaccctatcccgcggggccggttattgaccggttgagtaaaaagggaaaacccatttataagtttccggtagctcgtttaaaagaggaaggatataactttagctttagcggtttaaaaactgcggtaagagttttccgggaaaaaaatcccgaggctaaagttgaagacattgccgcgtcttttcaggaagctctggtcagagctttggtggaaaataccgaaaaagctttaaaagaatgcatgccggctaagctttacttagccggtggcgttgcggctaactcaaggttgagagaagagtttttaaatcttggtaaaacctataatgttccggtacattttccttcccttcagtactgtaccgataatgcggcaatgattgctgccgccggttatcaccgctatctttcggggaagtatgcaccgcttaatttaaacgcctacccttcgctgatgctcggggaggaaagatattaatcctgtggaaaactacctgtggataatgtggataactttgttgataacttgagattaaagggtttgtcctgttgataacttttaaaaatttgtcaaagtactccggtatttgttcataagatgtcgcatgagctcggcgtttgacggcggagtgtaagtgatggcgttagctccggcttcaatggtttttaaaattgagtcgttgtttgggccaccggtggcaatgatgggaacctggggatagttttttctaatttcccgtaccacttgcggggtgctgggaccggcggaaacatttaaaatatcggctccattggctaaacgtgcttcaatattttcttcctgagaaattaccgtaacgattatcggaatacttaccgtttgcctaaccatttttaaagaatgattatcgatggggctgtttaaaacaactcctaaagctccctgaaattcggcatcgagggccaagttaaccacccttcgcccgcgggtggtaccgcctccaacccctatgaaaaccggctgatcggcagcactaataattgcatgggtgattatcggctgggccgtaaaagggtagacggccatgatggcgtcagcgttgttgttccggattaatacgaggtcggtagtaaagatgatggattgaatatgttttcccaggatatcaatcccggaagcttctttaattacttccggcatttttattatattgccccttaaaacggaagtaactgcaggaataattctatccaaagtaatcgctcccataattttttatttttagttttacaaatttattatagcgttaatgaaaaatctgtaaagaagcctggtgggaatctatggaaaagtatttggctgatgcggtaaaaagaaacgtgctaccaattacttctcgctgtaatgtccgctgccttttctgcagtcataccggaaacccgttggaagttaataccgtatcctttccccacctacctttcgcaaaaattaaagaattccttccttttttagatccggagaagaaaattgttttaggagagtcggctacaattataaacgaaggagaacctttatttcatccggattttaaaaaaatattgcttaaaatacgggaattatttccgaaaactcctctttccattaccaccaatggccttcttttaacccgggaaatggtggactttttaacttctctgggggaagttgagctggtaatttcggtaaatgcgctaactcctgccaaaagaaaattaattttcggtttttattcggatatttatcctaacctttactatctgtcaggaaaaataccttttacagcaagttttgtttttatgccccacgtggtgggttatgaggaatacgttttgagtattaaaaaattaatgcagttgggggtagaggcggtaagggttttccttccgggttttacgaaaaaaaataaacaattaattaatgctcctcgggatttagagaaactttcgcaaaaacttttcacagagtttttggaggaaaaaacaccggtgattattgaaccaaaacgtttaacggattttagagccgaggttttaggggtaacccccggcggtatggcctattttttaaagaaaaaagatattattttaaaaataaatggccaaaccccttttagccggatggaagcccataaacttttaaatacccccggagataagactgtagaaataagacggcaaggggaaattatgacctttaatttttcgttaaaacccggccaaaaagcaggagcggttttttaccgggatattgaaaaagaaaggctcttagggataattaacaaggtaaaaaaagctttagctaaatccccccttattttaacttcttattttgccactaccttaatcaagaaggggttacaaaagcttggagccaattacttggtcttaccggttaaaaaccggttttttggcggaaatattggctgtgccggtcttttaacggtagaagattacctgtgggcggtaacaaaggtgcttaaagtgcgaaaaccggattatctccttttacccggtatttcttttgacgaccggggccgggatttaaccggtagaagttatctcgaaattgaagattactttaaaattaagacggaaattttctaaaaaagttttaagctaaaaggaaaaatttttgttttgttgaatatataaaaaaattttatctatttgaaggggggtaacctggaaaatgtttcgcaatcgggaagaaattaaagaaatacagcttcaccgcttgaaagacttagtgaaaaggttgtacgaacgggtgcctttttaccggcagaaattagatgccattggttttacaccggacaaactaaaatccttggaagatcttcggcatcttccttttactaccaaacaggacctgcgggataactacccctttggcctttttgcggtaagccaggaagaaattgtgagaattcatgcttcttccggtaccaccggcaaacccacggtggtgggttataccagaaatgatattgacctctggagtgaattaatggcaaggtcaatgagaaatgccggggtaacttcccgcgatatcattcacaatgcttatggctacgggctttttaccggggggctgggttttcattacggcgctgaaaaattaggggcaacggtggtgccggtttccgggggtaacagcaaacggcagttaatgctgatggaagattttggagctacagtcttaacctgtaccccttcttatgctttgcatttggccgaagaaatggaagagcagggcatttcccgggacaggttaaaattgcgactggggatttttggtgccgagccctggagtgaagaattaaggaccaaaattgaagaaaagttgaaaataaaagccattgacgtttacggcttaagtgaaatcctgggaccgggagtagcaatggagtgtcaggaacaaaaaggcttgcacattaatgaagaccatttccttccggaaatcattgacccggataccggtgaggtattgccgtacggggaaaaaggggagctggtaataaccaccctgaccaaggaaggaattccccttttaaggtaccgcaccagggatattaccgccctttatccggaaccgtgtgcctgcgggaacggcttaattagaatggaccgggtaaccggcagaagcgatgatatgttgattattcgcggggttaacgtctttccttcccaaattgaaacggtgcttttatctctgggttataccgagccccactacatgattgtggtggataaaaaaggagccttggaccagttagaagtttgggtggaactgtcggaacagttcttttccgatgaaataaagaagcttgaacaatgggaaaagaaagtggaaggagaacttttcacggtcctggggattaatgctaaagtgcggttagtggagccccgcagtattccgcgcagtgaaggtaaggccaagcggatttgggatagaagagagttaaaataaaaggagggagttagatgattgttaagcagctgtcggtttttttggaaaacaaatcgggaagacttgcccgggtgaccgagattttaggggaaaataacatcaatattcgggctttatccattgccgatactaccgattttggtattttaaggcttattgtgaacaagcccaatgaagcttataagctgttaaaagaagaacagtttatggtaagtttaaccgatgttattgctgtggaagtgcccgataagcccgggggactggccggggttttaaaaattttagagccctacaacatcaacatcgaatacttatatgcttttgtggagaaatcttctaataatgccctggtggtttttcgggtagaagagcttgaaaaagcaattaaaattttaaccgataatggagtcaaagtgctggcgggtaacgaggtttatagtttgtaaccggcaaattttgccggtttttttgttaatttagttttaaaaatgattaaaaatagcaggaatattaacgaataaagagaatacttaaacagttagtctatttttgaaaaatctgaaaataaggaagatcatggatggatgataaaaaagtattgagaaaggaaatattaaacaaaagagccgcccaaactcccgctgaaatagctgcaaaaagttccagaattttaacacttttaaaagcctttgcgccctatcaacaggcgcggacggtaatggtttacctggattttcgcggggaggttaaaacccgggaaattatcagggacttatgggcttacggtaaaaaagtggtaataccggtgacagttctttcggaaaaaaagcttttaccggtttaccttagagattttggggacctggtagaaggaacttacggaatcctggagcctaaagaggaagcaagaacgattgcggaaccggaagtaattgatttggtcctggtaccgggagtagcttttgatttaaagggaaaccgcctgggatacggagccggtttttacgaccgatttttacccaatcttcagcccgcggtaaaaaaggtggctttagccttcgaactacaaatagtacccaaaattccaaccggaccccacgatatcccaatggattatatcataaccgaagagcgcattataaactgccgcctttattaaaaagtttataaaggtttatttattaatgttttctccaacttctaacatctaacttccaatatctaagttgtttttatcaaaaggttataaaaggttattaaggtttattatttaatgttttttccaacatccaatctctaacttccaacatctaattagggggtgtattttctttggtttgtgcctgcgggaaggaagtagttgatccaaaaaaagaaaaactaaaagaactgctatctcagtatcaagggcaaaaaggggctctgattccggttttacagggtgctcaggaaatttatggctatcttcccagagaggttatggaagaaataagtcgtagccttaaaattccttttagcaaggtttatggagtggcaaccttctatgctcagtttcatctaaagcctcgcggacgcaatgtgattcgcgcctgtctggggactgcctgtcatgtacgcggtggagcgaaagtatttgagaccctaaagaatgaactgggaattggtgatggggagacgactcccgatttacggtttaccctggaatcggtagcctgcattggagcctgcgggttagctccggtaattatggtcaacaatgatacttacggccggcttaccccggataaggtaaaagaaattcttgccaagtacgaatagggggtgccttatgagaaaggttttgatttgtgcggggactggttgcatttcgtccggttcacctaaagttaccgaaaagtttcgggaagaactatcaaaaagaggtattaccgatatagaggtttacaataccggctgtcacggtttttgcgaacagggaccaattgtgatcattgagcccgataaaactttttactgccgggtagaggtggacgatgtaccggaaattattgaaaagcaccttttaggtggacaaattgtggaaaaagttttattccacgaaccccaggtagacaaaaaggtggaaaagtacaccgatatctctttttatgctaaacaaaagcggctggtcctccataactgcgggcatattaacccggaacggattgaagattatgtagcaaatggtggttatgaagccttaagaaaggtacttacttccatgtcgccgcaggaagtggttgatgaaattaaaaaatccggcttacgcggacggggtggcggcggttttcctaccggtttgaagtggcagtttaccagggatgccaaaggggataaaaaatatgtggtgtgtaacgccgacgaaggcgacccgggagcttttatggaccggtccgtgttagaaggagatccccacgcggttttagaagggatggccatttgcggctatgcggtgggggctgacgaaggttatatctacgtgcgggctgagtaccctctggccataaaacgcttgcaaattgccataaaacaggcggaagaaaagggttatttaggagaaaatatctttggtagcggctttaatttccggataaaaattaaagctggtgcgggagcttttgtttgcggtgaagaaaccgcccttttgacttccattgaaggaaatagaggaatgccaagaccgcggccgccttttccggcggtaaaaggcctctggggtaagcccaccaatatcaataacgtcgaaacatttgccaacgtgcccttaatcatcaaaaacggcgccgactggtatgcctccatgggtaccgaaggaagtaaaggaacaaagatttttgctttaaccggtaaggttaataataccggtctggtggaagtaccgatgggcattaccatgcgccagataatttttgatattggcggtggcattaagggaggtcggaagtttaaagcggtacaaattgggggtccatcaggtgggtgcttgccggaagaacttttagacttaccggtagattatgattcgttaattaaagccggggcgatgatgggttccggcgggcttgtggtaatggacgaaactacctgcatggtggacgtggccaagtttttcttaagatttacccaaaaggaatcgtgcgggaaatgcgttccctgccgggaaggaactaaacggatgttagaaatcttagaaaaaatcaccgaagggaaaggcgaacccggggatcttgaaaccttagaaaaacttgcctataacattaagaactccagcctttgcggtctgggccaaacggcacccaatccggttttatcaacattgaggtatttccggcatgagtacgaggctcatatttacgataaaaagtgtccggccggcgtttgcgcggcgctcttagaatataagatccttgaagataaatgtgtcggttgcggcgcctgtgcccgggtttgccccgtgggagcaatctccggcgaaagaaaacagccgcaccagattgaccctgaaaagtgcattaagtgcggttcgtgtatggaaaaatgtaagtttggcgcaatagttaaaggttaaaggggggatacggatggcagacgttactttaaaaataaacggtatagaagtgacggtgcccgaaggcacgacgattttggaagcggctcaaattgctggctttaagattccaaccctctgctacgacccagagctttctaaacccggagcttgcaggatatgtgtggtcgaggttaagggagcgagaaacttagttgcttcctgtgtcactccggtggctccgggaatggaggttttaacccattcggagccggtaatcaatgcccggagggaaattttggaccttcttttaagcaatcatccggaagactgcttgacttgtgataaaatgggagaatgtgcccttgccgattatgcttatgagtacggggtgcgccggggaagttatcagggagaaaaaaatgtctaccccattgaagacaacaacccgtttattgttcgggacatgaacaaatgtattctttgtggcaaatgcgtccgggtttgcgacgagattgttggttattcggtaatagactttattaaccggggctttaaaaccaaagtggcaccgccgtatgacgggactttggcggagtccaactgtgtcttttgcggaagctgcgttaccgtttgtcctaccggagctttgacggtcaaagatacccgggggaaatttagaccctgggaggtaaaacgggtaaaaaccacctgtccctactgcggggttggctgtaactttgaccttctggtaaaagatgataaggtggtaggagtagctccgaatcctacctccgaagtaaatggccggtttatgtgcgttaagggacgttttgggtacaagtttatccatagcgatgaccggctgaccaaaccgctaattaagaaaaatggcgagctgacagaagcttcctgggatgaagcattaactttggtagcggaaaaactcggggagataaaagccaaatacggtagtgattcgattggggttctggcttcggccaagtgtactaacgaggaaaattatcttttaagcaaatttacccgggcggtgcttggtaccaataatattgaccactgtgcccggctctgacactcgccttcggtggcaggtcttgccgccgcttttggcagtggtgccatgaccaatagctttgaagacataatggaaacggaattaattatgttaattggttccaatactaccgaatcccatcctgtagccggttacaaaattaagcaggcggtgaagaaaggagccaaactcatagtcattgaccccagaaatattgagctggcaagttatgcggatcttcacctccagttaaagccgggaacgaatctgcctttgttaaatgctatggcccatgtgataattgaggagggactgtacaacgaacaatttatccgggagcgtaccgaaggctttgactcgtataaggatacggttaaagattattcaccggaagcggtagcagaaatttgtggcgttcccgccgaaaaaatccgggaagcggcccggatgtatgccaaggccggaaaagccatgattttatacaccatgggggttacccagtttagcttcggtacctacggagtactggcggtggccaatttagccatgcttaccggtcatgtaggtaaggatggtgccggggtaaacccgcttaggggtcaaaataatgttcagggcgcctgcgatatgggcggccttcccaacgtttttacgggatatcagcgggtagatgatccggccgccaacgaaaaattctccaaagcctggggcgttaagcttccggaaaagccgggattaaccctgggggaaatgtttgatggggcgttaaagggcaatattaaagccatgtatattatgggtgaaaacccggttttatccgatcccgatgcccggcacatcgaagaagctttaaagaagcttgatttcctggtggtgcaggatattttcttaaccgaaacggcaaaatttgccgatgtagtattgccggcagcaacctttgccgaaaaagatggtacctttaccaataccgaacgtcgggtacaaagggtaaggaaagcaattccctgtgtaggggaagccaaacccgactgggagattattgcactggtggccaccaaaatgggttatccgatgagttattcttcggcggaagaaatctttgacgaaatgcggacccttactcccagctatgcggggattacctatgaacgcctggagaaaaagagcctccagtggccgtgtccagctcccgaccatccggggaccaagtttctccacagcgataaatttgtgcgcggcaaaggcctgttccacccgattccgttcaaggaaccggaggaaaaaccggacagcgagtatccctttactttaattaccggccgccggctttaccactaccataccggaacgatgagccgccggtccatgatgggcgaacatgtaccggaagatcatttagaaatgaaccccgccgatgctaagaaacttaatataaaagatggagatagggtaagggtaaccactcgccggggaagtgtggaaattaaggtagcgctaaccgataaggtaccggaaggaaccgtctttgcttccttccacttctttgaaagtccggtcaaccaggttaccaatccggcccgggacccaatggctaaaacgccggaactaaaatattctgcagccaaaattgagaaactttaagggacggttctgtaaaccaccattttacaatgaatagaatgtggtggctgtaagaaccgtccctggaggaggaggtataaggatgccgattattcaaattgaacttttagaaggaagaactgttgagcaaaaacgggaactggtgaaaagaattaccgaggtaactgttgatgttgtaaaatgtccaccggaagcggtgaaaattatcatcagggaaatgaaaccggaaaattacggtgatggtggagtgttacgggcagataaaaaatagagaaaaaaggcggctttaaaaggccgtcttttttcttggaataaaaatctaaaaattttgaaaaataattgcaggaattggcaaaaagatttagaaatatatacttagtacaaacttttggaggtgataatttgcgtgagattttagttgatttagaaaaatgccttggttgtaaaacctgtgaactggtttgtgctacctcccattctaagactaaagagctatatacagcaatctcagaaaatccccgaccgcaaagacggatttttgttgaggccaatggttccaccaatttccctttgatgtgccggcattgtgaagacgctccctgtgttaccgcttgcatgagcggagctttaaccaaagatgaactaaccggtgaagtgctgttaaactcccaaaggtgtattggctgttttatgtgcgtgatggtttgtcctttcggagtaattatcgaaaaccagcataaagccgcgaaatgtgaccgctgtgctgaaattggctatccccagtgcgttttagcctgtcccaccaaagccctgtcctttgcagaagttcccgtttatgccaaaaaggaacgaaagaaatacttaacaaattttttgatgaaggagtgattttatggataaaagcaaattatcggtagacccggtaattcccaatctttatcggaaagcccgggaagaagggatttccaccgtttttgaccggtatgaagcgcagcagcctcagtgcggttttggcttaacaggcctttgctgtcgtcactgcgtccagggaccgtgccggatcgacccctttggggaaggaccgcaagcgggaatttgcggggcaacggccgaagtaataacggcaagaaatctactgcgtcaggtaactgccggtgctgccgctcatgtggaccatgcctatgatgttctggaagttttggaacaaattgcccaaggtacggaaagctacagtattaaggatcaggaaaaattaaagcaggtagcttttaccttaggtatagatacagctaataaaacagagcaggaaattgttgaagaaatgtgccaaattatctaccgggattttgccaattccggcgcaactcccatgacctacctgaaagccaattctccgcgggagcgcctcgaaacctgggaaaagttaggagtactgccgcgaaacccggacagggaaattagagaagctctgcaccagactacaatggggatggatgcggacccggtaaatttaatcttaaagactatccggcttggtctggtggatggttttgcgggactcaagctggccacggacttacaggacataatatttggaactccccagccggtggtaacagaagccaacctgggtgtacttaaagaagactacgtcaatatcattgtccatggccacgtacctttgctttcggaaaaaattgttgagtggagcagaaaattggaagatgaggcgaaaaaggcaggggcaaaaggaatcaatcttgccgggatatgttgtaccggtaatgaagtgttaatgcggcaaggggttcctctggcgactaacttcctggcccaggaattggcgattattaccggcgctgtggatttaatggtagtggatgttcagtgcattatgccgtctttagcggaaattgctgcttgctaccatacccgcctggtcactaccatgcctattgtcaaaattcccggagcggaacacgtaccttttaccaccgaaactgccgatgaagcctcccagcagattgtccggatggctattgaaagttaccaaaaaagaaatccagccaaggtctatattcccagggaaaaagccaaagtagtagcaggatttagcgtggaagcaatagtaaaagctttagcgaaactaaatcctgatgacccgttaaagcccttaattgacaatattgtttctggcaatattctgggggtagtggctaccgtaggttgtaataacgtcaaagtaaaacacgattggtttcatatagaactggtaaaagaattaattaaaaacaacgttttagtagttactaccggctgttccgctcatgccttagccaaagcaggattgatggatcccgcagcagccgaatgggctggcgaagggttaagagctgtcttaacggcaataggtacggccaatgatttgggaggaccgctgcctccggttttgcacatgggaagctgtgtggataattcccgaatcggggatttagtcatagccgtagccaattaccttaaagttagtcccaaagacctgccaattgctgcttctgccccggaataccagcatgaaaaagctttgagcattggaacctgggcggtggcgatgggaataatgacccacctgggagttgttccaccggttgttggaagttccaaagttacccggattttaacccaggacgccgaagctttaattggcggtaagttttacgtggaaacggatccttataaagcagcagccggtattattgaacatattaaagctaaacgggctttgttaaacctttagggggttaaccttaatgaaatacttaattattggaaacagtgctgcaggaatttttgcggcagaaagtttaagaaagttggacccagcgggcgaaatcaccgttttaaccgatgagccgtacgaggtttacgggcgctgtttaacatcttactttattgccggggacatagttgaggagcaaatctttatccgtcccaaggatttttacgaaaaaaaccggataaatcttaaaaaaggtgaaaaagtagtaagaattgattttaatgaaaaaaaagtcataactttcaaaaattcttaccaatatgaccggcttttaattgcgagcggtgcaagggccaaaaagctttcgctcccgggaagtaatttacccggagttttcaccttacgaaccctggatgatgccaaaaatatcctggattattcccgcaaagctgaacaagctgttatagtggggggaggactggttagcttaaaaggggcttacggtttattaaagagaggggttaaagttaccgttgtggtggcctcccgccagattttatcccaggttctggattacgaagcggccgggttggtgcagcaaaacttagaaaaacaggggatgaaatttcttttaggggaagatgttttggagtttttaggagaagacaaaattttcgaagtaaaacttactaacggacaggttataaaagctgatttagttttaattggtaaaggtgttacccccaatgtcgattttttaccggaaccggagaaatttttggaaggtataccggtggaccagtatttaaggactccctgggagggtgtttgggcagcgggggatgtggcgaaaacttttgatgttgctcatggtaaatacagagttaatgctctctggccaattgccgccgagcagggaagggtggcagcaatgaatatggtcggacaaaattatgtgtatcaaggttccataggcatgaattccctggagttttttgggtacaataccattgcagcgggaattacccggcaggaagaaggttatacggttatcaaacgaagacagggagccaactatttaaagctcgtattggagggcgaaaaactaaaagggtacattttaagcggggaggtgcggggagccggaaaacttacccagcttatccgttccggtagcaaaataaagcaatttccctcctttttaaaaatattttaaaaacaataaatttctggtaaaatgtagataaaaatcaaaggagggaagataatgaaccaaaaaaccttagaaaatttaatggccgcttttgccggagaatcccaggccaaccgcaagtacttagcttttgccaaaaaagctgaagaagaaggttatcctaatattgccaagctttttagaagtgcggcggaagccgaaaccattcatgctttaaagcaccttgaagttgccggtaaaattggttctaccctggagaacctgaaagcagcggtagccggtgaaacttacgagtttaccgaaatgtacccggagtttattaaagaagctgaagctgccggagaaaataatgccgccagaagctttacctttgcttccagggcagaagaggtccatgcccggctgtaccaggaagctttaaaggcgttagaagaaggcaaagatttggagggcgaattctacatatgccccgtttgtggcaatattgaaaaagcaagacccgaacgctgcccaatttgcggtgtagctggcgagcggtttttccaggtttaacttaaatgcctttgggggagggcagttttcctccctcaaaggctgtttcaatatatgccaaaatactttttttatttgctgggaaaattaaatttagaaaaaaaatgattgacaaaaattagttttagaagtattatttttaaagatataaaaatactataaaaaagtttcgcaaaaacttaaaaaagagtaaaggagtgatagttgatggcctttttacaggaaaaggatatccagtttcttaaagaaaaatttgccaaagaaatggtcaatgatgtgaccattcacttttttaccaaaagcccggtattagcccaggattgtccttactgtgaccataccaagcagcttttagaagagttagcagctaccagtgaaaaaataaagctcatggttcacacttatcccaccgaaaaagaagctgtggaaaaatacgggattgataagattccggcaatcgtcttcgaaggtacggaagatgtgggtattcgtttttatggaataccgtccggttatgaattttctaccgttatcgagacaattattgatctctctaaaggaaaaccggagttgccggataacgttttggcagaactggccaaggtaacttcaccggttaccattaaagtttttgtcacccctacctgaccgtactgcccacgggctgcagttgcagccaaccggtttgcgatggctaatgccaatattcgcgccgaagttatcgaagttagcgagtttccggaattaggggataaatacaacgtctttggagttcccaagtcggtaattaacgaaacggtagaaattgaaggagcagcaccggaaacgatgtttgtgcaaaaagtgctggaggcggtccagtagaaaagctgcgggcaaacccgcagctttttgtatattaaaccactgccttgccaaaatattaataaatccgctgccggaggcaaggtgatggtggaaaaagctttaaagattatttcacccctgcaggggtttttggataatgttgaaccaactcacggttttctcctgaataaagcgctaattcaattacaggaaaaaaactataagacaagttattatgagagatactaccggcaaatttactgcggcttatatgcagcggataaaggctggcaaaatgttacccattattttaatccccggaccaagaaaggtttgtttatttttttatcggccaaggaagctttttaccaggagttaaaaaactttcataaattttccgaacaaaaaaaccccaaagctttctggcatttcggccgggcggcacatatcttgcaggatctttgtgaaccgcatcatttaaaacctacctttttaaacggccacaaaaagtttgaacgctgggtgggagataatataaagataataataaggaaactttatttgcctccggccctgcggccgtggcttaccctggagatagaatcctttagcagtaagatcttggattactacgaattagtaggagaaaaggctggagacattagttacttccgtgctgctcaagaattgctggcggctgcggttaagcttaccatggatttgtttttggagaatgaaatttattttaggaaattttggtactaaaattcattgtttctacataacattttattgggggcacaaaagacttaaaaattaaaatttagcaaggtttaataagatgcggctgggcaaggagacttgcccccgttttttgtttttttggtataatggaagaaaaaacggtgagggcaatggaatttgttactattgaacattattctgaagaaaggtttaccgaaagaaagtcgttatttattggccgggctctcccggtaaactccgaagatgaagcaagaaagtttattgaagaaataaaagaaaaacataacgacgcaacccataacgtttatgcttatactattgaaaacaggattacccggatgagtgacgatggtgagccttccggtaccgccggacgacccgttttagaagcaatcatgcagaaaaagcttaccaatgtgtgtgtagtggtaacgcggtactttgggggaattcttttaggagctggaggcttaattcgggcttatcggaaagctgccgagctttgcttaaataaagccaccattatcactatcaaaaaaatcccggtttatgcggttaccgtgagttacgaacactggtcgcggattttaaagcttgccaataatttaggtttaccccaaaaagagccggtatatcttcaggaagttaccgggtattttggagttatacctgaactggaagaaaagtttttgcaggaagtaattgatttatcgtttggacaggccaaaatccaaaaagaagaggaaatgcttgtaaagtataaagaaggaaggtatttgcccgtttaggggggagaagatgaaagtatttgtgtatggcacgttgatgcaaaaccacagggcgaacttcctgctttcccggcaaaagtacataggtcctggtgagatctatggtttttcgctgtataaagtgtctaactggtacccgggagtggttccgcgggagggagacagggtgaaaggggaaatttatgaattaatccatgaagcggaaaagaccttgaccaggctcgatgattatgaaggagaaggaagtttgtatcaaaggattttaacaaaagccgttgaccagaaaggcgaagaacacgaagtctttgtttatgtttataacggtaccgtggatgaggaaaaatatataccctatgaacagcagccctggcggggttaaaaacaaaaaaagccctaaaaggctatcgtttgggttgtggggtttttaaggtttactcttaccttttagggccatacttaagatttcgacaaaaaaagcaaaaacccttttattttaaagcttgatagtaaattttttttctaaaaataatttttttatttttcttcttttaattaattcctttaaaacttcctggacaagacggggagaaatattaaagtggatggcaatatcggctttagtttgcggtagcataagaaggtgaagaactgctttttttagataagcttgccgagttgtaatatcgataaaattaggatttgtattcaggtggtataagtatggacatagccttccttgggtaattcaaaccattccgttggttttccgcaatgcatacagtgggctcggggagtgccgtacttagccaccacagttcacgcgccacatcatcccagaacttttccgggttatcccaggatagttttaaaagttcgttgaatttttcaatactgcccgctaccgatttttttactttttccggattgggataaaaaatcttactttctgttaaaatgcagagttgaaatgctaaaatctgctttttattggtcagaaaaatggtggtctgttagattatcttgacaatttatagttatttagataaattaaaaataacaaaaaacctcaggggtgccggatgagcccggctgagaaggcttcgcgatgaagaagtctaccctttgaacctgctctgggtaatgccagcggagggagaggaaataatgataaggtacaaccaacctcttccatcttctggaaggggtttatttttttcggggaggtatttgatggaaatttaccggattattgatgttaatttaaaccgggcccgggaaggaatccgggtgctggaggaagtagctcgctttggtttggctaacagaaaattatttgaggaatttaaacatttgcgacattttatcaaagaaatagaaaaaagtcttgctggaaatcccttgtggtatcgggatgctcaaaacgacccgggacaggaactaagctcagaggagatggcgaggaataatttgcgggaggtggtgttagccaacgccaaaagagcccaggaaagtctgagggttttagaagaatttgggaagctgttagatgctgcgattgtccttaatgccaaaaaagcaaggtttttactttatgagctggaaaaagaagttttaaccttgattaagccttcggtggatttaaccttatacgtacttaccgatgatgcttaccttaacgaagaaaagttctggagggttgtcgaagattgcctgaaaaatggagtgacggctttccagtaccgggcaaaaggaaaaaagggagccgaaatgtaccgggaggggctaaggctgaaagagctttgtgcaaaatatggggtttcgttttttgtaaacgaccggctggacctgggtctggctttaaatgccgatggggtacatctgggacaggaggatttactcctggaggtggcaagaaagcattttcccggaaaaattatcgggctttcggctaccaattatgaagaaggggttttaggaataaaggcgggagccgattatcttgggcttgggccaatttttcccacgtccaccaaggaagatgccgcaccgccctgcggggtagaagtgattcagaagcttaaagaggagttccccaattctccggtaatagctattgggggtattgatcgggaaaaggtttttgaggttattcgtgccggggccgatgggattgcggtaatttcggctgtatttggagcggaaagtccggctcgggcagtttatgaactacgggaaacaataattagagcaagggagtgagcgataatgactcagcttttaaaagcaaaagagggagttattaccagggaaatggaagtagtggcggcggaggaaagaaaatcgccggaagaaatccggcaaaaggtagctttgggggaagtggtaatacccgctaatgttaatcaccaaaatttgcatcccaaaggtattggagcggggcttaaagtaaaagtaaatgctaaccttgggacttcggaaaatcgctgtttttacgaagatgaactaaaaaaagtaaaggtggctattaaagcgggagccgatgcaataatggacttaagtaccggcggaaatcttgatgaaattcgaagggcgattataaaagaaagttcggtgccggtagggaccgtacctttatatcaggcggcggctgaaacgctaaataaatacggtgatataagtcgtttggacccggaactcctgtttgacgttatcgaaaaacaggcagctgacggcgttgactttatgacggtgcatgtgggggtgacccgggaaatccttaaggttcttgaccgttttcccagggtaacggaggtggtaagccggggaggctctctgaccattgcctggatggagaaaaacggaagagaaaatccattgtatgaacagttcgaccggcttttagctatttgccggaaatacgacgttaccttaagcctgggggacggtttaagaccgggaagtattgcggatgctactgaccagctgcaaattatggaattaatgaagctcggcgaactggttaagtatgcccaaaatcaaggcgtccaggttatggtggaaggccccgggcatgtgcccatcaatcaaattgaaatgaacgttaaacttatgaagcggctttgcgccaatgctcccttttatgtattagggccactggttaccgacattgctccgggatacgaccatattactgcggcgattggtggcgcctgggctgcgtattttggggcggatttcctctgctacgttactccagcggagcatttaggattgcctacggtggaagatgtagaagaaggggtgattgccttaaaaattgcggcccatgcagccgatttggcccgggggaaccgggaagcctggaaccgggattatgaaatgagtgtagcccgaaaagagttaaactgggaacggcagtttgaactggcaataaatcccgagcgggccaggaaaatgcgaatagagcgcggctctcaagacataaagagctgttccatgtgcggggaactttgtgccatgaaaattatgaatgaaaggggcggaaaaaatgcttaacaccctatgggaaatcagggagaaggtccgggacttatctcctctggtggtaaatttaaccaataatgtggtgactaattttaccgcaaatgtacttttagcggccggggcttcgccgatcatgtcggaaggggtagaagaagctgacgatttagtgaaaattgctaatgcagtggtcataaatatcggaacccttcactcccgtcaggttgagtactttaagaaagcagtttatttggccaataaatatcaaaagcctttgctgttagacccggtgggtttgggagcaaccacataccgcaacgaaacgacctttgaacttttaaattctggaaatttcacattaatcaggggtaattacggtgaaataagctttttggcgggaaattctgcccaggttaaaggggtggacagccaaacgtccgattttgcagccgaaaatcttaccgaagtggctaaacgctacaaaactgttgtggtggcaactgggccggtagattacgttattgctgaaggagaattgtatttaaaccgtaccggggatataatgcttcaaaaagtgaccggaaccgggtgtgctctaacctcattgattggtgcttttgttggggtaattgatgaaccggctcttgcggccttagcggctttagctttttacggagcggcttccgaaaaagcccggaaaataagtgccggtcccgggagttttctggtaaattttatagattctctttataatttaactaaagaagagtttttggagctaactacggaaaaagttcaagggctacggtgagaaaatggaagttacaaagattggggaagaaggggttatagctattgccaagaaagctactgaagtatcccccggcgttattttgggaatcggggatgatgcagcggtagttgaaattaagggaaagctccttgtaaccactgatttactggtggaaaacgtccattttaagcgaaattacacgaagccggaaatattggggaaaaaggctttggcggtaaatttaagcgacattgcggcaatgggcggcatacctcgcttttgtctggtgagcctggctttgcccaaaaccactgaagttaattttgttgaaggcttttaccagggattaaaaagtatggctaaagagtatggggttactttgattggtggcgatactaccggagctggcagtgaaataatggtggcggttacggtactgggggaagccttagaagaaggagttttaacccgaagcggagcaaaacccggggatggggtatatgtctccggttatcttggcgatagcgcggcaggactttatttgcttttaaaggaaaaattgggtttattgccggaagaagtggaaaaatatctgatttcccggcacctggaacccgaacccagattggagttaggccagcttctctgccgggaaaaatttgctacttctactaatgatttaagtgacggtcttgtgaaaaaacttcaggaaatagcgcgggcttctggggttgaaattacgattaaccgggagaaaatacctttgtcttttgctcttttaacattctgccagcaatttaccttaaaaccgttggattttgctttacacggcggcgaagattatgaacttttgtttaccgtgcctgccgaaaaggaggaagagctttttaaactggacttaccgctgtttaaaattggtatggttacgggatatgacgagcggggaagggtaaaagctgaagatggggtagtcttgcaggataggggtttccagcatttttaattatgaggtggaagatatttgcgcagggtaaaaattatttttttaacttttttactggcaattaccttaactaaagcttttgccagtgcagcttctccggcaaaggaaattaaacttgtctttttgggtgatgtcttagccggcggcaacttaaattattactaccaaaaatacggctatgattatccctggcagaaggttaaaaagtattttcagggtaagcttgtttttgccaatttagaaagctgtatttctcttcggggaaagcccgaaaggaaaaaatacacttttcggggtcgaccggaatttttaaaggctatgaaaaaggcaggagttacggcggtttcggttgcaaataaccactctgcggattatgggctgataagtctttatgatacccttggctacttacgtcaagaagggatttactactcaggggcaggaagggatgtttatatcacggaaatcccctggcagggatataaaattggttttcttgctttttcccgggtaattccttcaactgcctgggtggcaagccccaaaaaaacgggaatctggtctatttatgagccgaatgtcggtaaaatcttaaagttaatctgcgaaaatgatgctaaatacgatcttttagtggtaagcgttcactggggagtggagagggatttaaccccaaatccacctgaaataaaacttgcccataaactggttgaagcgggagccgatgtggtgatgggccatcacccgcatgttgtgcaaaggtatgaaatttataaaggtagaccaatcttttacagcctgggtaactttatatttacttccagtggtaataaagaaactgcaaaaactgttattgctgaagcggtatttacgggaaggaaactaaaaagtgtggaggttaggcatggagaaataaaaagaggccagccggtcattaaataataatccccggtttttaccggggatttttcctcaatctttaagtttgccagcaaaatatgcttcatacgcggacaagtcaaaatagccgtgcccgcttaaattaaagacaatagttttggcaacactttcttcccggcatttaattgcttcatcaatagctgcggcgatagcgtgggaagattccggtgccgggataatgccttcggtacgggcaaaggttactccagcttcaaatacctttaactggggataagctttagcggaaataattttatttttataaagaaggcttaccaaaggtgaatcgccgtggtaccgaagtcctcccgcatggatgcccggcgggataaaatcgtagcctaaagtatacatcggcattttaggagtaaggccggcaacatcgccaaagtcgtatttatattccccttcggtaagggttgggcaggcctttggctctacagcaattatttcaatattttcaccttttaatttttcccgcacaaaaggaaaggtaaagccaccgaagttactgccaccgcccacgcaggcaatcaagacatcgggcttttctcccaaaagggataattcctcataaacctcttgccctataaccgtctggtgtaaaaggacgtggtccaaaacacttcccaaagcgtacttggtcttggggtcactcattgctacttctaccgcttcgctgatagctatcccaaggcttcccggagaattagggtctgcttctaaaaccttacgtccggcagcagtttccggacttgggctttttaccacccgggcgccgaaagtttccatgaaaatcctccggtacggcttttggtcatagcttatacccaccatatatacggttaacttcagcccgaaaaaattggcggcataagctaaagcgctcccccactgaccggctccggtttcggtggtaagctgttcggttccatccagcttgttgaaataagcctgggccagagcggtattaagcttgtgactgccggaagcgttggtaccttcgtacttaaagtaaattctggcgggagtatttagatacttttctaactttttagcccttttaagtggggttggacggtactcggcgtaagcttcccggactttttcgggaatttcaatgaaacgttcggtagaaatctcctgttcaattaaacttttaggaaaaagactctctaaatccgctggcgagatgggctgaccggtaaagggatgaagaggcgggggtggaagttcgggaaggtctgccttaaggttgtagtaatacttgggtaaatttaccttgctcatctaaactcacctcttctaatattaatttctaacattatagcaatttagggcaaaaattggcaaggaaattttaaaaatttctcgaaaagttaattgatcctggttcggtaccatccccgggttgcggtcaatgtttaaaagtattaaactttaaaatagacctaattattatccaggaggggatatgatggaaaaatttctggaagttttaaacacccgacgcagcattagaaaatttcttgatcatccggtggaaaaggagaaaattttaaaaatcctggaagcggggatgaatgcgccttcggcaggtaacgaacaaccctggcattttgtcgttgtaaccgaccggcaaaaaatgctggccatgaaagaaaagcatccttatgcagctatgcttgccgaagcagcagcggcaattgctgtggttgctgatccaaaactactgaaatatcccggtcctgggcaggaattgtggattcaggacctgtctgcagcaacggaaaatattctccttgctatacacgctttagggttaggcggtgtttggttggcagtacatcctttcgaagagcgggagcgcgaaatagctaaaattttagaaattcccgaaggctatcgcattttaaacttgatagctttgggttatcccaaccaaaagcccgatacgactacccgctttaaagaagaaaggattcactgggaaaaatggtaaacttcccggcaaaaccgggaagtttttttttaatatcaaatgcgataagattatgttagaggtgataggatgaagcgattttgggggttactttttttactcctttttggctttaataaattggtcctgggtggggaagtcattgtcaaaggcattgtagttgagtcagatttagaaggaaagcattacgaattaaaagttaccgattccggaaatttaagtaaacccgagccctattatgtcttatacggcgaacataactggcaaagctatgtgggaaaggaagtggtggtggaagggaccgtctttgacggttacagtatttacatgaaacccgggttaaaggttaccgcgataagccttcccggagaaaaggttaaccgcacctttaaggaaaatcttccctattatttgggacttgttttggttgctggactttttggctactatatctttttacggtacattaaaaagaagtaaggagagtttaccgtgtatcctatcagtttaaatttaagggggacccccgtgttagtagtagggggtggtcgggttgcccttcgaaaggtgcaaaatcttctccgagaaggtgcaaaaattaccgtagttgccccgaaaactcttccggaattaatgagtctggcccagagcgggcaaattaaactttatctgcgggaatttcaggaagaagatttatccggccccaagttagtctttgctgccaccgataattcagagcttaataaaagaatagctaatctttgtcaaagactggggatttgggtcaacgtagccgacaatcccgaggagtccaattttattgttccagcggtttggcgccggggaggttgggaaatagctgtggggacctcagggttatctcccctggcggcccgccttttaaaagaagagctttcctggttaattgatcctgcctgggatgattacctgaaattttggggggaattacgtaaagccttaaaggaaagcaatattgagaaaaataggagggaagaaattttaaaagaagtagccaagatttatgattaccggaagttttgccgggaaaaaccttcggtaaaattaatcttggaaaaatttaaataaaaatattttcacaaagcaggatttacgaaaaattttacgaattatcttaataaaaattgaatattgtaactttaaggtgcctttacggcttaaaagggaagtccgagcccaaaagttttgggtaacggcgcggtcccgccactgtaagtagggagttaccctaatatatccactggtttttaccgggaaggatagggtaacgatgaactacagccaggagacctgccttaaagtttggttcgaaacctacgcggataggtggagaacgggagtttggttataagtccccttctaccggcgtaggaggggattttaatttttaaaaaggatggtggagggcatgttaaaaaccaattttcgcttattgtttctgttaatttttcttttaattcccaccccggttcttgccatgcatattatggaagggtttttaccggtaaaatgggtgattttctgggatcttgttactctaccttttataatggtaggttttatccgtttgcaaagggaagctacccaggggccgggagcgaaactaatgttagcttttgccggagcgtttatctttgttttatcggcgctaaaaatgccttcggtaacgggcagttgttcccatcctaccggaacggggttggctgcaattttatttgggccctttatcacaaccgtattaggttttattgttttgatttttcaggctcttcttttagcccacggtggccttaccacccttggtgctaatactttctccatggcagttgctggaccactggtagcttacggggtttataaagggttacagaaagccggaattaatagtaattttagcatttttttagcggccatgctgggagacctggtcacctatatcgttacttcggtccaactggcgttagcctttccgggaagttctctttttttaagtgctttaaaatttatgggaatctttgccttaacccaaattcctttagctataagtgaagggattttaacggttttaacctataatttcttgagccgttatgaagatgccaaaatatgggtagaaaagggtgagcattaatgagaacgtttaccaatatcatcctgctaattttggtaatagcgttaattgcggttcccatgtttttagttaaaggggaattttccggcgccgatgaattagcctcccgggtgattgaaaagcaagaccccaattataagccctggttttcccccgtctgggaaccgcccagcggcgagatagagtcgtttttatttgccctgcaggcggctttgggagctggggttgtgggattttatctggggtacttgaagggaaagaaggaaggaaaaaatgttaacggaacagttggcttatcaaagtcctttaaggaaaattgaccctgtttataaacttcttttttcctttacgcttttattcctggggttaacagctcccaatcctttttttaccttactccctacccttggggtagtaagcttttttctggtgagaaagggaaaaatccccgggcaaatttatcttaagtacttgcttttaccgggaggttttttgctggcaagcttaatcgggataatgattgacttccggccagctccttatgttaactggcaaaatttgtttttggctttaaatgccggcggtcgtgcccttacttctcttctgggtttgtattttttaatttttaccactcccctcctggatttaatagcgggactttcgagatttggtattcctcaatttataattgaaataattatttttattcaccggtttatttttatattcttcgaaatagccggggaaatcattaaagcccaggaggcaaggctgggctaccgaaattttcgccggggcatctactccttttctctcttaactaccgggatttttaaaggaggattggcccgggcgggacaaatgaccatttctttagaaagccggggatacaacgataaaatagtttttttgcaaccggattatcaaaatcaaaattaccccttgctattttggggaatagtagttgtgctggcgctctttacttatggaggtgcttttatttggaggagcttttaaccgtaaaaggattaaaatacgtatatccaacgggaaatgtggctttagacggcttgaatttggagattaaaaaaggtgagcggctttttgtcttaggggaaaatggcgccggaaaaaccactttttttctccacttaaacgggattttaaaaccaaccgccggagagctattttggcggggggaaaagttttcgtacaaaagggattttctgttacgacttcggcaaaaagttggggtggtgtttcaggatccggagacccagcttgttgccggtacggtagcggaagagatatcttatgggctttttaatctcgggtatgcggaaagtaaagtgtgggaaaaggtggaagaaaccttaaaagagctcggaatttgggagttaagagaccagccgatagcttcgcttagcctgggtcaaaaaaagcttgtcgccctgggagcaattttggcgatggagccggagcttttagttttagatgaaccgacggcgtttttggaccggtatcacacccgcctctttttaaatattgttgaacggcagtggcaaaaagggattacgattgtcgctgctacccatgaaattgatttggcgtatcgttttgccgacagggtagcggttttacatgccggaaaacttttggcctcagggccgcccgaagaaattctcctggaatcccggattttggaaagcgcgaacctggaagagccatggcttttaaggggcagcaaaattttaaaagatagcgggcggcttttagctcacgaatatccggtaaaagaggaaaaaaagttctgggaagtacttaaccgggtaaaaactccccgttacggggtaactaccggtactgtagccgcggcagcggctttgggagcagcccgtttcttgctcctgggggaaaaaatgaaggcaattaccattaatacgccggcaggaataacttttactttaaccccggaaattttagagaaaaatgcgacggaagcggtttgcggcattagaaaagaggcaggagatgatccggatgtcaccgatcaggctttaatcatagcccgggtacgccggcaaaacttcccggggattaccataaaaggaggacggggagtgggagttgttacggaaccggggcttgctgtaccggtgggagaagcggcaattaatccggttccgcggcaacaaatcaaagaagcgctggagccgttaattttgggcggggaaacggggttggaagtgattattgaagtgcccgaaggggagaagcttgcgtcacaaacattaaatccgattttggggattaaaggcggtatttccatcctgggtacccggggtattgtcgtaccttactcccgggaagcttatatcgagtccctgcaactccagctaaaaagagcgttatatttggatttaaaaagacttgtttttgttttgggcaataaaagtaaaaaagtagcccagaggttaaatgttcctgctgaagctattgtcgaaactggtaattatctgggggatatgctgaagatttctgagaacgaagggatagagaaaattttaataatagggtacctgggaaaacttattaaaacttaccttggcattttaaaccttcacagccaggtggcccggggccaaaaggaggctttagcgttatttttatattctcttggagaaagtcaggagttaattaataaaatttactccaccaaaaatatggagcaggccctggaaattttgaagagcgccgggaaagaccattacctgcctttacttgcccgggcggttaaagaaaagttaaagagctattatagcggtcttaccatggatgtggcttttaccgatatatcgggggcgattattgctacaacctttgaccgccttgaggagggatggccgtgggatgggtaaaagtcgtgggggtcggtccgggtagtcccgagtatcttactaaaattggcgaaagggtaattggggaggcggattatgtagccggggcggaagaacttttaaaaacttttgctccggataaaaaacatctatcttttggtgagtttggtgcggttttaaagcaaataaaagatttatcaagaagttttaatattgctcttcttttgcggggcgataccggcttttacagtttattaagaaagattgaaagagaaaatccaggacttgttaccgaggtaataccggggataagttcggtgcagttagcttttgcccgcttgaaaaaattgtgggatggggctgctttttattctttgcatggaagagccctgccggaaaaattaaaggatgagtttacggtccatgtatttttattaggagagaaaatcgatacctcttccctaaaacaacttttgcaaaaacacggcctggagggagcttcttactatttactttatgatttaagctatccggaagaaaaaattataaagctttcctttgccgatttacctccagagctttcagggagggggatattaattgctgaaagatgaagatttttatctacccggaactccttataccaaagaagaaatccgggcagttcttttaaaaaagcttaacctgaaaggcgatgaggtggtttacgaagtagggtcaggctcgggcactattacggtggagctggctttaagtcttccccggggtaaagtatatgcttttgaaaaagaccttcagaggcttaccgtaattaaagaaaatctacgaagattttcggtaaggaatgtggttttactaccccaggccttaccctgtgatttatccgcctatcctccaccggatatggtggtaattggtggaagttctaatttaaaagaagtattaaagcaagttggggcctgtttgaaaaatggtggggtccttgccggtttggcagttacccttgaatcattagctatttaccaggagttttttcaaaacagctcttttaccgattttgacgggattagcatagcggttaccaggtttaaaaaagcaggaagctatcatatcctgaatgcgcaaaatcccgtatttatctttaccggaaggaaaaagggggaaaaaaatggctaaactttacgtggttggtgttggtccgggggaccccgagcttattacggtgaaagctatgaagattttgcgaggggtacgggttttagtttttcccggaaaaagggcttttaaagttgtggaaagttttctttcagatgataaagaaattctcttttttaattttcccatggtggaagacgaggggcaaaaacgggaagcggcgcacacctttgcccaaaaaattttagagtatttaaaccgggaagaagtttctttttttaccctgggagacccgggtttatacagtaccgctggatatttattggaggcgctaaaacagttaggttttgcaggggatatagaaatagttccggggataaattccttttcactggcagccgctaagtctttctttaacctggcttttgaagatgaaaaggtagaaatcctatcgactttgccggaagattttacttttgagcccaaaactacctatgtttttttaaaactttcctcctattacgaccgctttttagagctggtaaaggaagcaaagatccagggatattattttaaagagcttggtaccgaagaggaaaaaatctgttcttttaatgaacttcccgaaaaaaccgggtatttttccctggccctggcgaagagggggacttagccgtgaaagtttatttagtaggcgccggacctggagatcccgagttaataactgttaaagggaaaaaacttttagaggaagctgatttaattgtttatgcaggctccctggttaatcccggacttttggaatatgccaaaccggaggcggtgaaagttgattcggcgcccaggactttagaagaaatagtggagataatggtcgagtatgctcgagccggaaaagttgtcgtacgcttgcagaccggagacccatccctctatggggcagtagaggaacaaaaaagagctttaaaagcctatggagttgagctggaatgggtgccgggagttagctcttttcttggtgcggctgcccgcctgggttacgaattaaccgttccagacggtacccagacggtaattttaagcagggttgccgggagaacaccggtgccggaaaaagaaaacttagaggaattggctaaaattgggtcaacccttgtgctctttttaagtgtggataaaatcgacgaggttgtcgcccaaatttcccgggtaagagctcttgatactccggtagcggtagtttataaagctacttttcccgaagaaaaaattattaccggtactttagcggatattgctcagaaagtaaaagaagaaaagataaacaaaaccgcccttatctttgtaggggagtttttaaatccgccccctactcgctcaaaattatatgctcccgattttactcatggtgggagaagaaaaggtgattaagaatttaataattttttactttaccgcagccggcgaaactctggcccggcgctttttaaccctaaagcttggggggaacgttactctcttttccggtaaaagcgcggaaattaaaaactgtcttaaaaaaaactggaacaacgatacagcttttctttttatcggagccttaggaattgcggttcgcttaattgctccgtttatcaaagataagttttccgacccggcggtagttgtagccgatgaaacgggtaaatattttataagcgttttatccggccattttggtggggcaaatgaaatttgtcaacttttagcccaaaagctggggggagaagcggtaattaccaccgccaccgatgttcagggaaaagttggcttggatgttttagccagaaaatacgtgttaaggtatgctgaccgggaagtttttaaaagggtaaatgctgccttagcccggggagaagaggttaagttttttgccagatctttgccttccgattttccctatccttacctggcagaaattgaagaggagttttctggcattaaagtattgatttcgccgtatcttattgctctaaaacccaatgaataccagctctatcctccggcggtttgggtgggtataggctgtcgccggggagtagagtttaccctgctggaaaaggcagttctcgaagctctacaagagggcggtgtttctttaaaaggtgttgccggaatagccagtatcgatcttaaaaaagatgagactgctctcctggagctggcagcgaaatacgggcttaaaacaaaattttttacgcgggaggaacttttggaagtaattaataaaaaaaatttacaacaatcttctaaagttttaacaaaagtaggggtgggaaatgtatgcgaagcggcggctatcaaagcggcagggatggggaatttaatattgcccaagaagatttttcccaaagtgtcagtagctctggcggaagccttgcggtggtgggaataggaccgggaggaaaggaagaactgactcctttagccttaagttacctccagcagtgtacggtaataattggttataaaacctatattgatttagttaaatctttaattggtgagaaaaaattagtggcttacggtatgaaggaagaacaagcgcgagctttagaagctatcaaccttgctctttcgggggaacgggtagtggtgatctccggcggtgatgctggagtttatggaatgagcggggtggtattagaggctctaaaggagaaaaatatttccccccggaaagtaaatttaacaattattccgggtattacttctgctttaaaagcagcaagcttgctgggatcacctttaaaccatgacttttgcttgataagtttatcagacctcttaactccctgggaggtaattgagaaacggctccggcatgcagctttaggagattttgctatcgccttgtacaatccccagagtcaccggagaaagaagctaaggagagccattgaaattttgctggagtataaaaatccagctacaccggttggtattgttcgggaggccggaagattgggagaagaaatcaagctaaaaactttagcggaaattaccgaagaggatgccgatatgcgcacggtaataattatcggaaatagccagagctatttttatgaaaactttattattacaccccgggggtataagtggtgattttattgctgggaggtaccagtgaaagtattttaattgccgatttgctcgaaaaaaaaggtttaccttttattttatcggtggcgtcaaatttgggccttatgcggtttaaaaaatatgaaaaacctttgcgggctggagtcctggattttcatggccttctggagtttgttcagaaaaatgggataaagttaataattgatgctacccatccctttgctaaaaatgccagtgaaaatgctatcagggcggcccaggtattaaatataccctatatcaggtttgagcgccccagggatgaattaaaaaattcccttatcatagaggccattgatttagaagctgcactaagagaactgccgcaacttggtaagcgtccattaataactgtgggagtaaaaatgcttccggaaatcatcagaaaaagtgctgttttagggcaaaagccggtagtcaaagttttgcccctaacggataattttacccttttggatggtttaggaattcctctcgaggaccggctttccttttggggtccaggaagccgggagcttatttctcagctaattaaattttattccctgaccggtcttttgaccaaagaaagcggtgatttaggaggagaaagggaaaaggtagaaagctttttaagtcagagtttaccggtaattttaataaaacgtcctgaggttttttaccctcaatcggtatccacactggaccggttggaagaaattttaacattggaggcggaaaaatggaaaaagcagtagttttgctggctcacggttcccgggtggcgcaagcggtggagaaatttcgcgaagtggtaggaaagttaagggagcgctttcccttccggctcgaggaggcgttcatggtaagggctaatcccaatttaaaggaagcgcttttaaggttgtatcaggaaggataccaggaaatagccgttttcccggtttttctatttgaaggtcttcatttagtgcacgatattcctgaagaaattgaccagttaaaagcccagtatcccgatttaaagattacggtttataaacctttaggtgaaaaagaacaatttattgaatttttagcggcggtgttggccaatgaattatgaatttttaattaatccccgggagattgaacagaaaagttttgccattattgaaagtttaacgggacttggcaatactcctgaagaccaggtaattaaacgggccatccatgcatcaggtgatccggaaatcagaaaggattttcgttttcatcccgcggctatcgaccgggggcttgccgctttaaaaaacaaaaatttaattattaccgatgtggaaatggtccgggcgggaattaccggttatgccggcgaggtagcctgcgcgattcgcgaggaagcggttaaaagaaaagctttagaaaataaagttacccgggcttatcaggcgatgatggagctaaaagagcgaatggatggagcggttatagcaattggtaatgccccaacagctcttttagcggtgattgaactcataaagaccggggtagagccggcgctggtggtgggagtgccggtgggctttgttggagcaaaagaaagtaaggaacttttgctgaactgtgatgtgccgtatatcacgttactgggtactaaagggggtagtaccattgcggcagcaatagttaatgctttaattaaattatccaggaccggagggaaataaagtgaaggtgttaattaccggtggggtgcgttcgggcaaaagtagttttgcggaaaagttagcgacctctttcggggaaaaagtggtatatgtggctaccgctactgccggggacgaagagatgcgtgagcggattgccaaacatcaaagccgtcgtccccctaactgggtcacggtggaggagccggtaaatttacgggacgttcttttaacagcccggggagatgcggttctggtcgattgtctaaccctctgggttaccaatttacttcttaaagaagaagatgtggttggtaaagcttatgaagtagtagaaatatttcccaggattaccgttccgcttatctttgttaccaacgaagtaggttcaggaattgttcccgataacccgttagcccgtaagtttagggatgtagccggccttgtcaaccaagtttttgcaaagtattgcgatgaagtttaccttaccgtggcgggaataccggtaaaaatcaagggggtgaactaatggccagggcgataatgtttcagggaaccgccagccatgtaggaaaatcggtgctgactttagctttagcccgggtgctttatctggacggctttaaagttgccccctttaaagcacaaaatatggctctaaattcctacgtaaccctggatggcggagaaatgggtagagcccaggtagcccaggcggaagcctgcgggttagagccccgggtagaaatgaacccggttttattaaaaccctcgtccgataaaggtagccaggttatagttctggggaaacccatcggtcactattcggccaagagctaccatcttgagcggcgcagtatggtttgggaagcggtaaaaaaagcttacgaaactttagctcaagaatttgattttattgtgattgaaggtgctggaagtccggcggaagtaaatttaaaagcttccgacattgccaatatgaaaaccgcttttttagccaatgccccggttattttagtggccgatattgaccggggaggagcgcttgcttccctggtggggacaatggaacttttagagcccgaggaaaggaaaatggtgtgcggctttatcttaaataaattccggggagacctggaattattaaagcctgcccttacttttttggaagaaaaaaccggtattccggttttgggggtaatgccttacattcccgaacttttaatacccgaagaagattcggtaagtttggaagaaactgttagtaaccgggagaaagatttaaaaattggcgtggtgtggtaccccaggatttccaattttaccgattttgaaatattccagtatgaaccggacgtggagcttatttacatcaaaactcttcaggattttcgggacgattttgacctggtaatattgccgggaagtaaaaacaccgtagccgatttaaactatttaaaacaaaggggccttgaccaaaagctctacgcttatgtagagaaaggaaaacccctgattggaatttgcgggggtcttcagatacttggagaaaagattttggatcccgatttggtggaagggaaggaaacggaggttaaagccttaggaatcctcgatactgttaccgaatttcgcggggataaaattacccggcggacaagtacccgggttaccagggccgatggctatttctttctccagagggaagaaatctccggctacgaaattcaccacggccgaacttttctttcaggggaaagaagtgatgtattggataatacggaaaatccgctggtatttgcccgcggcagagttcttggtacctacctgcacgggctttttgataatgacttttttcgccatcgccttttaaatcggttgcggcgggaaaaagggcttgacgggattgaaaaccgcccgacttccttaaaaaacctgcgccaggaaaattatgataaaatagcccgggtgttcagggaaaacgttaacttgaagaaaatttacgagattctggggatctgagatgaaaggaatttttattaccgtggttattgccttgatactggacattgtctttaaggatccagggcaagattatcatccggtagctttaattggtcgttatattgcttttatagaaaaaaagctttacccgaaaaagcctgccaagaaagccttaatcctttgcggtggtttgctggtagggctgaccttattgccggtaagtttcatagcttttatctaccagcattttacccagaagctaccttttcttttccaggttgtttttcaggggggcgggctgttttttgccatagcccctaccggtttggctttttcggttaacaccataaaaaaccacctgaaagatggtaaccttgctgaagcccgaaaaagtcttggaatgattgttagccgtgatacccgggaattaccggtgacggaagtggtaaggggaagtttggagagccttgccgaaaataccggcgatggggtagtggctcccatattctggtatttaattggaggacttcctggagtatggttttacaggacggttaacactttagacagcatggtgggctataaaagtgaaaggtatctttatttcgggcgcattgcggcaaaattggatgatcttttaaattaccttcccgcccgcatcacgggagttttaatggttttagcagcatttatcttaagatatgactggaaaagggcaataaaaacctggcttagagatgctaaaaaacacccgagccccaacggcggaattcccgaaagcgtcctggcgggaagtcttggggtcaggcttggaggcgaaaacatttaccacgggcagaaaagctttcgggcttatttaggtgaaccgctaaatccgttaactccggaggtaatagataaagctttaaagcttttctggtttacagtatttttaatggttttgctttttggcggtttctctacggtaggaggggtatgatgaaagggtttattataagtggtactactacaggagctggcaaaagtaccttaaccgttggtatcttagcagctttaaaacacttgggcttaaaggtgcaggcctttaaggctgggcctgattacctggatcctacctaccaccgtttagcgcttgctaaacctacctataacctcgatgagatcctgacttctccgggattggtgcgccgtcttttttacgaaaaagctaaagcagcggacgtggcggtagtggagggggtaatgggcttatttgatggccgggacgaaaagtttaccggaagtacctatcgcttagccaggtttttaaatcttccggtaattttagtggtcgacgcccagaatcttggtaccaccgtagcagctcaagtttacggttatcttaaatttaaaaaagatatcaaaattgccgggattattttaaacaaagtttcggggaaaaaccatgcggaacacctcttatctgccttgaaaccgttaggggttaaggtttttggggtgttttaccaaaacgaacttcccagacttaaatccaggcatttaggtcttatcccggccaccgaagagcagaatatcctggaaattattaaagaaataaaagataaagtgctggcaaaaattaattttgctgacttgctggcaactttaccggagttaactgttccaaaaaagcttccggcaattaaataccccgatttaaaaggaaagcgcgtagcttacgcctttgataaagcttttaatttttattaccaggaggcaattgagtatttgagaagatctaacgccgaagtctttgcggtaagtcccttaaacgattccgattttcctcccgtagacttactttttttggggggtggttatcccgagctttttgccagggacttatttttaaaccaaaaatttatccagaatttaaaaaagaaaatccagggtggtcttagagtttatgcggaatgcggcggttttatttatttaacttccggcgttaaggttaaggagcaaacttatcctttgaccggtatattacccggggaaatggaattaaccgataaacttcagggccttggttattatcggggaaagccggttggaggctacctcgggaaaaattttcaaaaggaaatctgggggcataaatttcattactccacttatacagggccgcaggacaatcctgcgtatctcttgcagaaaaacggacgggaagcctttgatggggtggcgagagataatatttttgcctcgtttttacatcttaatttctacggtaaggccgatttagtaaagacccttgtaggtggaagaaaaggatgaaaataaaagcgtatgtttgcggtacggcgggagaactggttcagggaagtattggaggaaaagattttttattaactgccccggttaacatagggaatatagttgaaattgctcttaacgaaaaacttgatattcccgaagatcgacccaaaatcaagcggttagtggaaatattttatagtaagttttcgattaaacataaatttaccataaaagttacgagaaatcttcccgaaggccggggcatgggcagcagcacggcggatttagccggaagtttggctgggatgttaaagctaagtggaattagaattaaccgcggggagtttttaaaaatcttaacccaggttgagcccaccgatgggagctttcttccgggaatttctctcgttgaccaccgccgggggagtttttggtaccgaatagcggcggcaaaaaattataaaatattttggattgataccggcaaagcggtagatacgattgcctttaaccggcgggaggacttaaaggagctaaatcggcttaaagagcccaaagtgcgacaggcgctcaaaatggtgttctggggtttaaaaaccgataatccctatctttttgggcggggggtgaccgttgatgcttttgcccaccagttaatattgcctaaggaggaacttttctgggtttacagggttggtaaagaactgggagcggtgggggttaacgtggcccatagcggcagcgggattggcctttggtttcataattcgtggtcgcaggaaaaagaagaaatcttaagaaaagagttttcttcctatacatgccgggtattaaccctggtggatggaggaattactttggaggttcatgatgcttgaacacggaggaaataagcaacttttttacgaaaaatacggggttttaccgcgttacgattttagcgccaatttaaaccccctgggtccacccagagacgctcttaaacttttgcgggaaaacttaaaggagttaatttctacctatcccgattatcggtaccgggagttagaaaaggcggcttacgggtattttcaaaaggaagaagtagttctgggaaacggggcttcgtcccttttaaactatttacttttttatctaaaaccttcccgggggttaattatcggacctacttttaacctttacgaaaaaacgctaagaaatcgcgagataccggtagaaaagctggactgtgctttagaggagaaagggtatagtaatgccagggcttatcttttgcaaaaaggccggaagggagatttattgttgatttgccggccaaacaaccccgatggctctgcctggcccgtaagtgaattatttaaattaattgctttatgtcaggaaaaagggataaagcttcttttagatgaaagttttgccgattttatggaagatgagagggaaatcttttggcgaaattccggaaagttaaaagatgtctatatcttaatttcccttaccaaaatttttgccattcccggtttaaggcttggagctttaatcttaccggaaaaggattataaagattttaaaaaatttttaccggagtgggagataaataatctggcagcggagatagggccggtactttttgcccagagggattatctgttaaaaaccagagctttaataaaaaaagaaagggagtatttaagccaaaatctttttcgtcttggctttcaggttttgccgtctaaagcaaattttttaatggcttatcttcctgaaagtatcagctcagaacagcttctttctgaactggcaaaataccggatagctgtaagaccgctccaaaattttggcttgaaacgggaagcggtgcggattgcggtaaaaacccggaaagaaaaccgggtgcttataaataccttaaaaaatattttattcaagactcacggtaaaaagtcaaggaccaagaaatggaaattagaaaagtaggggctaaaaaaggcaataataaccctctccaactatatggtaatagttggaaaatagcagagaagagaaaaggttttattcaagaactatttcatcaccgtccctttgtagatttggcctttgctcagcagggcaaagaccagccttactaatttgcgggcagttagaaccagcgctcgcttatgttgatgcttggtaacttcgtgatacttgctctggtagtaggccttatactcctcgttgtgcacccgcaacgagttggcggcctggaccaggtagtaacgcaggtaccggttgccactttttgtcaggcggcgttcttcggcgtcaaaatcacctgattggtagcgggtccaggtaaggccggcatattgagccagagcggcttgatctttgaaacgtttgatatcgccaatttcggctataataccagcagccgagatgggaccgaggccttttacgctggtcagagtttgaggtatggcttctaactcccggcaaatgactttatccagttgtttaagctgccttttgaggtggtcaatattctgcagagtaagagaaagagctacctcacaagctgcgagcattttaggattaaggcggtaggcgcgacgggcagcctgtttgagggccttagccatattctcaggtgaggctaatttgttattaccatgggactggatgaactctgccagctcttccaatggcatttctataagttcatctggtgtaaattcctgtaataccgccagggaggccttaccgaaagtttgactaaaaggcttgtcctggtgataattagaaaacttaaggaagaggagatttaaggctcggttctgctcggccgtcaccatttccacgaggtgtaggcgcaggcgggtgagctggcgcaaaggttcagtcactatagtttcccggctacaaggggtaagatggccgaagcgcacccgttctgcgataacgtaagcgtcgagggcatctgttttagggcgcttggtaccgaaggccttcttaaaactggccaccatgacggggtttatttcatagaccttggtggagtatggcttaagctttggggagtccaggaggaactgacggagatggacgctgtagatagaggtggcctccaaccctatatgaagttgctggatgttaaacttatgggcgagaccatccagcacctcaaccatagcagaagcgccttcgaggctgttaggaaaagacttaactggggcgagctgttgcccttgctcatcgagacacaccaagtcgcatttaagagcgctgacatcaatgcctgcaaaaacgacccgggccaaagggtatccctccttgggctggcccaaattaggggcgtgccctgcgggtacgtcgcgtaacaacctcgcggggcgatgagagcgtggcaggacagccgggggtgcacctctggcctgctgaatccagaagccggctggcctgttggctcagctcacgcgtaagaaacatgcgccgcaccgcaagggtctcactcttacatgagtagtcaccgggtttactcgggctacaggaggtatttaagagtgaccccggaccaacctattttaatcttcgcaaaggcacgccaagttatcaagaacccttaacctaatttttcggctcgggttctatggtaatttaaattatacgaggaggttttttaaatgaatatccgaacccttactactttagcaattttaattgccttaagcgccgttggcgcctttattaaaattcccagtcctaccggaaccgtagctttggatagtttacccggttattttgcggccctttatttgtccccgggtttgggagctttggtggctgctctgggccatttgctttccgccgctactgcaggttttcccctgaccttaccgctccacctgttagttgcgctggagatggccatttttgctgcggtatttggagttttaggtaagcgcaatgttattgtaggtattgtggtggctaccttattaaatggagtcatagctcccctttcctttgccattatgcccaaatttggtatggcctttttcaccgccatggttgtaccccttttggtggcatcgtttgttaatattttgctggccggtttaactgcccgggctcttcgcgggaaaacggagagatgagtatggccggatttaaataccgggatttaaccatcgtacctctatcccgggaaaagatggtaattgctgccgatagcattggtggggttggtccgaaagccggggatatagtaaaaacttccggagaaatcgttggtcgttacggggctcgggtggtattgatggagcttttagcggtaaaggccaggccgcaggtaatttcctgtaccgtttcgtgtgaatgggaacctactggtaaggagatttatcagggggttttggcggaagtaaaaaccctgccttttgccattgatattaccggaagcagtgaaaagaattttactacaaataccacgggagccggttttacggcggtgggcctgggagacgagcttttagtaaacaggatttgcgaaacttcggacttatatatcgtaggcgtacctctggtaggggaagaagtgttaaaatttccggaactgcaggctacacctcatctggtgtatgaattgagccaaaataatgatgtactggaaataatcccctgtgggtccggcggagttggggcggaactaatgtggcttaaaaatcagggatttgaaatagagaacgttatagcccctcccttttccctggaaaaatcggcaggaccgggaacttcactgctggtggcggtaaaagagggtattgagcttaaagcggcgattccggtacattatctgggtaaagccataaaagtcaaaaaaacttaggaggtagcaacagttaagccaaacaatgcagaatagtgcaataatacttactcagcaatggatgaggttaattttacaaaattgcaagcgtggtgaaagccgtgaagcaaatcataacaatccaggcaaggttatacccaaaggcggaggagaaagaggtattagataacttaatgcgaaagtggaactcctgtaagagatatgcttataaccgcctacttgaagggaaaacccgaaaagagctcaagaaagaactgcaaagcctatttggattgaattccagatatgcagacgatgctattcttgaagctaacgaaattttgcaaagcaccaaagaacttggagaaaacccacgcaaggttatctttggcgggaaagtattgttttatagactaaaaagcaaacatttaagcagtgagcagaggcaaaagtacaaaaaagagtgggaagataagcgcaaaggaacccttttctccagaggggataaaaccaagcaggggaatttaaatttaagagttattgaagaaaatggccaattctttttaagagtaaatgcaggtaatagaaaatggctgtttatagaacttaaaagttcgcataaaaaatggagaaagtttgcaaaaacaatgctaaattcctgtccttacagcgttcgtttgcagaggaaaaacaataaatactatgcttacatttcttttgaagataacctacctgttgcatcaatagatttcagcaatggagctatcgggatagacttaaatgcttttccatcacacatagcctgggctgaaataaaaaaagacggcaatttagaaagctttggagaaatccccacaccacatctctgggacgggagaaaagaaaaaagagattactttgcatgggtatatgccaacgaaattgtaaaattagcccttgagaaaaacaaaggcatcgtagtagaaaagttagcgataaaagacaaaggctaccggggagattacaagggaagaaaatccagaagggtaaaacacagttttagctatagaaagcttattgccagaataaagacccttgcccagaggtacggtgtagccataagagaagtaagtccagcttatacaagcgtgataggaatgctaaagtatgcaccacaattcaacctaacaaaagatacagcagcagcctatgtgatagcccgaagaggattggctttaagggagaaaattcccttgaagtatagagagcttttgaaaagcctgcaaagcaagtcacggtcggtatcttcattaaccgaaggaaggaatgaaggtactgcggtaaaggggaaaaccttaccgtacaaaccgtggcgagttttgcgggtagccctcctgaccggagctctcctgggcaggccattatatcgtgacctgtcaccgctgaagaggatgctcgtaagcggtatgggagaaggtggctgaatggccacggccagttcctgcttcttggggcaggggctatggctgtcccaaataccgccagttggggctggggcagtctgaaaggcggacaacaaataccccaaccttctaaactgatgcagttttgcacagtttggatgaccaggtttgcaatgaacggcaaggtatatttagtaggggcgggaccgggagacccggagctcattacggtaaaagggataaaacttttaaaagaggctcaggtggtcgtttacgaccggctgataagccccgagcttctaaaatatgtaaatccttctgctgaactttactatgccggaaaagctcctggccgacacagtttaaatcaggaggagataaacgagcttttaatacaaaaagcccgggaaggaaaaatggtggtacggcttaaagggggagatccttttgtttttggccggggaggggaagaagctttggctttaacccgggccgggattccctttgaggtggttccgggagttacttcggcggtagcggtaccggcgtatgcgggtattccggtaactcaccgccggattgcttcaacttttacggtagttaccggcaatgaaacggaaaataaagaagagcgggaggtagactgggaaaaaattgcccgggtcgggggtaccattgtcattttaatgggattaagtaaccttccgtttataaaaggtgaacttttaaaatacttgcctgccaccacaccggtggcggtaatttaccggggaactacccccagccagaaaattgtcaccgggaccctggaagacattgtagaaaaggtattggcggcgggaatcaagcatccggcggtaattgtggtgggtgatgtggtaaaattacaaggggagcttggctggtattccccatcagcattaacggagtgagcttaaaatgttaactacctttcttttaggccttacctttttcaccaggattccggtgccgggaaaacttaatttttccgaagaaaaatttaacagggctcctatctttcttcccgcttatggtttagttaccggtggtatcttagccttaataattgaattattcggaaggtcctttccaggctttttctgggccggagttataatagccgggcaaatctatttatcgggagccctgcatatcgatgggttactggatagccttgatgcaatttactccaaccgcgaccgggaaaaaaggctggaaattttaaaggactcccgggtaggctcgatggcggtggcgttttttggagcgtttttaattctaaaatacggaagttatgcttcctttactccgaaagtgcaggcctttacggtgctgatttccgaaattatcctgcgtggaacgggctacctggtgatttattccttcccctatgtgggctcttccctgggacggggttttaaagataatgcttcaactgccgggttaatctttaccctggggcaaaccttaatctttaccctgggagcagcggcgttttttaatttttctctaattaaaattttaataattttgcttttggcttatctttttgcgtttgtggtggcagctcgctggcagcagttttttgggggactaacgggagataattacggcggaattatggaattaaccggcctttttgtgccggtggcggttttacttatcaataatattggggtggtgtgataccaccccttttagcttttaatggattgttaaggtaaaatttgcttttatttctccgaccatttcttttttgtgatttttaataaccggacggtagtgggtagctaattttttaagttcctcgtcaccgataaatccaagctggcgcagggcttctaaagtaatagcccccagggcccgggcgttaccatcggccacttttaccgctacggcaatacctttgttaagaatacctacgatttgcaccgcttccgcccctatctttgagacaaacctaccgggaaaacttcccattaaatcggtatcaaaacggccggttcctgcgaccattaccggataggcattcatgctgtgtaatactgtttttaccgcttcttttaatttcccggaaaacaggtcgggccgtgagagtttcgcaaaggctaaagctccatttttcaggggtacggcaaaaaccggtaccccgcagccgtcaatgccgatctttatattttctggagaaacttcggtaaagtcagcaataaactttaaaatttcctgctggaccggatggtctatcttttcgtatcccgttaaagggtagccggaaactttggccaaagctaacatacccgcatgttttcccgaacagttgttatagaggggtgatggctctaatccctcctgtttaagccataaggcggttttccggtcaaaaggttcatgggtgccgcagcttagataaccttcgtcaagcccgattttttgtaaaattcctgctaccgtttgggtatgctctacggttccgctgtgggaagcgcacattacagcaatttctttggcgctaaaatcatagggtaaatcttttaccagaagaggtaaaacctgaataggtttggcggaagaccttaagaaagtaacgagctccgggtttccggcagaggctacaatcttgccggtgtaatcgaccacggcaatggaaccaaagtggacactttcgacgatatcaccccgggtaacttctgccaaaagagtgtaatctgttgcaaaattcattatctcacctcatttttctcctccatccaattatatcattttcgttaactccggagtatcttgtttaataaacaacccctggagtttctttacgaaggctttctttaaagttttgaatgttttcttgaaggaaggtaatgtcggctttctcccgaagctcttttacccatttagcaaagatttctttttctttttgcgaagtttctagaggttcatgctctcccgttggcttatttttctgagatgagatgacttcagtatatagcttttggatgataatccggtttttcaggatctctttatactctttttccgacatttgtgtataaatttgctggtataatgacggcaaatggtttttaagctgcttcagccttgcttctatttcttcccttgtggcatctatctttcgcctcttggcttcctgcagaataagtttttcatctattaggtcggaaaggatttggtcgaggcggttagcagcctggcttcctgctatccggtagtttttgataaccttattcacttccgaagtagttaaggcttcgccgtttataattaccagaacgttaggttgataggttttctgatttacatttaaaaaaaacttaaccgatagcagcaacccagctaacgcgaaaaaaataccacataataatatgtttttattatgtagtttataaaaaggtttcaagtataatcttcctcctccggcactttcttttcctaaaaaaacagagcgggacctgccccgctctttaaagtttttgcttaaatttaatatctatcccgcttgttaagccattcggacctatggtctgcacagagggtagtgttttcggtgggaccgtagagaatggggtacattaagcaggttggctgcgtgcaatggttatttccatcggtgggtgaccactgggccagaccgtaattatgtcccgtttcgtgacgaacgattattccattccagctgcttccgctgtcaaagattagtgagccaggtttgttaatgtacgctatacctaaagtatttccgtaagtttgtccggaaaaagctaccataagatcagcaccgttggtgagaccgacttctattttagcttcatccagtagatctccaggagttatattattggaattccagacattttgggcaacggaatagaaatctataccaaattgttcgtataggtagtcgtccgcaacttcaacggcatagttggcccagtacctccaatttgtaccgtagcgggcccgccattcttcgtcgcacggctcatttatataaacaggtattgagaaaagactaaaagcttcgttattaccgaggatgggcggtttcatgtttttttcgggcagggagtccgggtctggcggttgtggcccattgggatccgaggttacgatgtcaacaagcagcccggtttttgggtcaagatataccccggcctttggatacgcttcgttattaccgaggatgggcggtttcatgtttttttcgggcagggagtccgggtccggtggttgtggtccattgggatccgaggttacgatgtcaacaagcagcccggtttttgggtcaagatataccccggcctttggatacgcttcgttattaccgaggatgggcggtttcatgtttttttcaggcagggagtccgggtccggtggttgtggtccattgggatccgaggttacgatgcaataaagctgtccggttttggggtcggtatatacacccggcttagatataacattcgaagccgctaacgtaaccggtacggaaaagagaagaacccaggaaagaaaagccgtagtcataattcttttcaaccttttggcatttcccttgcgaatcacaggtttcacctccttcccccaagttctatagaccattgggcaagctgcgagtgggtctgcctcaattgactccatagcatttatcttaattccgaactttatctaccaatattgcttattaatactttttcttagtaaaattgtagcagctagcaaaaaaatgtaaagagtattttttgtaactttttatcaaattgtcggaataaaaggggtaaaaaaatttgtacggtatccagcgcggcaaaggggaaatttatgccgggggtaacctctggattttaaccactataagctaaagaggccgtaagcttttgcctacggcctctttcctaatttaactttacctttttttcataacgttttgttggaattaccagcaaaaggttaaaaatcagtaccaaaattaaaagcaaagcggcgctgccatcggcaatgcgggtggcatcgggaattagtccttcggaattaacataccagaggtggacggccagagtttcaccggaagcaaaggggtttaagtcgaacataaagcgggaaacggtggtacccgcagtaaaaatcaaaatagctgactcgccaatggcccttccagctaccagagttaccccggtaatgatgcggggtaaggctgcagggagtacgacccggaaaagggtttgactttttgttgcgcccagggccaggcttgccatgcggtacgatttgggaactgcgcgtacagcttcttcggtaacccttattagtaccggtaaatttaaaagggataaagttaaagcgccaccgataattgtaaatccaagccccaggaaattcacaaaaatgatcatgccaaaaagtccaaagacgatggaagggacggtcgctaacatttcagtactggttcggataatattaactaccctaccaggcttagcatattcggccagccagatgcctgctcccaggcctacgggcaaagaaaaagcaagagaaagcaccaaaatataaaaggtgttaaatagttcaggccccacacctccccctgcttccatctcggagggaggaccgaaaataaaggaaggggttaaaaccggcaatccgcgttttaaaatgtaaaaaataaaggatataagaataccaagaatggtgaggcccgccaatgttaataaagtagtagccagcttatcgataaatttattttttttcaatggccttcctccttggatgcggtaaattttcgcactaataaaattaaacctaacgcaataagtagcaacacaaaggccattaaaaagagagcattattccatgtggaattaaaggccgtatttcccatttccatcacaatttccgaagtcagggtggcagtaggttgaaacagggaacgggggaaaagaggtgtattgccaataaccatttgcacggccattgtttccccgatagcccttgccattcctaaaactaatccggtgataattcccggcgctgctgccggcaggagaacatgccagatggtctgccagcgggttgcccccagggcataagaagcttcttctaacgaccgggggaccgaccgcagagcatcttcggcaagggataaaaccgtgggtaaaatcattatagctaaaataattccggctgccagcaacccaaagccgttttggttgggtgagatttggcgaattgctggaacaataattgtaaggccaacccaaccgtagactactgaaggaatacctgccagtaaatctactactgtgcgcaaatatcccgtcagccaggaaggaactattttcgccgaaaacatagcaccggctatacctaaaggcccacccagcagaagagctaagagggttacgaaaaaggaactgctgataaacgtaagagctccaaactggttttggtcgggagcccattttgtactgccgaaaaactccaaaggactgacggctaaaaaagtttttaacccctgtttacctacaaaaacaacaatagctgctatggtaaaacaaactaccatagcagttagaaaaaagatatattgaattaaaagctcttgcttttttctaagcactactataaaccgcctttctatgttcatacggtttatttcattttacttatcgataagaagcccaatttttccacgtagttattttgaaattcatcgcttaaaacaaagtccaggaaatcttttaccacaccggtaggctcacctttcgtatacatgtgttcataggcgtataaggtatactttttgttataaacgttttcgggagtgtactctaccccattatattttaacacttttaccgaattatcgatatatgctgcatcaatatagccaattgaaccgggggtttgagaaattgcttttcgcaccgctccgttggagtcctgaattattgctttatcggtaaattctttgccatctaagacgaggtcggtgattactttgcgcgaaccggaagattttgcccggtgaataatggtgattttggcgtcattgccgccaacttctttccagttggtaattttaccggtaaagatatctgctaactgttctttagaaaggttatccaccttaacatcaggattgacgatgatcacgaaaggagcaaccgcaacttgatggtcaactaaacctttacccgcagtttcagggtctttttcggcatcgacatcgctattgccgatatctaccgcacctgcaattacctgtctgagtcctgtaaaagagcctcctccagaaacattcacggtaactttgggatttttctccatgtacaaggtagctgcttgtttggctaaaggcaaaagggcggtagaaccggcaagggtgatcttaccttccttggtagtttgcccgttttgcggggtagcttgctcattttttttagcacaacctccagcaaaaagcaaagccaccaccaggatgctgataatcgctacaattccatactttttcatcttttttcctccctggttttaaaattttcttgtctttaatataaccggtaaatgttattttttttcgagcaggaaagttaacaaaagttaaaaaaaggttaaaggtatgtttagcggtccagagtaatttcctgaagccatagatttagagctttttctttaatgatacataatttttaacccattacataatataagcttggtataaaaattaaattgggaaaggggaagaaaaaatgtttaaacacgaaaaagctttattacatgaagtgggagttgaaagaccaaaccccaattatgcggccatgcttcaagaacaattagggggtcctcacggggaactaaaagcggccatgcaatacctttctcaaagcttcaggatcaaagatccggccctgaaagatctattcttagacatcgctgctgaggagttaagtcacatggaaatggtggcagctaccattaatcttttaaatggtcatgagttaaatgccagtaatgctaccgttggcacgattgaagcccacgttttatcagggttaaatcctgtactaactaacgcttcgggtgagctttggacagcggcgtatgttgatgtaactggcgaccttgctgctgatattctttcaaatattgccgctgaacagcgggcaaaggtagtgtatgagtacctgtatcgacagataaacgataaaaaggtgcgggaaacgattgattttctcctgaatcgcgaggaagcccataataccctttttcgggaagcctttaataaattacaggaaaccggctctttaaaagactggggcgtcacccaggattcaaaattatactttgatttatcgacacccggaaaatacttttcactaaatgcggcaaatccgccgaaatttgaaagcccccaataattcaatgaaactactctccctgtaataggggggagtagttttataaaaatgaaatattaaacaaaataatatgaaaatttagactttacaaacaatttctcgtgttttataattagagaaaagcaattaagctaaacattttaccgggagaaaatcccggtttttttatttctaaaagcagtaaatatgatacaataattaatgtgtgatgccgaaaaaagttacataatttttaaaggaggacttttaaatggagatggagagaaagctatccttggaatttgcccgggtaacggaagcggcggcggtagcttctgcccgctggatgggccggggggataagcataaggctgaccaggccgctactgaagcaatgcgggcggtttttgataccatagatattcgcggtgaagtggttatcggcgaaggggaaatggatgaagcgccgatgctttacatcggggaaaaattaggtaccggttatggcccggctttagatattgccgttgatcctctggaagggaccaatcttgtcgccaaaggtttaaatggcgccattgcggtggtggctgctgctcccaaggggtgtcttttaaacgctcccgatatgtacatggaaaaaattgccgttggtccggcagcagcgggtaaaatccaccttgatgctcccgttaaagataacctgaggatagttgccgaaagtctgaaaaaatcggtagccgatttaacggtggtgattttggatcgcccccgccacgaaaaaataattaaagaagtgcgggaggcgggagccagaataatgctgatctccgatggagatgtttcaccggctatagcctgtgcttttgaggattccggggtggatatgatgattggtattggtggagccccggagggagttttagctgccgctgctttaaaatgtctgggcggagagctgatggggaggcttgtgccggaagatgatgagcagatggaacggtgccggaaaatgggtcttgctgatccccggcaaattttaacgttagatgatttggtaaagagcgatgatgtcatttttgcggctaccggaatcaccaacagtaaccttttaaaaggcgtgcggtttacggccaatggagcggccactcatacgttagttgttcgggggaaaaccggtaccgttaggtttattgaagccttgcaccgtttcgataagaagccaatatataatttaataggtttgaatgtttaaagaataaaaaataaaattttaaattttaaaagtagctttcttgaataagctttataaggtttacaccgagcaaataaaagcaggggctttttaagcgaagtccctgctttttgtaaaggagagtaaaaaatattacaagcgggggagtatggaagaatgaatgagcaatggcggcgttttatttcaggggaagaccctgtaagcagcgtagatccgctaatcttgcgttcctggaagaggtgtagagaaaaagtagttgattaccaaagagttattaataacgatatacttcctgcaccgcttttacgagaacgctggcaaaagcaggaagaattactgaaagcagcagaacaggtattgccccatatctaccgcttactgcagggccaaaactatatggttatactttgcgattctgagggatatattttaaaagcaataggcgatcccccgtttctgaataaagctcagaaagtgtacttatcgcctggggctaactggcgggaagatattaaaggaaccaacgccattggtacttctatttctgaaggtacggctgttaaagttttaggctgggaacattatgtccaggaaaaccattttttaaattgctgggctgcaccggtgtacaattctgaaggaaagatggtaggggtgttggacatatccggggaaaacggaaggagtgacaaccgtcttttagaaattgccctcatgggggccaaaataattgagcaaaatctcttattgcaagaattgcagaaaaaggttgttattagccagcaagggcttcaactggcaggtaagatgctgcaggaaggggttattgttattgataaccaagggataattaccgagataaaccaaaagggcgcccagattttgggcaaacggcgagaggaagttataggtaatttgataagtgatgttttgggtagtgctaaaagcttctcgcttagcccaaaggaagaaaagttccaaattaatgcagggcttggggagaaaattggtgacaagaggtttgataccgtttatgcactgaaccgggctgggcaaaatgtgattgaacaacatagatgggtcggcaacagtaccaaatcgaaacaggtgttagaaatagtagcaaaagcagctgcagttaatttgtcggtgctgctacagggagagagcggtacgggaaaagaggtaattgcccgctatattcatcagctcagcgaccggaagaatggtccgtttattgccataaattgtgctgctttgccgcctaatttaattgaaagcgagcttttcggttacgttgaaggagcttttacaggtgctaaaaaaggtggacagcccgggaagtttgaacttgctaatggtggtacgatctttttagacgaaatcagcgatatgccattgaatgttcaagcagcgttattacgtgtacttcaggaacgggaagtttgtcgtatcggagataataaagttagaaaaattgatgttagggtcattgccgcaactcaaaaagatttgcagcagttagtcaatgatgggttatttcgtttagatttatattaccgcttaaaagtcattaccataaacttaccgccactgcgtgaacggaaggaagatttgtatgagctggtaccctattttgttaacaaagcttgtcaaagtatgggtaaaccgcttttgagtgtggaccgagaaatttactcttatttccttgcataccactggccgggaaatgtgagagagctcgaaaactgtatttacagtatggtggcattagctaccggttcgcagctcacagttgccgatttgccggtagaattgcgccagaatttggaatctgttcaagctgatagtagttcacttttggagcaaaagaccaagcttgcgatactggaagcgttaaaacaaacaaatgggaaaattgctccggctgctcgattgttgggaatggggcggaccacactgtaccgcaagctgaaaaaatataacctgctcaaatagaaacagtttgttgggacaaaatgtttcagaaaggaacattttattttgtatttttcggaaagctgtaaatttttatactttataaatatctgaaaattggcatagattttgcaattatactaagttgctaacacaaccacaaaaatttaggagaggaggaatgagagtctcgggagaaactcctcaaattagtaataatttttttaaaaaatcttttttttaaaaaaatcttgaacttaactttatggtcaattatagttagagtagaaagtattttattttacaaggagggtttttatggccggctattgcgggaaagtattgagggttaacctctccaccggtgaaattaaaaaggaaccgctggatttggaggtggccaagaagtttttaggcggtcggggtttgggaagttatattttatccaaagaaatcgaccctgctgtggatccgctatctccggaaaacaaaattatttttgctaccggtccattgaccggatcatcggcgccgacctccggacgctacatggtggtaactaaatctccgcttaccggtactattgccagttccaactccggaggcttttggggggctgaattaaaatttgccggctatgatttaatcattgtagaaggaaaagcggcaaaaccaagctacatatatattaatgatgacaccgttgaaatccgggatgcgcagaattactgggggaaattagtatctgaaaccaccgagcttttacaaaaagaagtgggagatcccaaagcccgggtcttgaccattggtcctgccggggaaaggctttcgcccatagctgccgttatgaacgaaaaataccgggctgcaggtcgttccggtgtaggagcggtaatgggcagcaaaaacttaaaagcaattgtggtaagagggtccggaaaaattgaaccggcggagccggaaaaaaccaaggagctcttatccagacttttaaagaaaattcgagaagatggggttaccggtcagggcttgcccaattatggtaccgcggttctggtaaatattatcaatgaaaacggtattttacccactaacaacttccaaaaatcttacttcccaactgccgatgctatttccggggaaactttatccgaaaaatatttagtgaaaaaagacccctgctaccgttgtccgattgcgtgcggtcgttactgcaaagttgatgatgaagaaggcggcgggccggagtacgaaactatctgggcctttggtgccgattgcggcgttgacgatttagctgccataattaaagccaataacctgtgcaacgaatacggcttagatacgatttccgcaggagcaaccattgcctgcgctatggagctttacgaaaaaggccacattaagaaagaagaattagacggtccggagttaaagtttggttctgccgaagctgtcattgaatggaccaggaagatgggggcgggcgaaggttttggagccaaactggcccttgggtcgtatcggttagccgaatcttacggtgttccggaactttcgatgtcggtgaagaaacaggaattaccggcttatgacccccgtggtgttcagggccatggtctgcagtatgctacttccaaccggggaggctgtcacgtccggggttacctgatttctccggaaattctcggctctccggaaaaaattgaccgctttgctttagaaggaaaagccaactgggccaagctcttccaggacttaacggcggtcattgactcccttggtctttgcctcttcacctcctttgccttaaatgccgatgactaccgggaactctttaactatatcgttggggaaaattacactacggaagatattttaactgccggcgaacgaatctggaatttagagcgggtctttaacttaaaagcgggaatcgatgctaaagaggataccttacccaagcggcttttagaagaacctgtacccgatggaccgtccaaaggacataaacaccgcctggcagaacttttaccggagtattacaaggtacggggttgggacgaaaaaggggtaccaaccgccgaaaagttgcaagctttaggtttataaacaactaaaagcagggacttcccaaacggagtccctgctttcttaataaaggagagaacaaaaaaatatgattttacaatttaaggactaccagatagttctcgaaccccagccggatatccaggaaatatatcttgaattatcaggtttgtgtaatttaaactgccgccactgctatcgcaatagctggagttacaaaggtggactgatggaaaggaaaacctgggagaaagttttggaagatgcaaaagctttacctttactttcgcggattgttttagggggtattggcgaaccgctacttcatccggaaattaaggaaataattactaatataaaagcaatggggcttaaagtaagtattactacgaacggctttcttcttactgaagctatggcccgtgattttgtgaatttaggggttgacgaaatcattgtttccattgatgggtttttgccggaaacttttgcggaaaaccggggggcagatataggtaacttatggagtaatttaaagcaacttaatttaataaagcagcaaaataaaagcagccagccggaaatattagcggagatggtggtaaataagagaaactcccaggagatttttaaacttattcccaggcttttagagtataatattaaagttttgtatgttagccagcttatgccggtagtaaaagaaaaaatagaagacattttttaccagaagtatcccgatgagaagcttttagagtggcgaacattggtagcccgggcttccatgtattccggggtaaaagtcctcttaccggagatggggcttaatacccaccgttcctgccggtttgtggaaggaaaaaaagtagtggtgcggtttgacggtgaagtatctccttgctaccggtttttacacgattcccgggaatacgtttttggacgggaaaaggaaattcgggcagtaagttttgggaatgttaataaagagagcctggcggagatctggacgaaagaggcttttgttaaatttcgttttttggaacatatgaaccactacccttcctgtcctgattgcgaatgggttgacggctgtgatatggtctggaatattgaagaagactgctggggtaataaaccgtcctgtgccgattgcctttgggccaggggattaattttttgcccgtaaagaggaggtgaagcgaatgaaaattgagatccggctttttgcaactttccgggaaggacgctttaaaaaagaagtttgggaccttcccgaaggaacaaaagtaatcgatgttttaaaccgtttagggattaaaccggaagaaatagccatccttttagttaatggtttggatgccgagcctgaccgcgtattaaaagacggtgactatatttccctgttcccaccggtgggaggtggttaagtgttaagtaaaggagaaaaaaatctcctgggtaatatttttcgccgggaaggtattaaggaattatccctggaaacaaccgagagaatttcccgggaaaccggtattgctctacgcgctattgaatattttgccctcgaaaacggggttgtgccccggaagtatgcccgtaatatcggaagttttactttagctgggcagaaaaaacttttagcttccaaagtaatggttgtgggcttgggcggacttggtggctatgttttggaagaactgtgtcgagcaggcgtgggagaaatagtgggggttgatggcgatgcctttgaggaatccaatttaaaccgccagcttttggctacagaaaaaaatcttgggcagaaaaaagccaataaagccagaaaaagggcggcggagatcaatcaaacggtggtggtaagcggttttgtaaccaaggtcgaaaatcttccggaaactgcctggcagggagtagagcttgtctttgattgtttagataatatagaaagtcgtttttacctcgaagaaaaaacaaataaccttggactgcccctggtgcacggagcaataggaggctggtacggccaggtcgggattgtttggcccggaagtaaccttttaaccaagatttaccgggaacggaaaaaaggtatagaacaaaccctggggaaccctccttttactccggcggtggcggcaagtttaatggtagctttggggattaatttgcttctgggaacgttggaaaaagaaagcgtattttacttttttgatttaaaaaatatggagtttgagaaaataagcttttaaaattgtattaccaatcacaaagactgcttaatttacctttttctttttttcctgaaaaaccagtgtgtaaacaaatgtttacagattgacaagttgatttaagcaggagatgcaaggcgtttcaatgatttttgctggtttttataattgggagtgtctaaaaaatagacactccttttttgttgtctgaaattgttgatatttgtcggatttaagcgatttgtgattataataatttattatactgtctaaaaaatagacaatattgtaaaaaaatattataatattctataatatttacactggcaagaattttgcaaaaaatagttcagagcaattatgcccattataaaggagggaattggacttggccattacccgaagagaattcttaaaactatcagctttatccactgctatattaatgactgccgagcttggcttagataatagtaaagcttatgcgcaggcccaaaagtaccggatcaaaactgccaaaaaaactccaaccttgtgtcctttttgcagtgccggctgcggtatgcttgcctataccgataccaaaacgggagaattactttatgtggtcggggatccggaccatccggtaaaccgcggcggtgcgtgcagtaaaggagcttcaatataccagattaggaacattgcgcccggtaaacccaatcccaaaagacttaccaagcctctttatcgggctccggggagcaaagagtttaaagaggttacctgggaatgggcaatttcggaaattgccaaacgaattaaagatacgagggatcggacttttataaaagaggaagacggaataaccgtcatgcgtaccgaccatattgcttgtttgggcggtgcagctctggataacgaagaaacctatcttttacagaaattgatgcgcggacttggggtagtatatattgaacatcaggcccggctctgacacagttctacggttgccggtctggcaccaacctttggtcgtggagctatgaccaatcactggatagatttaaaaaataccgactgtgccttaattattggcgctaacccctttgaaaaccacccggtttcagccaagtggttaatggaagcaaaattaaaacggggagctaaaatcataagtgttgaccccagatttaccagaacttcttcgaaggcagatatttatgctcctttgcgagcggggaccgacattgcctttattggcggcatgattaactatatcttagaaaatgagctgtacgaccacgattatgtcgcaaattataccaacgcttcgtttatagttcacgatgactataaatttaccgatggcttatttagcgggtacgaccccagggagcgtaagtatgatttttccacctgggagtataagaaaaatgaaaagggggaaattgaaaaagaccctaccttaaaacatccgcggacggtatttcaacttttaaagcaacatttttcccgctacactatcgacaaagtatgcgaaattaccgggacacccagagaaatttaccttgaagtcatcaaaacctttgccgaaacttcccagaagggtaagtccggtacgattatgtatgctatgggaggaactcagcacagttgcggttcccaaatagttagaagctatgccatcttacagcttttattgggcaacgtgggtgttcccggaggcggagtaaatgctcttagaggggaatctaacgttcaaggttctactgactttggcttattaagtaataatattacaggttatattaatagtcctattgctcagccagaacataaggacttaaaagcttacttggagagtgaaactccgaaaaccggcttttggagcaataagccgaaattttttataagctatttaaaagcaatgtattatgataaagctaccaaagaaaacgaatttggttatcagtggttccccaaaagacatccgaagaaaaactacacttatatcggcttatttgaaaacctggctaaaggcgaaatagagggtatgttactttttggtcaaaaccccattgtgggcgggccgaactccaaccgggaaagggaagctttaaaaaatcttaaatggatggtagcggtagacctttttatgacggaaacaatgcggttctggacaaaggaagcgggaagtaaccctgaggaagtccaaaccgaagtttttgttttgccggctgctgcgtcctttgaaaagcagggcagcatcacttcttccggccggtggattcagtggcgctggaaagcggtcgaaccgcttggggagtcaaaggctgaccttgatattattcacatgctcgctttggaattaaagaaactttatgccagtagtcaaagaccggaagatgagcctattaaaaatctttactggaattacggtaacactaacgaatgtgatatcgaccgtgtagcccgggagattaatggcatagatcttaccaccggaaaacaggtggaaaactttttaaagcttgctgatgacggcagtaccctttgcggaaactggatcttctcgggcttttatccagaagccggaaacctggcccaaagaagggagttggaggatcccagcggccttggcctttaccccaattggacctatgcctggccgttaaaccggagaatactctacaaccgggcttcggcggacccatcgggcaagccgtggcatccggataaggcggttatctggtgggatgaaagccagaaaaagtgggttggttatgatgttcccgattttaaagcaacaataggtcccgatgatccggcttttgtcaatccctttattatgcaaaccgatggcaaaggctggttattcgtccctcagggcaaattaaaagacggaccgttcccggaacactacgaaccctgggaaagcccggtgcaaaacttgctttcctcggtccaaaacaacccggtaattaaaatttggcggccggaagaacaaagtgatgctcaaaattatccctatatagccacaacctacagggtatccgaacactggcaggcaggggcgatgaccaggaacctgccctggcaggcagaattagttccggaaatgtttgtggaaattggggaagaactggcccgggaactgggggtaaaatccggggacgaagtaatcgttgaaaataaacggggctctatcaaggtaaaagcttatgttaccaaacggatgaaaccgttaatggtaaatggcataaagcggcatcaggtaggtttgccctggcactttggttttgaaggtttagttaccggagaaattgccaataaacttactccttatctgggggatgccaataccatgattcccgaatacaaggggttcctggtcaacgtaaggagggctaaataatgaacggcatgtttattgatacatccctttgtgttggctgccggggctgcatgactgcctgcaaaagctggaacgaattacccggagaaaaaacgacttttaccggaagtttacagagtatgcccgatactacccctaaaacttatacattgattaaattttatgaacgtgaagaaaacgggcggattcgttttgacttttttaaacagcagtgttttcactgcggtgatgcggcttgtgaaaaagcttgtccggaagatgcaatctatcataccaaagaaggggcggtagtgcgggattacgaccggtgtataggctgtgattactgccagagggcgtgcccctttaatatcccgcggattgacactcaaaacaagaaaatgcataaatgcaccttgtgttttgaccggttagaaaacggagaaattccggcttgtgccctgacttgttctccgggagctattaaatacggcaaccgggatgagctgtgggaggcagcccaaaagcggctggcggaggttaaaaaagagtatcccaaggctaatctttatccttccgataaaaatgctttgggaggaaccggggtattttatcttttaattaacgagccggagttctacggtcttccggccgaggcaaaattaaaaactaccttttccctctggcatgacgtggtgagacctttagggaaaattgtgccagggatagcgcttggggctactgttatagcggcggtagctaattcggtaaaaaaacaacgggaggagggacacggtgagtaataaagttttccggtttaataaaacaatgcgtttttttcactggtcgtatattaccttttattttcttttagctattaccggagcttttttatactttgattttcttgattggttaagacccctttttggcggagctcagggggccagaattgttcaccgggtagcagcggtggggctgatcctttcgccgattatttctttccttttaaatcccaaagaaatttgggaaactttaaaatacgcctactcctggaaagcatcggatctaaagttttttggcgagtttatcaaagagttctttgggggtcatgcccattatgaaccccagggtaaatacaatcagggagaaaaattaaacattgttttacaaagtttgggatggcttttatttatcgtcagtggtatagtactatggcgttttgaaagcttttcacccgaagtgggtatgatcgccttaatcggccatgatatagcgtttatctttaccctggcttatgttattggccatgtctacctgtccctcttccatccggttaccagaccggctcttaaagggatgcttactggttacgtggatgaagaatatgctaaaaatcaccatcctttgtggtataatgaggtaaaacaggaaaaacaggttaggggaaaagaaaaaactaaaaccaaagcgctttctcttgaaaaatgataagcgggggcatttactgcccccggttttatctttttagaaaatgggggagaaaatatggatgctaaaaaacttgtaagcactatggaaaagttaattgccgggtttgatgaaaaactcttattaaatatttcgtggaatggaaagttgccagtaacggataatgtagaagtggagtttaatgaagaaaagataatggaatttttaaagagggtaaacttagaattaatttctttggagcttattaaccggaaaattaattttccaggcttaattacgaattttaaagataaaggaagttttctaaagcttttaaaggataatttggaggaagggttttgggagcaatttgccttaaagcaaaaggtaaaaaaagaaattctggccttacattttttgattttaagaagaaaaatgttaagggagttaagtaacgcaatacaaaataaccaatcaaatcaccaaacctgtcctacctgtggtactttaccgggttttgctgcgattacacctaccggagaaagaattcttttttgtttagagtgtcagactcagtggcgttattatcgcttaggctgcccaaaatgtggcaataagttccatgaggatttcatcgaaattcatcccgaaggcaaagaagaaaccccttactttggtgaagtttgcaaaaaatgcggaagctatttaaaaaccaaaaaactaaaaagtaatgaagaaaaaattaatcccaatcttgaggatgtggaaagcctttttctcgattatcttatcccaaagaaaataaattattaaaaaaatttaggaagtttgttaaaataaaagagtaaagggggttttggtatggaagaagaaatcaaaaatgaagtaatcagggcggctaaagacggaaagcttccctgcaaagtagctttggagttagccaaccgcttaaatgttccgcccaaaaaaattggtgatgctgctaatgaactaaaaataaaaatttcagcctgtcagttaggctgttttaaataaacggtgacatcttatgaaagaacttttaaatttaattactccagaagaagcattaaagctcttaaaaagtaattttaaagtgtcgttaaaagctactgaaatagaactttcccaggcttttggcaaaattttagcagagccggtaaaagccctggaaaatatacctccattttctcgctctacggttgatggttatgcggtttttgcggaagacacttttggcgcaacggaaacttttcctgtactattaaagctaaaaggcgaaataggaatgggggaggttccggaatttgctctgggacccggggaagcggtgcgaatttttaccggtggggccctgccggaaggtgccgatagtgtagtgatggtcgagcataccgaactgtttgactccgaaactgtttcggttttaaaaccggtggcaccgggagaaaatgttattgccgcgggagaggattttaaagaaggggaagtggttttggaaaaggggacgagaattcgtcctcaggaacttggggttttggctgcgctgggttacagcaaggttaccgtttataattctttaaaagtaggaattatttctaccggtgatgaactggttccggtggaaaccaagttaaaaccgggacaaattcgggataccaatgcctatcttttggtgggacgaattcttgatttagggatgcaaccggtgtattttggcatagttcccgatagatttgaagagctaattaaagcaattaagaaagccctcctggaaaccgatatcgttcttttatccggcggcacttccatgggggtaaaggatatggtagtggatgctataaatagcctggggactcccggggttttattccatggtcttgccataaagcccggaaaacccaccataggcggaggtatcaacggcaaacctattctcggtcttcccggccatcccgcttctgctttaatggtttttgagcgaattggtgtaccctttttgcgctatctttccgggttaaaaagtagctatcagccccgggtaaaagccaccttaactttaaatcttccttccaaaaccggtcaggaagatttataccgggtaatgttaacccagaaagaacagggctatttagccactccaattttaggcaagtcgggattaataaataccttaacccgggctgatggttatgtaatggtgccgttagatattgaagggctgcatgccggggaagaagtggaagttattttgttttagggggtttagagaaattggccttttatttaaaccaggtaccttttgaagaggcatgggaaaatttcgaaagcgaacttttaaatgttaatttttttcatccccgggaagaagaaattgaaaccgttttggcggtgggacggataacttgtgagccggttctggccaagcgttccaatcctcatttcaatgcctcggcggtggatggttttgccgtcaaggctaaagacaccttttatgcccgggagacaagtccaattttattaaaaatcggtgagtcatgtataagggttgataccggagaccttatccccgaaggatttgatgcggtaattatggtggaagatgtcctttatccagaacctggagtgatttcggtaattaaaccggtaactcccggaacaaatatccgttttcttggggaagactttaatgaggaggaagttttgctaccggcttttgccaaggtgaagcctgctgacattggggcccttctggcgggcggagtaaagacgcttaaagtgttaaaaaaattaaaagctctttttattcctaccggcgatgaaataatcccgtttacagaaacgccagagcccgggcaaattcccgataccaactcttcctttattaaagctgttcttgccgaatacgggtacgaaacttccattcatcctattgtcaaagatgatccggagcttttgtataagacggtaaaggataatttagagaaatacgacgtaataattattaatgccggctcttcggccggacgggacgattatgctgctaaagtgattgaacgtttggggcgggttttagtccatggccttgctaccaaacccggtaagccaaccgttttaggaattgccggaaataaaccggtaatcggacttcctggttttcccttatcggcttatttggtctgtgaaataatcttaaaacctctggcggaaaagtattacaaaaataagtttcacgactatggcaaaattaaagcaaccttaactaaaactttgatatctaccaccggagtagatgattttgtctggggaaaagtgagccgggtagccggcaggtattgttttacacccttatcgcgcggagccagtgtcagctccactcttttaaaagccaatgctttactcaggattcctcgcttttccgaagggtataaagagggaatggaaatcgaagtaacccttaaagaaccaccggcggaagtggaccaatacctgaccgttaccggaagtcatgatcttttactggaccttatagattctttcttacgggaaaaatacggaattaaacttagttcttcacatgttggaagcttaaacggtattgtggcaattgaaaaaaattacgctaagcttgccggagtgcatttattagatccggcaacgggggattataatcaaagttatgtggaaaaaaggctaaaaggttatgttcttataaatttaagtttgcgggaacagggtttaatcgttgcccggggaaaccccaggaaaatttccggtcttgccgatttagtaaaacccggggttacctttgtcaaccggcaaaaaggctccggaacccgggtgtttttggattacctgttaaataaagaaaacatcaacccccgtcagatttccggatatgaccgggaagaatacacccatctggcggtagcggcgaaagtaaaaaatggtcttgccgattgcgggatgggaatttttgctgctgctaaaatctttgacctggattttattccgttaggagaagaacggtatgaccttttgctgcgggaagatactttggaagatccgcaggttaagaaattgttagaggtaataaccagtgaagaatttaaaaaagaagtagaaagaataggcggatataaaactacgttaacaggacaaattgtggggaaaggataggattatggagatagtaaataaaagaaacattattcgttattttgacggacgcctggaagaaaaagaagatttactggtggatgaagcgcctcttaccatttattttaacggggaagaactggtaaccctgctctgtaccccggaataccaggatgaattggccgtaggttttttagcggcggaaggattaatcaatcgccgggaaaacttggagaaaattaccgttgaccgggagcaggggctggtgtacgtggagtataagggaaatgcccggcggggggaactatttttaaaacggtacattactaccggttgcggtaagggaactactttttacaatgctttggacccggtgtctttaaaaccgtaccggggaaacgtgcgggtttctgcagaaagactttttgctttaatgaaagaaatgcagcgccgttccgaactgtaccttactaccggtggggtgcacagtgcggcgttgtgcgatgctgaaaaaattttattgttccgggaagatgtaggtcgccacaatgctgccgataaaattatgggatatgcctttttaaacggcattaatttagaagataaaatctttcttacctccggccgcatttcttcggagataattttaaaagttgccaaaatgggcatcgggatgattgtttcccgctcggccccaacggaactggctcttaagcatgccgaagaattaaatttaaccgtggtgggttttgtccgggcgggccgcttaaatatttataccggcagggaaagaattttattataaaaagaggaaatttggggtctttggtcgaattattattacaaaaaaataagctgctccgagtattttcacctaaagctttaggccatggtgaaaataccaaagggtactaccgggaaaccggggtgcctcccgttttggaaaggagttatcaaagcgcctttttaaaacggggcgcttttaattttaggaggctaaagaaatgcttgattcttttaaccgggaaataaactatttgcggatttcggttaccgacaaatgtaaccttaactgtttttactgtaaacccggaaattttcaagaattttcgccgggagatattttaacctttgaggaaattttagaagtagtccgggcctttttacccttgggtttaaaaaaagtacggattaccggcggcgagccattggttagaaaaaatcttttatatttaattgaaaatattgcagctttaccgggtattgatgatttagccctcactaccaacggtatcttgtttccccgctacgctcgagatttaaaaagtgctgggctttcgcgggtaaactttagccttgatagcttgaatccggacaaatttcgctcgattaccggcggcggcgagttaaaaaatgtgctggaagccattaatcttgccctggaattggaccttactccggtaaaaataaatacggttttattacgaggtattaatttagacgaaatcgatgctttcgtggattttatctttcggtatccggtgcactggcggtttattgagcttatgccattaaatgaccgggaaaagtggcagcggcaatttgtttcggtgaaagaaattgtggaaatcatctcagccaagtacaaactaattccggggaaaacggtgggtggcgcagggccggcccgctattatgaagtgccggaagcattgggaacgattggggtaatttctcccctgtccaatcatttttgcgaatactgtaatcgcctcaggcttacctctaccggtaagttaaggctttgtttggccaaaaaccaggaagttgatataaaaagccttttacggtccgggatttcgcaagaggagttgaccggagttttgcgggaggcaattttaagaaaacccagggcccatgagtttggcgataaggactttttaggaacaatggccaacataggaggttaatgcgatggagcttacccactttaatgaagaaggacgggcgcgaatggtagaggtgaccgaaaagcaagaaacggtacggacagcggtagctgccggagaaatcaccatgcgcccggaaactttagaattgattttagataaaaaggtcgctaaaggggacgtgctggcggtagcgcaggtggccgggataatggcggccaaaaaaaccggtgatttaattccgatgtgccaccctttaaacttaaccggagtggacataagttttactattaaagtgcccgataccattgaagcaaaagctaaagttacctgtgtgggcaaaaccggggttgagatggaagcgttaactgccgtttccgtgacccttcttactatctatgatatggtgaaagccgtagaaaaaggcatggtgataaaaaatatccggcttttagagaaaaccggtggtaagagcggcgattacagaagggaggaataaaaatgggcaaggtagtagcggtaaatatcagcgaaaaaaaaggaatgcgcaaaaaaaatattgagcgggcatatttaagggaaaaccacggcattgaaggggatgcccatgccggggattggcaccggcaggtgagtttgctggccgtcgaaagcattcaaaaaatgcgggatttaggccttaaggttaatcccggggattttgccgaaaatatcactaccgaaggggtggatttattaagcctatcaattgggactaaagtgaaaattggcgaggccttaacggaagttacgcaaataggtaaagtctgtcacacccgctgtgctatctactatcaggccggggactgtgtcatgccccgggaaggtatttttgttaaagtattaaaaggcggggaagttaaggttggggatccggtggaggtaataagccatgattaaagtgggcgttcttactttaagcgataagggttctcggggagagcgtgaggataaaagcggccaggtaatcaaggaaatggtccgggagattgatggggtggtggtgaagtatgaagttatccccgatgagtacgaattaattgttaaaactttaatttcctggtgcgatgaagaaaagttagatttaatccttaccaccggtggcaccggcttatctccccgggatgtgactccagaagctactaaagacgtaattacccgggaagtgccgggaattcccgaagcgatgcgcatggcttctctggccaaaaccaaccgggccatgctcagccgggcggtagcgggtacccggggtggcacgttaatcatcaaccttcccggtagtcccaaaggagtgcgggaaaacctggaagtagtcttaccggtaatcccccatgccctggaaatcctgcaggcccggggcggcgaatgcggccaaccctgaacaccgattgcagggacggttctttttttaggcgtttagacgcaaatatcggaaccgtccctgtttttgctgtttggacgtttaaaattgggaccggcattgtgtataaaacaggtaatcctgggaaaagatttattaatggattgacgtaaggatatacggttgaaaaagcaggtataaggaataaaaaacgaaagattggaaaaaataatccagaaaaattggcataaatcaaggaatatgcccaaaatattccttaattaaaaatttgcttttctccggttctctttatattataatacttggtattagcactctatcgaagtgagtgctaacaatacataagaaaaaaattaatctaaaggaggggttatcgtgttcagaccgcttcatgacagggttttggtgaaaccacttcccaccgaagaggtgaccaagagcgggattgtaattcctgacactgccaaagaaaaaccccagcaaggggaagtaaaagccgtgggttccggccggattttagaaaacggcgagcgggtacccatggaagtaaaagttggtgaccgggtattttacagcaagtatgccggtaccgaagtgaaaattgatggtgaagagtatttaatcttacgggaaagcgatatcctcgggattttagaataaaaaacacaaaaaaaggaggggtataaatggctggcaaacaaatattatttagagaagatgcccggagagctttagaaagaggcgtaaacgctctggcagatgcggtaaaggttactcttggtccgaaaggccgtaacgttgttttagaaaagaaatttggttcaccgcaaattattaacgacggtgtttccattgctcgggaaattgaacttgctgaccctgtagaaaacatgggagcgcagcttgtaaaagaagttgctaccaaaaccaacgatgtagccggtgacggtactaccaccgctaccgttttggctcaggctatcattcgggaaggcttaaagaacgttactgccggtgccaacccgatgattttacggaaaggtattgaaaaagctgttgccaaagcggtagaagaaattaaggctattgccaagccggtagaaacttccgaagctatcgcccaggttgctgcaatttctgctaacgacgaggaaatcggtaagctaattgctgaagcaatggaaaaagtgggtaaagacggggttatcaccgtagaagagtcccagggtcttggcactaccttagaagtagttgaaggtatgagctttgaccggggttacatttctccttacatgattaccgaccccgataagatggaagctattttaaacgatccttacatcctcatcaccgataagaagatttccgcgattgctgacttactgccgattttagaaaaagttgtgcaaaccggtaagccccttttaatcattgctgaagatgtcgaaggggaagctctcgctaccctggttgtgaacaaactgcgcggtaccttgacctgtgtcgctgtaaaagctcccggctttggtgaccggagaaaggctatgcttgaagatatcgccatcctcaccaacggccaggtggtaagcgaagagcttggctttaagctcgaaaatgctaccctttcgatgctcggtcgggctaagcaagtccgggttaagaaagaagaaaccatcattgttggtggtcaaggttctccggaagctattgaaaagcggattgctcaaatcaagaagcaaatcgaagaaaccacttccgattttgaccgggaaaaattacaggagcgtctggctaagcttgccggtggcgtagcggtaatccaggtaggtgctgctaccgaaaccgaaatgaaagaaaagaaactccgcattgaagacgctttgaacgctacccgggcagcggtggaagaaggtattgtagctggtggtggcacaacctacatccacatcattaaggctttggaagagcttgaaaagaccgctaccggcgatgaaagaaccggtatcgccattgtccggaaagctttagaagaacccttaaagcaaattgctattaacgctggcttagagggttcggtcatcgttgaaaaggttaagaccttaccggtaggccatggcttcaacgctctaaccgaagaatatgttgacatgatagctgctggtattgttgacccggctaaggtcacccggagtgctttacaaaacgctgcctccgttgctgctatgctcctcaccacggaagctttggtggctgaaaagccggaaaaagaaaagaaaggccctgacatgcccaacatggacatgatgtaaaaccttataaccggagcgtaaaggctccggtttttttatggattaaaaacataatagttgacaggattagtaggaattaatataatgggtttagaaggacaatactaaaatgaggtgattttaatgcgaatttatgaggatattacccagcttatcggcaagaccccgttattgaaattaaaaagagttaccagaggtgtgaaagcaacagttgtggccaagcttgagtattttaacccgggaggtagtgttaaggaccgtatcgcgtttaacatgattaaagctgctgaagaacaggggcttttagataaggataccgtcattattgagcctacttctggcaataccgggattggccttgcgatggtggccgcagcccggggttatcgtttaattattaccatgcccgaaaccatgagtgtggagcggcgaatgcttttaaaagcatacggggcggaaatagttctgactcccggagagcttgggatgaccggtgcggtaaacaaagctctggaactggctaaagaatttcccaaagcttttattccgcaacagtttgaaaacccggctaatccggaaatccaccggaaaacaacggcaatagaaatctgggaagatactgatggtcaggtggatattgtggttggtggtgttgggaccggaggtaccattaccggagtaggagaggttcttaaagccaaaaaaccggaagtaaaaattatagcggtggagccggcagattcaccggtattatcgggaggaaaacccggccctcataaaattcagggaattggtgcgggttttgtacctaaagtatttaacagggacgtggtggatgagattattcaggtagaaagtgatgatgcttttgctatggctaaaaaaattgcaaaagaagaaggggtactggtggggatttcttccggtgcggctctctgggcagcgttagaagtggccaaaagaccggaaaatgaagggaaacttatcgtggttgtcttacccgataccggcgaacgttacctgtccacacccctgtttagctaaccctcaagctttcaaagagggggctctaagatggagtgtgatatcattactactgattacggttatgtagccattgcagtttcggagaagggggtttatgccgtttcccttcctaaagctactccgaaagctgccttagaggaaatcggcgtagaggtaaatcctgtaaaatccgaattattttgtcgaactgccgaattattaaagcgctattatgccggggagaaagtggatttttcttccttgccccttgatataagctgggcttcgccttttgcccgcaaagtctatgaaaagcttcgaaaaattccctacggggcaaccgtttcctatggtgaattagcaggtctttcgggaaacccgaaagcggcccgggcggtaggacgggccatggccaccaacaaaattccggtaataatcccctgacatcgagtcctggctgccggcggcggcctgggaggatttgccgggggactatctttaaaagaaaaaatgcttaaaatggaaaagcaggcgttataacctgctttttatctttctttttctaaatttagctggttatatttttgcaagtcggcaactctaattttgtaatcaacaatagtgggcttaaaaatggggaatggtaatactccatccactaaatttctcataaacgtagcggttccaacaagaaaccagataaaaataaactctcctgatatcccagccggaatttgacattcctttgcctcctttggctctttttttaaatattcgacaaaaagataaatttaccaagaaaatccgctgctgaagggcccgacttttaagtctgggaatgaaagcggctttagattttgctataatggaagcatgaaacgcaccaacgtcgtccgggttcttccagataaactgcagaagcaagttctggagaccattggggaccgctgtgctgccctctggaacgccgtccagtacaggtgcaggcaagcgttcttcaagggagaatctgtgccctcctatgccgccttatgctccgagttcaaggagcacccagcatataaagccctgcccgctcacatggggcaggagatcatcaaaaaagcaaggaaggcgtgggactcctactttgcctgcctgcggttgtaccggaaaggcgaactggagaagccgccgcacataccccgctactggaaggaccgccgcacgggaaagcgcatattccgcgtcattcccgtcaaggcacctacgtcctactccctggatgctcgttatctctccctcacactgccgcaggacctccggaaggggcggggagatcgcttggtcctgcgcacgaagggtgtcctgcgcttccacggcagacctaaaaccctggagcttaaatatgacccggtaaaaatccgctggtatgcccatcaggtagtggaggtgccggagccagcaagaaaagcccggcccgaaaagcatgccgccatcgacctgggtgtgagggtcctggtcgccttagccgtcgaaggactcaaccgccaattccttttctccgcccgcgaagtcatcaaggacttcctctactggaccaatcagattgcaggggagcagtcgaggctcaaccgggcaggaaggaagacctccaggaggctgaagaggctttatcagctccgtgcccgcaggctcaggcacgcctttgttgctttggctgcaaaaattgtccgcattcttaaacggcttcgtgtaaccacgctatttctcgaagacctgagaggcattcgggagaccatggacttcgggccgaagaaccttctggtgcacaacttctgggccttccgcatgttgaggaaccttatcgaagctgcctgcactcggaccgggataagggtagtgccgatggagccgcgagggacctcttcccggtgtgccgtctgcggttcttctgtcaggcgacctgtgcggcataaagcggtgtgcgagaaatgcggtcgcgtctggcacgccgatgccaacgcggcattaaacataatccttcagggctcctcgaaggagcacggggcggaggctacgcccttaaagccgcttgccttccggtggaaccgccaccggtgggtaagccgcttcgaatctgccgccggtacgccctctggggcgacgagcggcagccggatggcggcgtaagccgcctgaaggaatccccgggctttagccctggggtggaagtcaacttgtggtaaaataaaaatatctggattgattgagcttgccgaccagcgactttatcaagcccaaaatacttgaagaaatcagttatatgttaattcaggaggcatcctaaaatgaattgtccgaagtgtggaactgaaggtattaaagtttttgccgaaacggtgtttaatcttttaaaagatgaggaaaaagaacggtttcaggatggcttatactttgcctgtaccaatccttcttgtccggtagcttacttcggggaaaaaacttttgaggtagatttaataaaaactactctctggtataaagatgagggcgatgacgtttatctatgctactgcaataaagtttcccgcggggaaatcaagaaagctttcaggcaggttggtccggacttaaaggcaattctggccctaacgggagcctgtggcggtggaaaatgccgcaccgaaaacccccttggccgttgttgtcattcggtaatagagcaatatgtggaagaattaaaaaccttttcttaacgtaaatctttttgcccggtttttagtgggtaaaagcttgacataaaaatttatttagtaaataatttataacgtaaaatatttataaactaaaaaaggagttgatgaatattaacgaagaactaaaacaaaagcttaccgaagagctggtgcgtacggtgattcagtttaaaaaaggggacggatttcacgggcaacgttttgggattaaaaaaagtgaattaatcttacttgccaccatgcgggagatgtgcggtgaaggcattgatggagtaaaagtttcagatctaagccagcggcttaatatcactccggcagcggtaacccatatgttaaattccctggaagaagggggatatattgaacgccttcgcgacgcaaaagaccggcgcatagtcattgtaagaccctcggcaaaagggaaggaaattttagaacaggggaaaaaagagattctaaaaagattttctggcttggtggaatatttaggagaaaaggacaccagcgagttaatcaggcttttaaataaagcaagctattactttagagaggtggcaagataaaatggaccagaattccagaagaaacattttactaattggtttaatcctcgggatgtttttttcagcactggaccaaacggtggtcggcactgcaatgccgcggattataggagagctcggggggcttgatattttatcctgggttactactgcatacatgttaagttctaccacctttgtgcctatagctggaaaacttgccgatatctacggccggcggataatgtatgtatctggccttggcctttttatgctgggctccgcactctgtggaaccagtgaaaatatgacccagcttattatttaccgcggtcttcagggcattggtggaggaatcttgatgcccatggctatgacgattgtaggcgacgtttttcctccggataaacggggcaaatggcagggggtaatgggggctttatttggattgtcatcaattgtaggtccctcccttgggggctggattgttgaccatacctcctggcgctgggtattttatattaacttacctgtaggcattttagcagcaattaccgtatttattggcttaagtggggaaaaacggcttaaagcagaagctcctattgactttgccggggctttaaccatgattattgcggtggcatctcttttacttggcttaagtttgggaggtaaagaatatccctggaattcctggcaaattatcggtctgtttgctacttccctggtatttttattgattttctttagagtggagaagactgccagggagccgattttaagcctggacctttttaaaaaccggatttttaccgtagccaacctggtaggttttttaatgggttttggcatgtttggggcaattatgtttttaccgttattcatgcagggggttctggggatttccgctaccaattcgggcaatacaatgattcccatgatgtttgctatggtctttaccagtattttgggcggacaattggtttcgaaagtcggtttcaggaatttattgattaccggaatggctttaatgacattaggcttttatttgctaagtactatgaccgttgacaccacccggttagtggtaactttgtacattatagttctgggattaggaatgggactggtgatgccgaccctgactattgccgttcagtacgctttccccttagaacagcggggagttgcaacgtcggcgacccagttttttagaagtatcggcgggacttttggtgtaaccatttttggggtagttttaaatcaccgctccatcgaacttttaaagaaagactttttgccggtagtgcaaaaaatcccggggcttgcaacggggccctttgctaattttttggaaaaagccaaaaccgatccccagggtttgttcaataccttacttcggccggaagtactggaaaaaataccacctcagctcaaagaaattatcgtaccacctttaaagcatgctttagctgaatccatccattatgtattttgggtggcaatgtttataattgtttttggcatttttctcagctttttcatggaaaatattaaggttgaaaagcaaccaggaggaattatctctaaagaaaaaccggtggaaagtggagcaaaataactggaaatgattaaaagcctcccgcaaaaccggggggcttattaacatctaatgggggaggttatactgttggaaaaagcggtaaaatcggcgaaaccaaatttaggcgtgcttttactcttatctatgggacatttggttaccgatatggctcagggagctttaccggctttattaccaatattaaaacaggcttttgctttaaactatgctaaaaccagtcttttagtattaatgtcaaatatagcatcgtccgttattcaacctttttttggttacattgccgataggcgtcccgcccggtggttattgcctttagggtgtttgctggccggagttggtgtagcggtcaccggccgtatgccctggttttctttactgttaattgtagttacaattgcaagcgttggtgttgcggcttatcaccctgaaggctcccgcgtagccaacctggccagcggtgtgcgcaagggaaggggaatggctgtattttcggtgggtggcaatttaggttttggtttgggttcgatatatatggcctggcttttaagcaaagggggcttaaaggcaacggttttcttccttctgccaagccttttaatagcggtcctgtttttgttttcctggcctcgccttacttctcttcgggacgaagtggtggagaaaaaagcaaaaggaaatggtcagggatccgggcaggagataaaggctgaaagtaaaaaaagaaccattgctgcttttttccttcttcttttatacattgtttttcgtacctggatgcatgcgggtctttatacgtacgtgccattgtattataccgattatttaaaaggggatccccatttagcaggttacattgtttcggtatttttacttgctggtgccgttggtacattgctgggaggaccacttacggatattttaggggcgccgaaggtaatggccggttctatggcattactaattccgctaattttcttcttttcccgtactaacaacggttttgtctactttgttttacttgccttggttggggcaactttaatcagtaccttttcgaccacggtggtgctcgggcagcaacttataccccacagaaaaggacttgccagcggctttacaatgggttttggtgtaggcatgggaggagtgggagtaactttacttggggtgcttgctgaccacctgggagtgccggcggtatttcatgttttaaacatcctggccgtaggaggatttgtcctggccttaatacttatacggtattttccctggagttcgaaaactatggagtagttatttatttgaatgattcgtaacagcaggaaggtgaagccgttagatgaattctaatatctttgagcttgaataccgaattccttattacgatgtagactatcaaaagagaaccctaatcaccagcctcatcaattattttaacgatatagcctttgtccaaagcgaaaacttaggaggaattgcttatttaacgcaaaataatctcggatgggttctgatgaactgggatataaaagtagatagatatccaaggtttaatgaaagagtattagtaagaacagccccgcattctttcaataaattttttgcctatagatggtttgaaatatatgataaaaatggaatcaaaattgccaaggccaattcccggtggcttctaattaataccgaaaaaagaaggccggtaaaaattaacgactatctgtacgggatatatggcgtgagttatgaaaataataatattctgccgattgaagaaccacaaaagcttttgagtattgatattgaaaagcagtttgaggtaaggtacagtgacctggactctaatggtcatgtcaataatgtaaaatatgtggtatgggccttagatactgtgcctctggaaattatctcaaattatagtctccaaaggcttaaagttaaatacgagaaagaagtaacatatggtaaaactgtaagagtattaaccggaattctttctgaacagaaaaccattgtaagtctccataagattgtagatgaagatgaaacggaactatgctttttggaaagtgtctggtttttaaatgagaaattgagctaacgaacttcaagcttgataaacctttcttcggacataaaatcacctgctttttaataaaaaattaaaactataaaattatttgtcaggaaaagtggaatcaaaccacctccttttgggcaggataagcccggaggtggtatttttgcaaaataaaaaaattgaaattttactaaaaacaattgagttattaaaggcagaactggctcaattaatagatgaggtagcggaattaaccaatcccgaagtggtaaagaaaagtcaggagttagacaggattttaatagaatattataagcttctaaaaagtacgaataaagaaaatacttaaaagataagcccggttttacgggctttttaagattatcctttgcggggtagctggaaaagatgagattagcttttttgaattagttgtactaacaagatattgttagattttaggactgctggctatggcatttttattattactttttctgcacttttaccttgccaaactttgtacttttattttgccataaacacaatggaaatttataatgttactaactcatgagttactaacttttaatttagtaactcataagttagcagagatgaatttaatgataattttgtgaacttgcaaataagtctggcacctatttttctaaataacttagcatagaagacagttgcagagtattttagggaagtcaaaaaattttttgcaatatatcactgtattttagcaaagaaaaaaataaatttaaactggtcgttataaatcggtgaaagagcaaagcctccagttaatgctctgggggcttttgtgtgtatatggtatgtttgccgtcgaaaggttgaaagtttcgaaaccggtttggttgaaaaaactcaaatatttgggtcaaaatgaaggtaaataacacatagacggcgaaatatttaactctacccttcgagtttaaagcctccaatttaaattaactcagtaaagagaaaaggagaataaagatgatacctttaagagatgtaaacccgagccgaaaatttccggtgatgacaattttaataatcctggccaatgtgcttgtatttatttttcaaatttcacttccccgggagacgagcgagctttttttgcatacctttggttttactcccctgcgcctgaccgaaggattaagacaaggcctattgtcagagataatctggagtggagtaaccctctttaccagtatgtttttacatggaagctttatacatcttattagcaatatgtgggctctctggctttttggggataatgtggaagaacgcatggggcacttaaaatttttattgttttattttttaagcgggattgtagcaatgacagcgcattacgtatttaattttgcttcggacattgttgcagttggggcttcgggagcaattgccggagtgatgggggcttactttgtcctttttcccttggctaaaattgtgactttattttttttaatttttatcccaatttttattgacgttccggctttcatttatattggcttgtggtatatctcgcagctttccaatggcatcttaactttatttggcccagtttttgggtttgggatagcatggtgggcccatatcggaggttttttatttgggatattagttggtccaaggtataaacggcgaaaaagaactatttatttcgacaattattttattgtttaggaaattattctttgattcttactgtggaactgcagtaaaatttgaggaagtgcttataaagtatttggcgtaaatacgccaataagaggaaagaaataaaataccaagaaatatttagcaaattattgatatataattttaatcagcaatagacagcaataacgtatattttttaaaaataactactcttgcacaaaagtcagagaaggtcaataattataagtggaaggtcaaggaaagttaaaataaaaataaaacctaaaaatctatgacagggggtggtagccatgctcatgagaaaatttgatccgttcagagaagtgttagatttaaatcgcctgtttgccgaagcctttgcaccgattagtagaggtgtatcaatcccaagggtagatattcttgatgaaggcgatgaaatattagttaaggcagaactccctggcatagaagataagaaccagattgagctgtatgtccaaaacgatcatctaattattaaaggacaggttaaagatgaaatagaagcaagaaacgataaattctatcgcaaggaaatatttacaggcagctttgagcgagtagtgtacttgccggtagaagtagaacctgccaaagcaactgctgaatataaaaacggcattttaaacatcaggctcaagaaggcacaggataatctgcgaggatttaaagtggatatccaataatcctcctctccccgaagttttaaggcttcggggttttttttacttatttagtttttgtagcttaaaaattagaagaataagtattactttttgtgtaattttataagattaccaagctagttaatctccaattgaggtagtaaatcggtgatttttttgttcttaatttgaatccgaacttaaaactggcagaaatcatggagtttgataaccacttttatgcagaagtccaggaagtagacagcaaaaaatacgctatggagttaatagtggataaaattactggagcagtttctccggaaatgggccctaatatgatgtggaacactaaatatggtcatatggggcgaatgatgggctgggcttataacacatccacaaaaaatcgtatcaccgctgaacaagctttgcagcttgcccagcaatacctggacaaaaacttacccggcgtcaaagcagtagaacctcatgaattttacggttattatacgcttcatactgaaaaagatgggaaaattactggtatgttaagtgtcaacggtgttaacggaagtatctggtatcactcgtggcatgggtagtttttgggtatggaagaaaatgagtaggtagaaaaaagggataagtagcataagtccttcattttcagggctttgcacttatccctttactattaaaccagacaaagcctggattactttgaacaggtttgcatggtataggaaaacaggttagttttagttcgtattatttcctacacttccccttttagcccataacatctactaaccaattccattccctgcattctggctccttcttcaataccctttctaattacttctgcggcaaagcttttgcttccattttttaccgattttatcagattcagaatgcttttacttgggcggataaaggcagtagttgtaatcaatctctgttaattcgccaatttacaaaaagtgtgtagttcttagcaatagttatcttttatgcggcatattttttaagctcaccggcaatcttagatgctctgccttcagagcataaaggaaaattatttattttttattactttagtttacttttctggaggttatattttatggaaaaagcatcgttagtagctaagtttgttgtagcgttcaagctgattaacctaatttagcttgtggttagtttacttcaagttaatacaaaatccctgtcactagtgacactgcaaataaaaaataaaagaggcttcggaaaacgcagaaccctttttttaatgttaatttattgttttgttaataacgttttggtgttacaaatgcagtaggctgcttgtccccgaccctggcctttaaactggctttggccttgtccttcactttttccagcattattatcattgccgtaagcattgccaccgacagtggttttgttgatgttagctgttactcgtacggtcatctgggaataaattaggtactaattattttgatcgaaaggtgtcaacaacttcgtataagctcatgaaccgccgtataccgaacggtacgtacggtttgtaagaggacgggggttaatcacctcctcttactcgatttatgcgttcataccttcaaactctttgttcttcattaatggaaatggtataattttcataaagaatattctgaaaataaaaataatggttcaaggagggtccaaatgtttattaccgaaaaccaacttgatgaatgggtgcggagcaataagggtgaagcgcaaggcaccatcgttgaactgatagggcgtcttgtcgctgcgtcatgtcctaggcctcgagagcgccgctttcattggaaggacagtatcggccagcatggcccggatggggtgttggatactgatcttgactttgagccgtttgtccccaaaggaaaatcattttgggaaattggaaccggcttagggacccgcgataaagccacttctgactataaaaaactcactgaaaatgtgcctgaaaacattcggcgcgaaagcaccttcatctttgtgacgccactttccggacagagagagtgggaatatacatggaaaaaggacgctcaggcagcctggcttgaggaccgccgcacgaaaggtgaatggaaagatgttcgtgtcattgatggaacgaaactgatcgattggttgcgtcagttcccggctatagaacggtggcttgcgcgcaaaatgggtctaccggcacagcaaatcgacacacccgaagagcggtgggaagtgctccgaacattcggtggacttccactcacgccccaagtttttcttctaaacagagaagacgcttacaataaactcaaagaggtatttactgggaaaattcaacggcttaaactacaaacacacttccctgaccaaatagtcgacttcgttgccgcttgcgtggcgactcttgacgaggagacacgcacagatgttgccggtcggtgtttggtaatctcgggcatagaagcctggaatgcaatatgtgagcaatatagaaaccacatcttgatagccgcacctactatcgatttatccgggcatgagggtgtgatactgcttgagaaagctcggagagccggtcattctgtcatatatggtggtctctctgggggcatcccggaggaggatgctgttttccttcctcagccaaaggtctatcagctcagtaaggcgcttgaggaggccggttacaacgaagaacgggctaggctccttgctcagaaaagcggtggcaatctcagtacattcctgaagcttcttcaaaacctttctttgacgccagaatgggctcaatggcccgacgctgcagatctggttatcgctgtgttactcggagcgtggaacgaaaagtacgaagctgatcgcagggttgcggagaccctatctggaaaaccctatgagcaatggatagcaaagatacgtgaacttgcgcttcgtccaaacactcctttaacatatcaagatggtatatggaagtttattgctcgttatgaaggatggtatgcgctgggacctcgggtttttgacgagcacttggatcgcttgcgaagtgcaatggtgactgttctgcgtgagaaggatcctaagtttgatttgcctaccgacaagcgatatgctgcacaaatctatggaaaagtccttgctcactctcaattgctgcgtaatggcttggcagagtctttggcccttcttggtaatcaccctggggcgctgacttctgcttcgtttggaaaagctgaggcaacggcaattctcgcggcccgcgagatcttgagtgacgcggactgggtgctgtgggcgagcttgaacgatgtgctgccattgctggcagaggctgcacctaatgaatttttggatgcggttgaagcagctttacgtaaaactccgtgtccgtttgacgagctgtttgcccaagaaacctctggaataaccagtgccaactacatgacaggggtactgtgggcgctggagaccctggcttgggatcccgaccaccttatccgggtggtatgcatcctaggggcacttgccgcacgcgatccagggggtacctgggcgaaccgaccagccaattctctcactacgattttcttaccctggctaccccagacctgcgcatctgttgcaaaacgtcgtacggctgttgctactctgttcaatgaaaattcagatgttgcatggaaagttttgttgagtctactcccggagtcgcactcagtatcgttcggtacacgaaagcctacgtggaggaaaacgatccctgataattggccaaaaggcgttacatacgccgagtactgggaacaggttaagggttacgcagagatggctgtcaaagttgccgagggtaatgtccaaaggcttgttgaactgatagcgcggctgccggatttgccgccctctgcttgtgatcagcttttgacgcaccttgaatcggaggctattctggcgctcccagaaaccgaccgactgcacttatggaatgcgcttgctgatctggttactaaacacagaaagtttgccgatactgactgggcgatggaatctcgtcaggttgatagaattgaggccattgctaaacgacttgccccgaaatcacctgctcttcttcacaaacggctgttcagcgagcgtgatttcgatctatacgaagagaagggcgattttgaacagcaggtagagcagttggagaggcgccgtcagcaagcagtgcaagagatcgctgaaacaggtggctcacaggcggtcattgattttgccgcgtcggttcagtcgccttggcgtgtagggttttcattcggatgcgttgcaactgttgacgctgacagcgcaatattgcctgatatgctccatactgaacggagggatcttgcgcagtttgtaggcgggtttgtacgaggtagattgcacagccaaggttgggcgtgggttgacaaaatagataccagcaattggacgcctgaccagattgggcaatttctctccaacttaccgtttgtcccagagacttggaaacgttcggcgtgtcttcttggcgacgacgaattgccatattggaagaaaacagttgcgaacccgtatgagacacagactggacttgaacttgccgttgataagctgattgagtatgacaggccgtttgccgcgattcgatgcttatacagaatgctggtggacaagcagcctcttgatagcacaagggctctttccgccttgtttgcggcgctagattcatctgaaagcgcgagcgcaaacgacacttacaagatcgtagagatcataaaggctttgcaaaacgacccaaagacgaatcaggacgatctcttccgagtcgaatgggcctatctgcctttgttagagcacaaccaggatgcctcgcctaaattgttggaacgccgattggcaagcgatcctgatttcttctgcgaagtgattcgcttggtttttccgtcaaaaaatgaagattgctcaactcatgaaccaacggagcaaaacaaaaacatttcagccaatgccttgcgtctcctgtggaattggaaaacgcctcctggtactcgtgcagacggttcttacgatggtgatgcgctaattgcttggctggatgtggtgaaaagaaaatgttctgaaactgggcacttggagattgcattaaaaaaggtcggacacgtgctcgtgtatgcgcctcctgatcctgacgggttgtggattcatcggtctgctgctgcggttcttaattcggaagattcagaagagatgcgtgttggatttagaatcgagctgtttaactctcgggggatgcattgggtggacccatcaggaaaatccgagaggaaactggcagccaaatatcgcaagcaggctgaggaaattgaggcggcaggttactaccgtcttgcgagcacactaaaggaactagcaaaagagtacgaccgtgaagcagaacgcattttatcccgacaactttctgaagagtgaggtatagcctgtgcatccattcacccaatcagttgttgaagacgccgctttcgcctttttttgctccttaaatggaatggacaaaaatgtacgacatgataacgttaactagatagggcagagtgaggtggcagcaaggaaaaattttagtaccgaagagacactggctatcatagcagaagccgaaaagctcttttgttaccaaaattgcagtgtgccgcaaatatgggactgtcaaaagcaccattgagtactggaagaagcattttcttgaattaataacggtaatgatttatcatcggaactggctaacttgagaatagagaaagtaatgctttgctccatcatagtgctatgaacttacaaattaatttggcatccatttttcagaataaaatagcatagaagtaggccatataatctgcaaaaattgcaaaatattttaggaaagcacaaaaactttttgcaaaatatcatgttctatggtcaaaggctcaactttatagctctgggtaatttggaccagaggcttattctggtttaaggtaagtttatctaaaagatgcggaaggccagagagaattaagataaatggatttttcgaatccatgctaaagttaaagagaataattgtatctcaaaggaaaaggtctttagccatttgtatctcgtctaagataaaaactggagtaatcattctttcccgaaaaaaacctgaggggaaaacattctttctatcccggcgggcatattcacgatgggcatattcacggactgatatcttaaaatcgtaaaaaatcatcagaacaaatcatcccaaacattttgcaaaatttatagcaatttgtttggggtttaaaaatttttttgactgttctattttgaaaaattttatgaggatttggtaaaggtaatttgataaagaacagcaataagtcgtgctaagaaaaaaatatatgtggtaacttctatagaaccggaagacttaaatgtagaaaatagcaaaaataatggtccaaaattgctgaaaaaatatctacagtatgtaagagaaatttccaatggcaatagagatgcagcaaatgatatattaaagagcttacttgatacaaatgtattacgagacaagattaagccatttgatagcggatttgaagaagaagtatataatgccttggtgaagagaggttatattgttgacaatcaggtgggggttgcaggctacaaaattgatttagcaatctatgatcctatccagtctaaatatgttttgggtatagagtgtgatggtgcggcttatcatagttcaaaaaatgctcgagaaagagatatacatcggcagagatttttagaatcaaaaggttggaagatatatagaatctggagtagagattggtgggaaaatccgcaaaatgaaatagagaaaattgagaagtatttaaatgctcttggttttaataaaccagctaaaatgaattgggcttaaaaattaacgcacagcaggtaaagatatatttttggcgaataacagtattgattctaaaattaagggtgaggttaatggcagtggcaactgaaaaaataactttagcgcagttagagacccatctttttaaagcagcagatattttgcggggaaaaatggatgcttccgaatacaaggaatacatctttggtatgctttttttaaaatatacctcagatgtttttgctgccaagaaattagagctggaaaacatgtataaaaacttaggcttttctgatgaacaaattaaagaattaacggaagaccccaattcatacgatattttttatgtacctccaaaagcccgctgggagtacatacttaacttaaaagaggacgtaggaaaccagttgaataaagcgctttctgctttagaggaagcaaatcctgagttagatggggttttaaagcatattgatttcaacgctaccaaaggaaaaataaagcttaaagaccagcagttaattgaccttatccatcacttcaataaatacactctgactccggaaagctttgagtttccagatttgttgggtgcagcatatgagtatcttttaaaagaatttgctgattcggccgggaaaaaaggcggcgagttttatactcctgccggtgtcaaaaaactgatggtaaggctggttaaacccggcgagaacatgaccgtttacgacccgacggttggttcgggaggctttttgattgaagcttttcactatgtagaagagaaagggcaggatcgttataacttaggactttatgggcaggagttaaatggactcacttggtcgatttgtaaaatgaacatgattttacacggtatctcagatgcccatattgaaaatgaagatgttttaaccactccgatgtttttagaaaacgggtatatcaagcgctttgaccgggttctggccaatcctcctttttccgaaaattatacccgggcaaacatgcagtatccagagcggtttaaatacggttttactcccgaaaccggcaaaaaagcagacttaatgtttttacagcatatgattgccagcttaaaagatgatgggattatggccacggtcatgcctcacggcgttttgttccggggcggacaggaaaaggtaatccgggaagggattgttaaagaaggtataattgaagcaatcattgggcttccgcctaagcttttttacaataccggcatcccggcctgtattatagtgattaataaaaataaacccgaacatttaaaaaataaaattttatttatcaatgccgaccgggaatatggcgaaggaagaaatcaaaacttcttacgccctgaagatatcgaaaaaattgtaaatgtttttgatgagaaaaaggaaatacctggctattcaagactggtggatataaaagaaattgaagaaaatgactttaatcttaacatcagaagatatgtagataattctccagagccagagatagaagatgtgcgggcccatcttaccggtggggtacctttacgggaagtaagaaggtatgaagagcagtttaaaaaatttgggatttcttacgctattcttttagaaaaaaaagatgagcattatttagagtttaatgatttaataacagaaaaaagtcaaataagagaagtccttgaaaatgctaatgaagtgaaaaataccatagcaaaacataaggaaatgcttttaaactggtggcaggaagtagaacaggagattttagagttttacggaagaaataacctctggagttttagaaacgctgccctgaataaattaaaggaaaagcttttgcctcttggaactcttgatgaatttaaaattgccggcgttttcgtgaactggtgggaagaacttctttatgattttaagagtatagctgctaccggctggaataaaaacctggtgaatgatgaaaggattaaggaaaaatatttcgggaaggaaatcgaagaaatagaagaactggaaagtaaaattgcggaagtagaaggcgaactaaatgaacttttagatgaagttgaagaatgggatgaagaagagcagggagagaaaacggcgagcaaagtaaaaaatcatctaaaagagctggtaaaagaattaaaagaaaataagagcgaatcggcaattaaagaagctaaaagatgggaggagttattggctaaaatagctgaaaaagaaaaagaaattaaaaatgcccgaagcaaaaaaacgcaaaaagaaaaaaatcttgaaaatgaagtttccagaagaaaagaaaacttaaccgaggaagaagttaaagaactacttttgggaaaattctatgaacttatcgataaacagcttgaaaagtatctaaatgcggaaaagaaagaaatcgtcaaagtctttgaaaatctttgggacaagtataatgtatcgctttctgaactcacaaaagcaagagatgaagaagtaaataagctaaatgagtttttgcaaaagctggggtgttactatgaatgaggataaaaaaattccagaaggatggcaatgggtaaaattgggggatatattaaaatatgagcagccttataaatatattgtaaaaagtactgaatataaggatagcaatagtattcctgtattaactgcaggtaaatcctttattttaggatatacagatgaaaaagatggaatttatacaaatttgcctgtaattatttttgatgattttacaactgaaagtaaattcataaaatttccatttaaagtaaaatcttctgcactgaaatttttaaaggaaaaaagtgataactttgttttgaaatttatttttgaaagtatgcaattaataaagtttaataatgtaggtggtgagcataaaagacgctggatttcggagtttcaattatttaaaattccactcccccctcttccggaacaacgaaaaatcgccgaaatccttgaaactgtagataatgccatcgaaaaaactgacgctattattgaaaaatataaacgcttaaaacaggggttaatgcaggatttattgacaaaaggtattgacgaaaactggcagataagagatgaaaaaacccataaatttaaggattcgccgctggggagaattccggaagagtgggaagtgataatgttggaaaagtgtggtaagattgtaactggaagtactccttccacagaaattccgcagtattatggtgatgaatttcaatttatttctcctgaagatatacaagataataagtatatacttgaaacaaagaaaatgctttcaaaacaaggttttaatcttcaaagaaaattaccgcctaagtctgtatgtgttgtatgtataggttcaaccattggaaaagtagctttaacttctactttctcttctactaaccaacaaataaatacgatagttcctaggcctgagttatgggaacctgaggcactttattattttgttagcttttatattcaaaatcctttgagaatggaagctggcatgcaagcagttcctattgtaaataaaggtaaattttcaaagattcttattccccttccccctcttcccgaacagcaacgcattgctgcagttttatctcaaatcgacgaagcgatcgaaaaagaacaggcttacaaggaaaagcttgaaagaattaaaaaaggcctgatggaagatttattgaccgggcgggtcagggtgaattccctgctttaagtatttggtttgggaggcttttctaaatgtacagtaagcttgatgaggagcattatgtggaaaatcccttcttagcccagcttctaaggctgggctggaaggtataccggcagaataaagataaccccgaagagataaaagagattgcttcatttaattcagcttttgaaccgtcatttggtgagtcggttaagttcagagaaagctttaaagaagtagttttagaaagcgttttaaaagaaagcctgaaaaaaattaatccttggcttatggaggaccagataaatgaagtaatgcggaagattaccactcctcaggccaattcatttttggaaatcaaccgggagattcatgatttacttttagaaaacacctctgtatccgaaaaccgcaggaccggtgaaaaaagccccacggtcagatttattgactttagaaatccggaaaacaatacttttttagctgtatcgcagtataaagtaaacattccgggaacagaaaaacatattattcccgatatcgttctctttgtaaacggcttacctctggtggtagtggagtgcaaatccccggccattgccgatcccctaaccgaagctataactcagctcatgcgctactccaaccggcggggagtaaaagaaggaaacgaaaaactcttctggtacaatgtttttatgattgccacttcaaatcaggtagccaaatacggcaccattacctcggactttgaacattttgtagagtggaaagacccctatccttatgccctgtccgaagtaaatcctgacggtgttgttaccagtcagcagcttttaattcacggaatgctttcaaaacagaatttcctcgacttactgcacacctttaccatttttaaagaagactccaaaggcggtgtaatcaaagtagttgcccgctaccagcagtttagagctgtaaaaaagatggttaaacggttaaaagaggggaaaactccgattgagcggggcgggattgtctggcacacccaggggtcgggaaagtcgctgaccatgatgtacatggtccgggaaatgtaccaccagccggaatttggtagtttcaagatagtttttataaccgaccggaaagaattagaacagcagttaagagacacctcaaaaagcgttggctttactgtaaatcttgcgggaagcatcgaagaacttaaacagcttttaaaaaccaaaactcccgacctggttatggccatggtgcataagtttcaggaacgggatttaaaacgggagtttcccgtattaaatacatcgcccaatatcctggtaatgattgatgaagcgcaccgcactcagtacaagcttttaggagccaatttaagaaaagcccttcccaatgcggttagaatagcttttaccggaactccgattgataagactgaacaagaatttggccagtacatagacaaatacagcatccggcaggcagtagacgatggggttacggtagaaatagtttatgaaggccgggttcacagtgccgaactttccgatgaagaagcggccaatgccaggtttgaggatgtctttcgggatgctgatcaggagacaaaacgccaaatcttaggcaaatatacctggaaggcctatcttgaagcagaagaagtaatcagggataaagcaaaagacatgatcgaccattatgtgacgcatatctttcccaatggctttaaagcccaggtggttaccgtttcccgtttagcagcggtaagatataaaaaggccttagaagacgccttgaaagaaaaaattgctgagctggaaaagagccagaaccagaaagtagacctaaagacgctgaaaaagttaaaagtaggagtcgtaatctccggtaagcagaacgatgaagctatctatcagccctataccaatccggtggagcacgaaaaaataatccagagttttcgccttccctttggtaaagttaacgagagtggcatatcgggggatgtaggcattttagtagttcagagcatgctgattaccggctttgatgctccgatagaacaggttatgtatcttgataatgtaataaaaggccataacttactgcaggctatagcccgggtaaaccgggtttacaaaaacaaatcctgcggctatgtggtggattatgttggcgttttaaaacatttggaagaagcactggcaatttatgctgatgaagatttagccgaaatctctaaggttgttattaataaggcaaaaagtattgctaatttgcattatacccatagacagatcgaagaattttttgccaaaaaaggccttaaagactggcggtctcaggttgatgactgcattgaccttttagttgacgaacaaatcagaaatgaatttatcatgctggttcgaaacttcaatcgggcaatggatgcggttcttcctgatgctgaggccttaaaatatctaacagatttaaagatattaagctttatcaaagaagcagcccggaatcggtatcgtgacagtaaattgagtataagtgatgccagccggaaaataagggagatcgtagaagagtacattgtagccaaaggaatcgaccccaaaattccgccaaccccgcttttagatgataaatttttaaataaattaaaaggaaagccagctaaagttaaagctcaggaattgataacagctattaaagaacatattgttgatcattttgaagaagacccggagctatatgaaagattttccgatagattaaaaagattgctggaagaatatcacgaaaagtgggaaatacttgccgaagagttagaaagatttagggaggaaattcaaaagggccgggaagtagaaaatacttttgggtttgaacctaagaaagaaatgccgttttttggcctgctgaaaaaggagttatttgggcagaaagcctttaatgagctgagtgaggaagaagttaatttccttgttgatttaaccagagacgtaattgaaataattaagagagagaccaaagcggttgacttctgggaaagctacaccaagcaaaagcggttaaaaacctatgtaggaaaccacctgctgcagaaattagttccaaaagcttctgccggtaagggtgttgctgaaaatcctgctccctatcatgccgatagcttagcaaaagtaatatttaataaaagaaacgaaataacgcaaaaactcctggaacttgcctattatcattacgggaagtgaaaaacatggatataaaaattgaaaaaataattcgcaccaaaagaaagaccattgctctggaagtaaccgataacgctactttaatagttcgagcgccttacagagtaagtgaaagcaccattcaggcggttattcgaaagcactacaactggattattaaaaagaaaaaagaagtagaagcccgagacccaaaagttagagctaaagagtttgttaacggtgaaggctttttatatcttggaaagtattataaacttcagatagtggaagaccagatcgagcctcttaaatttgcaaatgctttttatctttcaaagaaagcactgccgcatgctaaaaaggtatttaccgaatggtataagaaggcagctttagaaaagataactgaacgggtacagttttatgcgaagatgggcggttataaatattcccgaataaatataaccagtgctcaaagaagatggggttcctgctcaagcaaaggcaacttaaattttagctggcggttaattatggcccccttgccggttattgattatgtagtagtgcatgaacttgtgcatttagaggagaaaaatcatggtaaagttttctggactaaagttaagattttaatgcctgactaccaaaaacacgaaaaatggctaaaagaaaacgggtatgttttaaaaatttaacagtttgagggttaaaaacgatgtttaattttagtaattaaggttgaacaattttaagattgtgaagttttacatcgtgatttattaattttaaaagggcgtaatcaagcttttctccatgttcctttagcgtcattttaatttccgcaatttcctctttgatttgctggttggaaattttaagttcgttaacgtcacttttaagttcgttaacgtcactttttaagttgctcacatcacttttaagttcgttaacgtcactttttaagttgctcacatcacttttaagttcgttaacgtcactttttaagttgctcacatcacttttaagttcgttaatgtcactttttaagttgctcacatcacttttaagttcgttaatgtcactttttaagttgctcacatcacttttaattccgttaacgtcacttttaagtccgttaacatcacttcgtaattcttcgacagctgcattagtatttcctacaatccgaattaattcggtaatcattcttgccatatggtctaattgtgtttcaagcctattaaatctttcttcggacataaaatcacccgctctatatttcttataaaagaataataccatattttaaaaaaattaaaaacaaaaaatttttactgcgaagttatggtttaataaaaaattaagcctccaggcgaaccctggaggcgttgattttctggagccgatggtgggattcgaacccacgacctacgcattacgagtgcggagtttttacgcctttttctcatcccaccaaagccttgagtttcaaagccttccgccaccggaaagcctcactttttcaggaactacgcattaaccccttttgttgttttatattcgatacttcttattaaattcctgctcaagtggaggagttttttaaaagtcttttcttttctgcataaaccttctgttttgcgtttttacttctgcacgttgggcagtaattttttcgccccttctgaggctttcggtcatagcgaacatataactgattgcatttatcgcaaacacacaactgtcttacccccgcaagacattgagcaagctcaacccacatcttttgaaaacatccccatcccgtgtctatattcattcttggacgttgttctttgtcccatttcaaccatagagttacatccgaccccgataaccaaccattcacacttgaagctaaaaagaagcgttgaattgtaacatcaaacttgctttcttcttcacaccatcccgccattttccaaagtgatggtggagcaggttttccttccagtaaataagaagcaatatcgagtattgcctttactaatcgggcatagtgtcgataaaagtataatggctctgcaggaaaccaaagacaggagtctgttccaccctcccatttaagttgtattctattcggagtccatatacaatccctatgttttacgcacaaccacaaaggcccccatttttttgcaaaggatagtatatcttcgtccgtcccttccgctaatttcacaaagtcattaagtaccccctccgtctcttctttttttgtccatccaatgctttccaatatattttccccctcgtctgctgacaaaacaaaagggtctgcccgtaaaggtaagtttttttgccattctggaggtataggatacattacacactccaccaatttatcacttgaatctggccattttcccaatttcacatcaggaggaacccatatagcagaatacccttcaaggtaagcctgaagccttgagttttcgtccgtaaaccctgctatatcccaattggcccaattcataaaaaaatccctccttttacctgaaattttacctgaaaatatttttttaagcaaggttttttgcaaaaattaacttagaaaaaacggaggtgagaaagaaaatggttacagccttgcgtgttttgagagttaaaactgggaaaaccttacggcaaatcgcaaatgaattgaggatttctgaaattcaactttgcagaattgaaagggggcagtcctacattccaccgcacttgcgacaaaaattagccgacttcttcagcgtctcagtctccgaaatttgcgatgaagctactggttggcccatcttggtggacatggaaatgcccaaactggtgcggaaagcgtaatgaaccgatacaacagaataccccggacgtcctgcaggctgtttcacctgcggaagggcgtcggaagaaggagggaagcgagtggaactgcggaaaatgcttgaggctttcgctaacgagcaaactcctgaattgctactggccattcgcaaaaagtatggcaaatacggcttttctctcgcttgcaaggttgcggggataagccgagggcagggtaagcgtatgttaggcctgtatgacgacacaaaagctatcaggcaattggctaatcggttatgcggaatgaaaacttcaaggtggcaataaggaggccgggggtatgacccggccttaaaactttaggaggtgtgtttcatggaaaagaatagacgaggcagtatcccgctttacgtggactaccaagggaaacgtgtggtctctggcattctcggcccggacaaggttttccgtaaatcggttgaactgcggcaaaaactggtagtcatggacgcttacggcatcgacgaggagaacttccgggaactcaacgccttcggctgcaaagttatcgagttgcgggagcgagacaccgggaggaaatacctcatagatttcgacaccttcaaagccaaagcagtacctcggcaaatcggtaagtttggcttgcggtactatcttccgcttcgctattggcgaacccttgaaccggcagtaggcgatacgccataagaaccgcctaacttttcaaaaggagggattacatgaacactgtttctattcccagtttagccgtttttcaagccgcaaacaagtacctccagcgaggctggcaggtcatcccggtgcctttcaaacagaaaagtccagtcatcaagaactggcaaaacctgcgtttgacccaagaagatattcgacgtgttttcgcaaaaccctccaatgtgggtatactcttaggcgaaccctctggcggacttgtggacatcgaccttgacgacccattagcggtaaaactcgccccctatttccttccatctaccgaagctatttttggccgaacttcgaagcctgcaagtcattggctgtatctctgctttggggcaaaaacgaccaaatggcaaggcattgatggagaaatgctcgttgaactccgttcaaccggttgccaaacggtatttccgccttcgatacacccatcgggagaagctatcacatggcacaaagaagggcaacctacgcaagtaagtaaagcagagcttgaaaaagcctgctcaaaacttgcaagtgctgtccttatcgcaaaacattggccttctcaaggcactaggcaggataccgctctggcccttgcaggcgggttaattcgccttggattcggtgaagaagaagcggaaagattcattgaggctgtaaccgtaggagcaggagacgaagaaagcagggacagggtgaaaacagtcgtttataccgcacgcaaaacaggaaattcaccaaccaccggatggaaacgattgagcgaactcattagtgaggaagtggttaataaggtcttgcaatggcttggagtggagaaacgagaggaagaaaagcaatcaaggcccaacgttgaaattaaactttggactgctacggaactcatggaaacagacttccccgaaccttcgtggcttattccgggaatcctacccgaaggcggtttggtgctattggccggaaaaccaaaagtaggaaaaagctggcttgcgttaaatatggcttgcggtttaagcaatggcggtgctgtctgcggtattcctgcggaaaaggctgttaagaccttataccttgcgttggaagatactacccggagactgaaaacacgaatccaacaggcaggattaacgccaaatgaaaattccctcatttcaacgacatggcccaaactcaatgaaaaaggccttactctgttagaagaaacgataaagcaggctggtattcaagtcgtaatcattgacacattggcgaaggtaaaaccttcttctaaatcgaaggtagtttccttgtatgacaatgattatgaaatgctcggtagtctcaaagaacttgcggacagactgggaatcaccgttgtaatcgttcatcatttgcggaaaagcgaaagtgaagatccattggaagaagtttcaggaactactggaatcaccggtgcggttgatacgattttggtgttgaagcgtgcaaggactgaggcggacggaacattgttcataaccggacgggattgcgaggaacaggagttagcccttcgattcaatgcaggacgttgggaggtgcttggagaggcgaaactatacgaaatttcgaaggagcggagagagattctcgaagcaatcgaaaaactcggaggaagtgcaagcccgaaagagatagctgaaataaccgaaaggcctcatggctcggttaaacacctccttcgcaagctggaggaagatggattggtaacttcattcaatggcagatattcacttaccacctccttgaatgatattcacccagacaactccgttcaccctgtttactctattcactctattcactccgttcaccctattcactctattcaccgttcacccggtgaacagggtgaatactcggtgaatgataccattcaccctgaaaaatgcagtaatgatgagcctttcggggattcggtgaatgcggtgaacacggtgaacggtgaacctgttgttttagcaagaagcaacgtctcacaactcgatatagaggtatgggagatatgactgccgaggccattgttaccgaactggaaaggttaaacgtaaaaataactgttgtcggggacaagctcaggcttgaggccccggctggcatcctcacaccttcaataaaggaactcatagcacgcaataaggcccaaatcatcgaatggctaatgaatcctactaccgattgcatgggcacggtagtaaagttataccacgcaagaaaggaatgtttagaagcgggctactgcttacaatttacactggactgtgacttattccctctaacatggcgttggggatggtgcagggaaggggtaagcatggcaaggcccaaaagaaatgcagggggaggataaaaatttccttcctttcctgcaaatgacccgccgggcactcgcttgcgtgaaaaaatcccccataaaagcgagggtagtccctttaacggacatcccctaggggcatgccgaaaattttggccctgctccagagaaccggcgacgtgcaggcttgcgttcgcaaaattcgctttatctcgcaagaggggaaaaagagcggttgaattgactaccccctcctcaaatctgaggaagcctcctaagttttacttagtaggccgagagaggggatagcgaatctctaccacgccaaagggaagaccggcgagctgggccatgaaggtacgtccgcaagttttaccgattttttggaatttgtcacttttgccttgaatttgctacttttagcttaaatttgcctgctttcggtaattttacctctccccccggtgcagtaaatcaagagcactctggagaccggcgggcaggccctccaaatactccggaatatactctttcacgagggtggttgaaatgctacgcacattgtgaacctcgaggccatacctgtgaccgcaaacggtcacaaacaataagggaggggtgaaatatggcaacaaagggatacaaacgggaacacggtcttaccatcgaacaacttaatgctgttgaacttttagttatgggcaagaccgataaagaagtggccgaagctgtgggagtgaaccgggtaacggttacaaaatggcggttgtatgacccttattttcaagctgagttaaacaggaggaggaaagaaatatggggcgttgcagtagacaggtttagaagccttctattgaaggccctgaatacggttgagaaggcccttaacgagggagatacaaggacggcggttgaaattctccggatggctggactggacatgacaaaagggggtggcactctggggacataccttgtaggtgagacggaagcggaaaagatacttgaggaattagcagaagcgaagaagcgagaagaaacattcaaggctttttctgttgccgattgggagaagaaaagcgtccttgacgaactcgaagaactggcaagaagattggagaggttgcagaccagaaccggaacatagcgaaaacaattgcttggataacgcaaaataacgcaaccccccctgaaaacggacattttcggacatcattaaaagcccagtcgcaagagaaagacgactgggctatgctaattgaagatgcaaaggctaaagggttaaaagggccgtggtagttattgcacatccacattattcggggtgttaacattttttggctttcttgccccgaagaattccataacagctaatataagagcaataacaccccaaactttcatgtcagaaaaatcgctcgtcgctccatttatgaaagcaaataaagctgctgcggctgagaaaatcattgcgacctttggaagggcaaaagcaaaagcaccaccgatgaaaagtagaaaggcaacaaacataccaaggtcgccactactgccagttgttttgcctgaaaacaatgcatcaccaaaactgacagtgcaggactgtaaaaacactaaaatcccgatgatgagagaaataataccagatgcaattctcataaaaattacctcctttaaattttgtttttcaagaaaaattctacaaaaaataaagaattccttctttttctaaaggtggttataaagtgaaagtcggagaacttattgcagtacttagtgttgatatgtcgcagtatgataaggatttggctacagcgaaatccaaagcagaaactatagtaagttccttagaaaagcctgcaaaagcccttttctatgcatggtgatataaaactattcggtgcaagaaaaaaaccgccttaaaaggcaaatatgaaggcggttgcaagctaagaaagcccttctgcccaagccggtaaattcgttttaatcccctttttctctaacttctccaccagaaacttgccggaaacgcctatttccccgatataccactttaccaaatccttcgctttcggattgttttcatctatagcccttgaaatcccctcatagatggcaagagtaacggggatgtaaagctccctcgggatagaaagatttttcatcactttccacccccggagagctttctcggtgctctcttgcccatctgctgtaacttctgcactggagaagccttttcatgaacttcctttatgtcatcctgcgaaagcctgacataccgacgtgtcatagtcaaatctgtatggcccaaaatcctctggaggctgaacggatctccaccggcttttagaaactcaatggcgaaggtatggcgtaagccgtagggagtgactttaacccctgctttcttgcagtattgccttactcttttggcccaatcgttttcattcaaagtaatgccattctcggaagcaaacaaaggcacgtcatcgccccaatgctctgggcgtattctcaagaaccttgcaatctgctgggcagtaaagggagtgattataagcgtccttcctatccttgtctttgccacttcgggccttatccgtatctcccttgactcaagggagaggtctgaccccctcacttgcaataactctccgggccttacgcctgtgtcaatctgcacgagcataagacagtaatccctaaggcccgtataggtctttttgtccggctgttggagaagttttttcacttcctcaagggagacatggcggatattagtaatatcctctttggccctttttataccttctgctggattggcaggaatataaccttcttttgcacaccacgaaaagaaagccttgagatgggctaatctcttatttctcgtgctgggggaagccttttcggtgaagtattttaatacgctttggcgtagggaggtataagactccaaagcatgagggaagcggttgaagaacctttcaatgtggaagcggtaatcgtggattgtccttgcacttctgccctctgcctctttgacgaggataaactcgtccagtaaatcctgccatgttatttttaacgagagaggcaatcttaagacgttacttttgggcataaaaataacctccttcaagacctacgcatttttttaggtctttcggaggctggaaggcttgatattcaaggttggagccgatggtgggattcgaacccacgacctacgcattacgagtgcgttgctctgcccctgagctacatcggcaacaacattgcattaatattttaacgggaaataaggtggtagtcaacgggcaaatatttgggagtagctttaattttgaatctttttggaataccattcagtataaaaaaacaaccaatcaccgtcatataatgcaactgagtaattattcattgaattgagcagtattcagggataaatttaacttaaaaaccctttaatgggaggtaagtttatggtggaaaaagcttacccctgggttaaacattatccacctcatgttcctttaagtctgacctatccggaaactccactttatgagcttttaaggaaaacggctcaaaaggtaaataaaactgctttaatcttttttaataaaaaattatcatacagcgaattaacagaatatattgaaaatttagcagtaaatttatcccctttgggcctggaaccgggggaccgggtggggattatgctaccaaattcgccccagtacgtaattgcatattttgccttaatggcggcgaggatgattgcggtccccttaaatccactcctgtcggcaagagaactaacttatattattgaagatgccggagtcaaggctatttttgccttaaatctttttgcggaaaagttaaaaaaccttgataacgtaaaaataatttatacagcaattgccgattttttagcgtttcctttaaattttcttttaaaacttaaagaaaaagcccctcccgtaaaaatcgataatgaaaaggtctttgcattaatgccccttttaaaaaataccggaagcaaaaactttagccccaaacagcgggaccttaaaaaggaaccggcggtgattatttacacctccggcactaccggtaaacccaaaggggttatgctctcggagtatgccctgatagtcaatgcctatcatgtcaaggtctggggagatttagtgccggaagatgtgatgttaacagtcttaccgatttttcacggttttggcatgagcgtttgcatgaatgctccccttttaaccggctcttcggtggtgttacttccgcggttttcggtggaagagttttttaaagcagtagcgaaacaccggccaacattgtttgcgggagttccgacaatgtttgtggcaatgttaaaccataaagatctaaccaaatacgatctttcctcctttagaggttgttttgttggggcggcggccatgcccccggaggtaaaggagcagtttgaaaaaatgaccggagctcaggttttggaaggttatggtcttaccgaggcggtaaccgctaagtgctgcaatccctaccgcggcgtaaataaaaccggcagtattgggatacctttccccgatacggtgatggaaattgtcgatgcgtttaccggagaaccattgccgccgggagaaataggggaaatacggttaaaaagccccgatttaatgctgggctattacaagcaggaagctgcgacccgggaagtgattaaagatggctggctttatactggagacattggacggatggacgaagatggttatttttacatcgttgaccgcaaaaaagatttaatcattaccggaggttttaatgtttatccccgggaagtggaagatgttctttactcccatcccgatgttaaagaagcctgcgtggtggggattccagacaattattacggggaagtggtcaaagcttatgtagtgttaaaagaaggggctaagacttcgccggaggagctaaaagccttttgccgggaaaacttaacccattataaagtgcccaaaatcattgaaataaaagatgatttaccaaaaagcgcgataggtaaaattttgcggagggctttaaaggaaatggagagtgaggccaggcaatgaaattaaactatttttgcagttactggccggtggaaatatccgaaggagcggggatttctacggtccgttatttcccgtccgatgaaagcaaagctccggtaaggcttcctgcttactgctgttcttatgccaggggaagccttgccgaaattgaagaagaaggagacggtgacttttggggatttgcccacagttgcgacacgatgcagagtttatacggcattactaagagtttactgggagacgaccgggtttttcttttcgttccgccggttgacttaaccaccgcttttgcccgggaatactaccgggaagctttaatttatctctggcgggaactttcccaaaaaagcggggttaatggtgaggaaaagttaaagcttacctgggaaaagttgaaggagttaagaaataaggttaaatctttggaaaacttgacgtcaattattccttcctccgaaatttttgagcttttaaaaaagcttcagaccctgccgctggatgaggctttggattacctcgaggccaaaaaagcggaatttaccagtttatctgtggctcaaaaggctatagggattattttaacgggagcggtagtcactaacagtaaactttaccttgctttagaacaacagggatttagagtagtttatgatgatacctgtaccggctttcgtcattttgctggagagatagaggataaagacgatattttggaggcaatagtttcttactacctttcaaagcccccctgtccctgcaggcataagggagtatgggcgagggcggagtatttaaaaaatctttatcataacaaaaatgcccgggccattgtacttttacaaaataaattttgtgacccctttgcctgggatgttccctatttagtggactactttaaaaaacagggagttccggttttagttttagaggtggaaggcggagaaatcggcgagcaaaataaaactcgcctccaggccttccgggaaagcgtgggtggagtgtaatggctaaaaaaatctttaagcctcttaaggcttcagagaaaataaataaaattttaaaaaatcattatttaaaagcaaagtatttgccaacgcttggaaaattttttggttataaaaccgcctggattaccagcggagctccggtggaactactgcgggcctttggtatagagccggtttatccggagaattacggtgccatttgcggtgcccgcaaggtttcgccgagtctttgccaggtagcggaaaacaggggttattctctcgatttgtgttcttatgccaagagtaatctcggaagtatctggaatccgaaagaaagtccatttaacggcttaccccggccggatttactggtggtttgcaacaacatttgcgggacggttttaaagtggtacgaaactttaagccgggaatttaatattcccctttttatcattgataccccttttatcaccggtgaaccccaaccctggcaaatccagtatgtggccaaacagatagaaaaactggcgattgaactggaaaaatttttccggaaaaagttggatttaaaccgtttggaaaaagtaattctccttgccaatgagacggtggatttatggaaggggataagaaattttgccaaaaataaaccttcgccggtaaacgttaccgatttatttattaatctggggccaatggtggttttaaggggtaccgaagttgcccgggatttttacgaggaagtttaccgggaagtggaagaaaggtacaaagccggggttccggcggtagagggagaaaaataccgtttagtctgggacaacattcccatctggtacggactgtaccgtttttacggttattttgccgaaaggggagcggtttttgttaccgattcctataccggtggctgggcggtcaacataaaaaagggtcctcccttttatgcattagccgagacctatgccggcgtctttttaaatcgggatttagaatttcgcaaaaatcagttgcaatctttcattgaggaattttctgccgatggctttgtcatgcactccaatcgttcgtgcaaagcttattcttttgtgcaggaggaaatccggcgccaaatcatgaggtcactaggagtgccggggttaatagtggatgccgatatgaccgacagccggctttattccgaagaaacggttttaaaccgggtccaggctttcctggagagcctgtagagaaaaagggggagggagattttgtatcttggagttgatattggttcgcttacgaccaaggttgtcttaattgaccggggaaaaaatcttattgcttatcgttacagtaaaaccggacctgccggaaaggaaacggccgagcggttaattcaagaggttttgataaaagcgaatatttcccgggacgatattcagggaatagttgctaccggttacggcagggttctcttttccggaaaggagttttcggagataacctgtcaggcccgggggattgggcatttatacccggaggcaaaaacgattatcgatattggtggccaggatagcaaagtaatttctctgggaaaaaacggaaaggtactggactttgccatgaacgataaatgtgctgctggcaccggacgttttttggaggtgatgagtcaggcccttgaagttcgtctggaagagataggggaacttgccgaaaagagccaggaggcagctaagatatcttcggtttgtaccgtttttgccgaatcggaagtgatatccaatttatcccgggggcagagccgggaagcggtagcacggggaatttgtgaggcggtggcggcccgaacggctatactggcgcaaaaagtgggggtggtagaaccggtggtttttaccggaggggtggccaaaaatactggagttgtggcggctttggagcgaaagcttggggttaagttattaattccggaagattccacgattaccgcagctctgggggcggctttattagccgctgaaaattcttaaagaggaaaattcgggaatttcaaggggttagctttaaaattgccgaaaggaaatcatgaacttgattattcaacacgagtattataaaaagctgcaggaagaaagtatggctggcagaaaccttgaaaaagacgccaaggaagcggaccgggaagaggagaaagtatacgaataaaaattatagcctcttttggggctttttttatttattgtttgtgttttcgattaaaatttatggtatattaaaattataaaacaaagggaggtgtccgaatgggagttaaaattagcgattccgttacatatgttggcaagattgactgggagcttagacggtttcacggggaagaactttctacccaccgggggtcaagttacaactcgtacttaattagggatgaaaaggtggcgttaattgatactgcctggatcaaatttgacaaagagtatgtaaaaaagctttcggaggaaattgatttaaataaaattgactatgtcgtagcccttcacggggaaattgaccacagtggagccttaccggaattaatgcgccatattcccgataaacccattgtttgttcggctaatgccgttaagtcgttaaaaggtcactaccaccaggactggaatttccaggtggttaaaaccggagataccctggatcttggcagcaaaaagcttatcttcattgaagccccgatgctccactggcccgacagcatgatggcatacttgaccggggaagagattttgttttccaatgatgcctttggtcagcattatgcctcggaaagtctgtttaacgatttggtggaccagcacgaactttttgaggaagccttaaaatattacgctaacatcctggcgccttttagcgcccgggtggtaaagaagatagaagaagtactggccttaaatttaccggtgaaaatgattgctcccagtcacgggataatctggcgggataaccccctgcaaatagttaataaatacctggagtgggctaaagactataaggaaaaccagatcaccattatttacgataccatgtgggatggcacccgacggatggccgaagaaatagcccggggaattaaagcggcggatccggaggttacggtgaagctttacaattgtgcccggtcggataataacgatattgtggtggaggtatttcgctccaaggcaatattggcgggttcacctacggttaaccgaaatattttgtataacttagccggacagctggatttaattaagagcttgcagtttaaagggaaaaaagcttctgcttttggcgcttacggctggagcggtgaaggggttaaaatcattaccgagattttaaaggaagcgggttttgaaattgtaatggagggtataagagagctctggaaccccgatgatgaagctttaaaacgttgttttgaatttgggaaaaattttgcccaggcagtaaaataatctcagaaaaaagaataatgtagataagggcgcacttctgtgcgctctttttttgtatttattttctcaactttttcttctaccccctgacacttcccgtattaatttttgtatggaagagagttttatgcattttaaaaatgtacggttgcacatgctgcaataatttactataatactttatgtagcgaagtaaaagtgacgaaatacacaaggaggcgctgacaatggctgtggaaaaacttcaaaataacgtggaaaaagtagcacaaaaagcggtttacaattttgtggaagatagttacaattgtgctgaagggatagttgctgctttttcggaggaaatgggtttggctgcgaaaacctatacagctttagccatgccctttggcggaggtatagggagccttggtcatatgtgcggagctatttccggaggtttaatgatgcttggcttaaaaggtgcgcaaaagggcttaaaaaagccggaaattcgggaactggcccagaagctttacaagggctttgaggaaaaatttggtgctgttaactgccacaccttaactcggcatgattgtaacgatgccagttctgctccttatgatataaaaaactgcgcaccttatattcaatatgtggtttataaagtaaatgaactcctgggggattaagatgaagtataaagttcatatcgatgggggttcccggggaaacccggggcctgccgcttctgcgatggttatttatgacgaaaacggggaagtcctgtatgaaaaaagcaaatatttaggtataacaacaaacaacgtggcggagtgggaagccctgaaaggggcttttttggctttgacctttcttgctcaaaagcatggtaaggttgaagccgagatttttgctgacagtgaacttatggttaagcagtttaacgggcagtataaagtaagagatgaaaagttaaaggaaatatacgctgaagtaaaaaaattggcagcaaatcctgctctaaaagtaactttgtcccatgtctaccgggagaacaataaagctgcggaccgacttgttaatcttgaattggaccggcaggaaaatgcaaacattgacagcgaaattatagaatagtataatagaacaaaaaattgcgaaaaatggaggggagcggcattatggattacgccgaaatgagtttacaggagctccaggaagagctaaaaaagcttaaagaaacccttgaagaggtagaggaagaaaagttttttgttttagggcagagcggttttcatgtatcggggggcaaagtaaaacagtacgaacaggaaatttctgagctgcaggcgaaaattaaagaagtggagaggttgatcagggaaaaaagcaattaagagttgagccctgcttttttcaggcagggttttacttttctggacaacggggtaaaaataataataaccatatcatgatcataaaagggggtattttaatggaagacagggtaatgcctattgcagaagaaaatttaccggaagaattaaaacccatttatgaaaattttaagcaaaattttggcgaggttccgttaccgattaaagtcatggccaataatccggcttatttaaaattgtttgtgcaaaagcataaagtactctgggaagaaaactcgcttgatcccaagaccaaagttcttatcgccttggttatttctaccttaaataactgtgaattttgcattagaaattatacgatgcaggcaaagaaattggggatatccgataaagagataattgaggcaattagtttaattgatttagttggcagcatgaatcactttaacaatggaatgcggattaaaccgtgaaagatgggggctaaccttaaagggaagaggttagcccctttaaatttcccaataacttcgaaaatagtattgacagcgaaaaccatggcgttttaatataaataagtaaagattacgctattattaaatatagagaaaagggggtataagatgtttaaaaaaatttttctttttccttcccaaaatttagttacagtaataccgctggtgatgattctgggaatcatcgtgggttattttgtggatacgagcttccttaaaaactacattctggtatttacttttttaatgctttatccaaccatgattgggatgaaaattaaagaagcttttgatttgtcccataagaatgtggtgggtcttgcttttcttttaaactttattgccattcctttgattgcctggggtcttggaactttacttttaaaaggcgaaccggaactttttgccggccttgccattagttctcttttgcctacttccgggatgaccatttcctggacaatgctttacaaagggaatgtgccggcagcggtaaaaaatactacattaagtcttattattggctcccttttggcgccctggtatttattactgatggttggcaagtacgtgccggtggatgtggttgctacttttaagcttattgttacggtagtctttattcccctgattcttggacattttacatataaatggcttttaaaaaaatatacaacggagcagtttaataaagagataaaaccgtttttaccggctttttcgacgtgggcgatgcttttaatcgtgtttaccagtatcagcatgaaagcaaagatgctggtgcaaaatccgaagcttttgggttatggtttattaattttggcggtgttttacggtattaactttttccttggaaccattgccgctaaggcatttttgaaccgaccggatggtttggctttggtttttagcaccgtcttaagaaatttatccctttctttaggaattgcggcaacggcctttgggccaaaagctgcctttattgttaccctggcgtttattttacaggttcagggagctgcctggtacggaaaaatgattaataaatacggagtttttaaagatgaaacggcgatgcaaacagcaaaggcctgaagtcatgccccaaaattttggggcattttttatttgtggtggcaggataaattcattgtggtataataagccaaaaggggaggattttggtggggaaattcaggggaaaaattatcttttggcttatggtttttctctggttgacgactcccgtttatgccggtgttctggctaccagggttgagggtgtcattgacccggtaatagcggggcaccttaaggaaataatccaaaaagcagagcgggaagaagcaagctttgtcttaattgaacttaatactcccggtggtcttgatacttctatgcgggagataacttctgcgattttagctgcaaaagtaccggtgggagtctgggttggtccttccggagccagggcggcttctgccggaacatttattttatacagtgctcaggtagcggcaatggctccgcaaaccactatcgggtctgctcatccggtaaatctcgggggacagtccctggatcaggatttgcgggccaaggtggaaaacgatgcggtttcttatattacttccctggcaaaaaggaatggaagaaaccctgtttgggcggaagaagcggttagaaaaagtgtttcggtggatgcggaggaagcttataaaaagggaataataaattttattgctaaaaacccggaagaatttttagaaaaagcccatgggctccgggtaaaagtttccggcagcgaattagtcttaaatttaaaggggcaaaggataaaatatcttgatttaagcttgtgggaaaaatttttacatgctttggccaatcctgagcttgcctattttcttattttggttggaatttacggtctaatttacgagtttgcccatcccggagggatggttggcgggataacgggggttcttgctttactcatggctttttatagcctttccgttttgccgactactctaacgggccttttattgcttctttttggtttggctttaatcattgccgaactttatttgccgacttttggagcactgggagtgggaggggtgattagcattactcttggttcgctgtttctttttggcaccgatttaccggggttaaccattagctgggttaatattctcccgctggttttgcttttagctttaggagtatacctgttaattaaacttgcggttcgggcgcagaaaagtaaaagtttaacaggaatggaggggatgatcggccttactggtaaagttaccgcggatcttcaaccggaaggatttgtaatggtaaggggggaaatctggaaagcaaaagcggtggaaggtaaaaccataccacggggtacaccggtaaaggtgataggggttaacgggttgaccctggtggtggatgaggttaacgaaagttaaaataacttttctggagggatgtaaatggagattattggtgcccttttaggggcaatgggcccgcttctggttttaatcctgttttttcttttctcggccgttaaagttattcgcgagtacgaacgggcggtaatctttcgcctgggtagagttatcggtgctaaagggccgggacttatcattgtaatacccattattgataaggtctggaaagttgacctgcggacggtggctatggatgtaccaccgcaggaagtaatcacccgggataacgtaccgataaaagtagatgcggtggtgtattttcgggttatggacccggtaaaagcggtggtggaagtagaaaattatatttatgccacctcccagttttctcaaacaactttaaggtcggtgctgggtcaggcggaactggatgacgttttaaccaaacgggaagcgataaaccacgagcttcagaaaatcatcgatgaagctacggatccctgggggattaaggttacttctgtggagttaaaagcggtagaactgcccgaagggatgaagcgggccatggccaaacaggcggaggcggaacgggagcgacgggctaaaattatctctgccgaaggggagtttcaggctgccgaaaaacttaccgctgctgcaagcttgatcggtcaggtaccaactgctttacaactgcgctttttacagactctggtggaaatttccgccgagaaaaattccaccgttttattccccttccccatagagttagtagagccttttctgaaaaaaatgacgcaaaatcaggacaaataagcggggatttttactgaatttacaaggctggccgaagtaggccagtcttatttatttccattagatattaattttcttacccggaggggttttttgcaccggtaagtttaaacgaatgtcccgggcgattaaatcggggttttcggcgtaacggattgatacttcgtaaaacttttttaaagttggttcataccagattagggacgaaaattccatgtaggtttcccggcctttgggagttaaatttagcgaatctttttccaccagctcccactggcggagttcggccagtaactgctggacgtaagggctaaaaactcccttcccttgcttaataaaattaaaccggtaaaacggttcgagcggccgaccgtaaaaatacaaaaggtagattaaattgtgaagatccttttctcttttgggtttaacggtaaaaagtaaaagtaagataaaaaggtgttttaacgagagattcaaggctgcttccccctctttttaaaaattatatctttttttggccggttacaacactgctacttggcaaaaagataggaaaaatatataataatatatgaacaaatgaacatatgaggtgataaagtgaaagaaaaggctccggtgtgtaaggttactttatttgatgaagaaacggtccagacaattcgccaaaacttacccggtgaagagacaattatcgagctttccgaggtgtacaaatccctgggagatggaaccaggctcaagattttgctggccttaaaagaaaaagaaagttgtgtttgtgatttagccgctgccctttccatgagccagtcggctatttcccatcaattacgggttttgcggaatgtgcgcttggtgaaataccgaagagaagggaaaatggtttactacagtttggatgatgaacatattttaaaaattttacaggaaggtttaaaccatattacccataaataggttggtgaaattatggcaaaaaatagtattttttaccttaccggatgcagctgacagagctgtgcagccgttctggaagaacgggtgaaaaagcttcccggtgtcatagatgctgaacttgattttgcggcagggaaactgaaagttttaggggatgtggaccctgaagttattatcaaggaagcggaaaaagaaaaatttaaagcttatttatcccggagtgatgttccaaaagctcaaaattttttcaaagaaaattaccttttacttatgggaatattgtttttgcttgttggtaccggtattaactttatcggccaggataaagtagcttcattattttatttagcggcaattctggccggtggccgggaaaccattgaaaaaggtttaaaaaacctgtggcaacgaaaaataaccagcgatttattaatgttaaccggcctaattggggcgatggcgttaggagaattaacagaagcagctttagcagcggtattatttgggataagtgagtttgtcgagaactataatcttgaaaaagcccgtactgctttaaaagagttgtttgcagcagtacccgaagaagcattggtgttaaaaaatggtgaagaacagctctgtaaagtagaggaaatacgtccgggagatttggtagttataaagcccggtgagaaaatacctgtggacggtgtcctgaaaaaaggaagaattgaggttagccaggccgctattaccggggagagccggggaattttaaaacttcccggcgaggaagtatatgcgggaagtataaatcttgatggttttggtataattgaaacccaaaagccgagcggtgaaacggttatagccaggatggccgaattaatcgaggaagcgcaaaaggaaaaacttccggcgcaaacgttgttagatagatttgccgcggtttatacaccgctggttttagctctggcctttttagttgccttcattccaccgcttctccttggtggtgaatttcgactctggatttaccgggctcttacctttttggtggtatcctgcccctgcgcccttttaattgccgtaccgatttcggtgatttcaagccttggagcggcagcgagacggggaattgtagtaaagggtagtcggaatttggaacaacttgccctgtgtgatacgatagtattcgataaaaccgggactttaacccggggtgaaatggaagttaccgaggtaattgctgtaagtcctgatttttggccggcggtatattctttagaaaaaagggcaacccaccctttagctaaagcaattataaaggcggtgccggccgaatatcaaaaagaaatagaggttttaaactttcggcaaattccgggactgggagtgctcggccaggttgagggttccaattactttatcggttcaccaaaaggaattaaagaaattcccgaaagcttcataaaaactcttcaggaaattgaagaaaaggggcaaacggccattttggtggcaaaagaaaatattcccgttgcccttttagctgtggcggatgttatccgggatgatgccggtgaggcgattcgaaatataaaagcccttgggcttaccccggtgctgctttctggtgatagtaaaaaggtagccctgcgggtttccgaggagttagaaataggaaaatggtacggtgaagttttaccccaggaaaagcttaccgtcataaaagagctgcaggaaagcggacgaaaagttataatggtgggagatgggattaacgatgctccggccttggctgcggccgatgcgggtattgcaatgggagaggggagcggacttgccaccactacagcgaaaatagttcttttgtcggggaaattaaacaatattccctttttaataaaacttgcgcgccaaagccgggctattgttaaacaaaatataattttagctatcgggctaaaattgttggccctgatggcgattcttcctggctggttaaacctctggctggcaatcggagccgatataggggttgctttgctggttagtttaaatggcctcagggttttgtggttaaagtaacggtatttttttcccagtatttcaacagattataggggtttaccgctcgcattcccggagcataaaggccgtaatggagatggtccggtgtaaaatcggcattgccggtatgtccaacataaccgataacctcacctcttttaactttccgcccgggtttaatttccgggcggattccttttaaatgggcatagtaatggtagaggccgttttggtctttaattaatacccggtttcctcccagagaaagccagccgctctttactacttttccggacattaccgcccgaacttccgttccttcgggagcaaaaatatctatgccgagatgaatccttcctccttcccggggagcatgccagttggcggaaataaaatactggttacctgctacgggaaatacgccattggcgagattttgcagagttgtcttgtcaagcttttcccaggaaatgtcggtgattttttgaagttcaaggtattgattatagttctggtaagaggaaaggatattaagaaaaaagcaaaggaagaaaaaaacgaacagaataacaaagattcttttaacctttgccaccttaatcccaccttttcttaggaaatttatagttgtttttgggcaaaaatattccttactcgacaaatccgttaaaaaaacataaaataaaagaaaaaacagggggtggaacgatgattaaggttacctgggaaggaaaaatgaaatttcggggaattggcccatccaaccatgaggtattcatggataccgatgcagcggggggcgaagataccgcagcccgtccggcagaagtcatgatgatgtccctgggcggttgtaccggcatggatgtagtggcaattttaaacaaaatgcaaattgcgggttatgagttttggctggaaattgaaccaacctgggcagaagatcatcccaagattttaaaacatgtaaaaatgacctactgctttaaaggagaaaacttacctaaagataaaattgagagggcggtatttttatcccagaccaaatactgccgggtaagtaacaccttaattaaagccgctccgatggaggtatatattaatttaaacggtgaaacctggcagttaaaaactcaataaaaaagagggcgaaaattcgccctcttacttgcgttctccggaaaattcttttggttttataaatttagcgataaatatgcttacttcatagaggattaaaagaggagcagccattaagagctggcttatgacatcggggccgggagtcagggcggcggccaggataaataccaccagtaaggcgtatttccggttttttaccaagaattcatgggagataatatttagcttggccaggatataaacaactaccggcagctcaaaaaccagaccaaaaggtatcaaaaaatttaaagcaaaagagatatacttgccgatggttatcatcggactcataatatcgccgccaaattgtaaaagaaatcgggtggcaatttgaaagactgtaaagaaggcaaaaacgataccggcgacgaataaaataattattactggaatcatccttaggataaactttctttccgccggtttcaacccgggagcgacgaaactccagatttgccacaaaattatcggggaggcaagtataattcccagtattatggcaattttcagttttgtcataaatgcttcggtgacattgataaaaactaacttcattttaagagcggtaaccggctggagtaagatatttagaaaataatcgacataattataagcaattattgagccaataactatggcaataacgctaataataattactttccgtaaagcttctaagtgttcaaacaacgtcatcggtttatcttccattaagatacctccacctgctgtaaaaacttgaagttttctttgatatgactttcgacctaccggggaaatcttttaagctatccggagacacatgataaacgcctccattttttaagtaagtcattatcaattatataaaaaatttattttcttaaaaaggggagatgggggttgtatttaaaagtttttgattttagcggtaaaaagcttaaagttttgccctggggttattttgccgatggacagattaagcagggggtaattaccgttaataacggaattatctcttcaattgaaaaaacgggggaggcggatttaaaagtaccgtattatttatatccggtgttagccgatgctcacctccacttgaacttaatggataacagtgagcttacactcccggaaattatggcaaagctaaccggtcacggcattatgggttttagggaatgcggggataggagtgaattctggaaaaccgccagagaacactgctcgtatgtaaaaggtgtattttgcggaaatggtctttacaaagaaggttattacggccgaattgccggaattgccgtaaaggataccagggaggctctttatgaaatttcgcgtctttacgaagaaggggcgaagtttgtaaaagtatttgttaccggattggtgagtttaaaggaaaagggtaaagtaggggctacgggatttagtcttgaagaattaaaaaaaattgtcgatacagcccataagctggggctaatggttgctgcccatgccaatggccccgaaggaatagaaataagtattgaagccggggtcgataccttggagcatggctattacataactgatgagcttcttttaaaaatgcgggatgccggtacctggtgggttccaacggtggcagcaattcgaaaccagatgtaccgggaagaattgagtcctgcggaaagagaaaatgcttattatgtatataaagagcagctttttaaagtaaagagagcctttgaactgggggtaaagctcggacttggtaccgatagcggtacgtcgtttttggcttttggtgaagctctctgggaagagatggagctttatcttaaagcaggtattcctcccggagaagtaataaaaattgcggtagaaaataactttcaaatgatggggatatcaggtttttctggtataaggcctggaaattttgctaaatttctggggcttaaaattccctttggcgatgaggtataataaaagttgaaaatttaaacattaggaaggagagtatattatgttcggtaattttgggtttcaggaattggtggttgttttaattattgcccttattatttttggaccttccaaacttccggagcttggacgggctttgggacgcggtattcgggagtttaaaaaggctactaccgaaattgaagaaagcataacaaaagaggtaaatgcggttaaagataataatttcaaggagggttaaatgcaaaatttaactgttgccattttggccgggggtaaaagttcgcgcatggggcaaaacaaagcccttttacctttgggtacaatgaagataattgagcatctggtaaccaatttaagacctatcgcttccgagcttttgcttgttgcgaacaccgatgaatatgcttttttaaaccttccggtttaccgcgaccgttttcccggccagggaccgctggcgggaattgaaacggctttaagggttgcgtttaatgaaaaagtatatattaccgcctgtgatttaccgctgttacccgctgaaatcccccggtttttggctgaaaataccgaagattatgatgtaacggttttagcttataaggggaaaattgaaccgttaataggcatttaccgaaaaagtatttatccggtggtagaaaaacatttaattcttcggaaaaataaaataatagatttttacccccaggtgaaggtaaagataattaattttgaacaacttcccgagaatttgcagcgggaagaatttcttttaaacgttaataccccggcggattatgaaaaactgttaaaaatattcagtttaaaggagtagttcaatggagaccaatgtagctttagaaaaagctttaaatatgcttttggcttatgttcctaaacccggaacggagattgtcgaaattttaaaaagtcagaaccgggtgctggcagaagacgttttagccgacattatggtacctcctttttcccgttcgcccttggatggatttgcttttagaagcagtgattccccgcgggaaaaagggcaaaaggttcggcttaaaattgttgactaccttcccgcgggagtgccggctacaaggccggtaaactccggtgaagcggtaaaacttatgaccggggccatgattcccgaaggagccgatgcggtagtcaaatttgaagatgtggtggaagaagacggctatgtaattatcgattttccggtaaagccagagacaaatatcgttaaaaaaggggaagactttttaccaggtgacgtcatcattgaaaaagaccgggtaattaatgccaatgccatttctctattagcgttagccggaaaaaagaaagtgttggtttataaaatacctaaagtttatattatttgtacgggcagtgaactggtggatattgaacaaattcccggtccggggaaaattcgcaataccaatttatacagtatcggggcattggtggcaaggtccggaggagagcctgttttaggccgaattgtgaacgatgatttaaatttaattgcccaagaaataaaacgaggactggaagtggccgatttagtgctgaccaccgggggagcgtcggtgggggaatatgacttgataattaaggctttagaaagtatcggtgccgaaattttattctggaaaaccgattttaaacccggtacaccggtgattggggcagtagctaatgggaaaatagttattggtttatcaggaaatccccaggcagctatgacttctttcgagctaattgcttaccccgtgatcagaaaattaaccggtcggcaaaatatttaccatgcccgggtaaaagcatttttggaccacccctttgataaaacccgggggcaacggcgttttgcccggggctattgttatttaaaagaaggggagtttagggtaaaaatcttaccctggctttccccgggctcgttaaaaggggttttaaactccaacgctttggtggaaatccccaaaaattgtccgcccttaaaaaccaatgatcccgttaatattgttttaattgaaggaggaagcttaagtgcctttgatactccagatagtgggctattctaattctggcaagaccaccgtagcagaaaaattagtgcagctctttacccggcatgggtttaaagtaggggttgtaaaacacgatgttcacggctttgaagtggaccaaccgggaaaagatacttatcgttaccggcaggcgggcggagtgaaggttggaattcttggacctggaaaagcagcctttatggtggaaagggaagtgctactcgaagaagtttttgaattttaccgggatatggaccttatcctggtggaaggctttaaaaaccggccttttccccggatagaggtaattagaagtgaaatttaccaggagcctttttctccaccaggacttctggtggcggtggttagtgatttaaatttagaggtagactgtccggtatttggtttcggggaaatcgataacttattccagtttttgcttaagtactttgaaatgggcggaggagtatgagtgacttttttgaatttttaaattccgggaaggcagaactctcgccttccttttgtttggaacaccggtatttgccttttaaatgcggcaaatgtgtaacggtttgtcctgcaaatgcgatatttaaagacggtgaaaaaattgccataaaaaaagaggaatgtacaaactgcggcttttgtaaagcagtatgtccaacgggagccataagttttggtggggttactccgttaaaagaaattgcagaggtgcgggacgagggacatgttggttgtaccttgaattcagccaataccgggaaagtaaaccttccctgttacggatttttagatgccggggaaatagcaattttagcagcggcaggaaagaagcttaatttttacctggaaaactgcagcacctgtcagtatcaaaaggggaaggagctttttttaactcacctcaaggaaaccgagaccaagcttggcggtctttcgggaattactttacaccaaaagggccgtcccccaaaggatttctcccgacgggaattttttagctttttgaccggaaaaataaaagtaactgccgcaacttttcttttaaaagaagatgaagaccccaatgatatctttgccaaacgcgtgccgttaaaataccgctattttttaaaggcggtagaactcctccaggggaagattaacggggagttggaaatcggagaaagtcttaaagtcattggagaatgtaatggctgcggggtttgcgagcggctttgccctaccggggctcttcgtttaaaagagggagagttaacctttaaggctcatctttgtctaaactgtagtctttgtgtggaaagttgtccgcaaaaaattttaaaatatgatggtaaaattaccgtaaatgatgtatatttaaagacagagcaggttttagccaaagttttaaccaaaacctgcgcgaaatgtggaaaaatctttactccggtaaataatgaagaattatgccttaattgttacattaccgaaggctttaaaacggagaatttatttgaaggaggctaaaaaatatgtttggtaattttggctggcaagaacttttgatagttttagtaatagctttgattatttttggtccctctaagcttccggaactcggcaaagcttttggccagacggtaaaagagtttcgtaaaggtgccaaagaaattcaggacgaaatcgctttagaagaagcgaaagaggaaaaacaagcgtaactttcaacctccaactttatacctccactaccccggcagagctgccggggtattttttttaaatggtcactggcagaaccgtccctaacggtactattctaatcgtttcttgaacctgagagacgctaccaccagcaaaaatacccctaataccgttaaggctatagcctggttttgcagttctaaaaggccggccccccggataataatgccccgcaggatttccaggaaataggtaagggggatggcatagccgagatactggataattttcggcatagcttcccggggaaacataaagccggaaagcaagatgctgggcagaagaaaaactatggtcatctgcatggcctgcagctgggtcctggctactgtcgagattaaaatgccgatagccagtgctacagctacaaagcagagggctaaggcaaaaagggttaaggtatcaccctgcatagggacggaaaaccagttgattccgaaatagaaggctatcgtaaaggacaaaaaaccaattaatacataagggacaagctttcctaaaattaactcaaatgaagtaaccggagtcacaataagctgctcgatagttccccgctctttttcccgtactaaagcaaaagcagttaaaaggaccgtaaggttttgcataacaagaccaattaaaccaggaatagtgaaaatttggcttctaattttcgggttgtagcgaacctccggccggatgagggatatcgaagtactggctatttgcggatattttttggccaaaatttctctggtgtaattttgtcccaccaaaacccctgatgataaagcggggcgggctattgaagggtccgagccatccacgatatactttacctccggtatttggccccgggagagtttttcggcataatcgggcgggatgattaaacctgctttaattttgccctttttaaaaagggaatttaattcagcggtcgtatttacaggataatcaagattaaaataattggacgccgtaaactttgccagaagttcccggctttccggcgtgcgggagagatctaaataagcagtggcgatgtggtcgacgtcggtggagaccgcataaccgaacagtaaaagcatcatcaccggcattataagagcaatggccatactgggtttatcccgttttaactggaggaactcttttttaactatagcccaaaaccgttttggattcatggagtctcccctccaataaacttttccaagtctttaaaatcgtacacttttttcccggtggctctttccacatattcgataaatacatcttctaaactaccttttccttcctgagccattaattctgcgggcgtgccgaaagaaactaatttcccgttaaaaataaaaccgacgatatcgcaaatttccgcttcatccatgtagtgggtagtaaccagcacggaaatccctgttgcacataactttttaataatttcccagaaaatccggcgggataccgggtcaactccggcggtgggttcatctaaaattaaaagtttgggccggtgaatcatggcagctcctaaggctaaacgctgcttccagcccccggagaggtgagcggtcagggttttgcggttatccgtaagaccggccataagaaggatttcttctttccgggattttaaaagctttgccggtaaattgtagattcggccaaaaaaatcgagattctcttcgacggttaaatcttcatagagagaaaaacgctgggacatgtagccgataaggttgcgtacttcccgggtcttttttaccacatccaggccaaaaatttcagcccgcccggaagtaggcaacagagcaccgcacagcatccggatggtggtggatttcccggagccattagggcctaaaagaccaaaaattttccccgctggaactgtaaaagaaacattatctactgcaacttttggaccaaaagttttggtcaacttttcggttaaaattgctactgtcaagcttaaccactccttacggcaaggtcagggttaagagcatccccggctgcacatcctgaaaatcttttgttagctcaatttttactaaataggaaatttcactctggtcttcccgggtttcggcgggtttcggggtaaattcacctttcggggaaatataaaccacttttccggtaggagccattttgagattttcatttttaacacataccgtatccccgagtttaattctgtttaaatacttttcggggatataatatttaacatagattttgcctaagtcgattatggttgcaacggtggttccgggattaacaaactcaccgggttttacgggagttgtcaaaactgtaccacttaccggagaggaaattttagccttttctaattggattttcgctaaatccacctgggtttgggcaagttttatccctgcctttgcctggtcttcgaggttttggcctttgccttccacttgttcgtattttaaccgggctaattccaaattagccctggcagcttctaactggtttttaagtaaagaatcatcaagagcaactaaaggttggccctttttgatttcatctccttccttaacgaaaacgttattaacttttccggctatttcggcttttacttcatactggtcagcttcggcgatgccgtcaaaggaagggggagtatttttatcgccattaaggctgcacccacctgctaagagactaaatattaaaatcataattattaaagattttttggccatagccatcctccctttttactttttaagtatagtagtattaaacaaaaacactttaatttccttttaaaaaattaaaatgtggtaaaatattttaataaaaccgatttaaatgtaactttaaacttttgccttggtcatgatatcccttttaccagggaaagtcaagcaccaaccctacataatttatgaaagacagggtatatgggtagaatccctcaaaggttctgggaaaaactatagaaggctaaaatttttcttgtcgactacctcccggctttgctataatcaaaaaaagtgccgggggtgctaatggtgatttaccccgctccaatttatctttactgcaaatttttgccaaaagaaactgccatggctggtaaaaatactggtctggcagtttctgtgtttttccgggaaaagcaatttagccaaaatcctttggagagtttattagcattacatcaaaaagggcttctctttaaagcactaccggagttatctcacctggtaggcttaccccagaatcccgaacgccatcgcctttgtgcctgggggcatactttaagggttttggaggagcttcccgagaaggatttagaattaatcatggccgctcttttgcacgatgtgggaaagggtctaccgggggtacgaacgtacaaaaacggctatcccaacggattttggccatgccgagcggggagcggatatagcccggggtattttaaaacgcttcaatttcccccggcaaactattgaccgaaccgcctggcttatttattaccacatgtccgtaccctatgaagtagaaaaagtagaattttggcttaagcagcttgggaaaacactacctccgggtgaactttaccggcgggtacaaaagttaattactttaaaagaagcggataaacgctcggataacatcggtgccgaagataaaatccaggcattgaaaaaggtaagggaggaagtagagaaattttaccttaaaagtaaataaagattttgctacaagcggtaaaaagggtggtataatgaagttagaaactttaagtcgggtgataagagcgatgaaccgggtttatgaaataattaccgatacttctttggattacaaagataagcggcacttactggcggcggaggcggaaaactcccttccttatgtaaaaattagtgaaaaggctcagcagtacttttcccagggaatcttatgtgatctttttgaaggtcacgctccctaccggccgcgttatattttgccggattaccaaaaatttatggaaaagggaagcgagtacttaaatttaaaacccccgcaggatttatttgaagcggttaatgcccttttaattatctatcgctacgttccttccataacgagctatcccgtatatctgggacaggtagatgagcatttagaaccgtttgttttggctgccggcgaggaactttccgaaaaactcttaaaaatgtttttggtgcaaatagaccgggtgttacccgatgggtttgtccacatgaacattgggcccaaagatacccgtaccggacgattaattttgaagctggagcgggagcttaagcaggcagtacccaacatttccttaaaatataatgaagaaactcctgatagttttgccatagaggcggttaaaacggcattggaaattggaaaaccgtattttgtcaacgaccgggaattaaaagaagaccttgaccctgcttacggagttgccagctgctataatactttattaattggtggaggcagctttactttagttcggttaaatttaaaagaagctgccaaaaaagcgagggattttcaggactttatccggaatgttttacctgatgcagtgttggcgcaggccgaggttatcaatgcccgggctaaatttatcgtagaagaagcgaaattttttgaaacttcctttttagctaaagaaggtttaatttcccttgcccgctttacctccatggccggatattttggactgtacgaatgtattgaacacttaacgggactgaagcttggtaaggataaagaagccctttactatgccgaacaagtgttaaaaaccgccaaagatactttagaaagtgtcccgggagcttactgctacggtaccggcggcaggataggttttcatgcccagtcggggattgacagcgacatcgatgtaacgcccggggtgcggataaaatacggcgaggagccggacatttttacccagattaaaaccgagggaaggctccataaatactttgatacaggcattagtgatatttacatctttgaccggaccgcccgggaaaatccggaaggggttttaaaaataatcaagggggctttaaaagagggaatcagagtattttctttcaacacttccgattcggaatttatccggattaccggttaccttgtaaaaagaaccgatgttttaaaatacgaaaaaggcgaggttttacgggaagatacggtaaagcttggagcagcaagcattaaaaacaacaataccgaagccagaaaggtaaggataatcggtgagaggaatagtcaataaaattattgaggtaagctttatcgacggtcccggaacccggatggcaatctttctccagggttgtaatcttgactgcctgtactgtcacaacccggaaacccaaaaatactgccagaattgtggtagatgtgttgaacagtgcccggccggagccttaacaaaccttgacggtaaggtaacctgggataaggcgatttgccaggggtgtgaccgttgccttgaggtgtgtccccattcatccactcccaaaactaccctttgggaggcggaggatttagtagcttatattttggaaaatgaagtttttttagatggggtaaccttttccggcggggaatgcaccctgcaggcggattttatcctggaagttagcaaaaagcttaaagaaaaaagtaatctaacggtttttgtcgatactaattgctttctggaggaagagaaatttctaaccttatgtcaaaatatcgatggaattatggccgatttaaaagcttttgacccggttttgcaccgaaagctgaccggtgtggccaacgaattaatttttcaaaatttaaatacggcgtcgcagcttggagtactgtatgagattcgaacggtattggtgcccggcttaaacgatcatccgcaggaagtaaaaaacattgcccggtttattcgtgaactcaattcgtatacattgttaaaactgatacctttccgtaactatggtgtaaaatcttatttaaaaggcgtaccgaacttgcctgaagaaaaattttttgagctatttgagtttgcaacggaaattcttggttcccgggtttacgggaagtacggtatgtaaagtttgtatttaaattcttttgccaaaagtattgtaattttaactttatgttttataatagagtaaaaaagataagattttaccgataaaggcaaacccggcgaaagccggcgacgcaaagctacaggggctaaggccgtaaggctatgccagccagctgccgaaggtgttaaggggattattaaccctccgctttctggcaggagggtttaaaattttaaagggggtattttaatgaagaagatagcggttttagttttaacggtatttttacttgggattactttacctgcgttggccgatactgctaccaccgtgccagctaataccactccgggggtaagtgatactgtttatgccaaccaaactccaaccgtaagtgacactacctatactaccccatcggtaacggatcaaacttatcaacctgtaccggctccagcagacaacccgttgccttttgatttaaaccttttaaacagcttgtcttataatcagctaaaacagttaaaggaagaaattgaaaatcttttggagcaaaaagaggaagaacttcaggaatttaaaggaattgtaacttcctttgacggacaaactcttaccgttaaaggagaaaacgaagaaaaaacttttgtaattacatcggatacggacatggaagtaaaaggagagttaggtgctggttataaagcagaagtaaaatacgatccggcaagcaacgaggctataaaagttgaagcaaaacctgtaatactggaatataccggtacggtaatttcttttgatggtaacaatctcaccgttgcccggggaaatggtgaacaaaaaacctttagtattacggagaacactaaaattgaaggattaggcaagcttaaaggagaaaaaaccatcaaacctggttataaagtaggtgttaaatacaccttaacgggaaatgctatcgaagttaaggtaatactggcaaaggttgaaaaggataaggaaaaagaaaaggagaaagaaaaggaaagaaaaaaagaaagtaaaaaagaaaaagaacaaaaatcagaaacaaaaaaattcgtaaaaaagacatactacaaaaaaagataaacctttttaatattagccgactggtttaccgccagtcggctttattattgcatgcgaaagttgccaaggggctggcaacacaaaatgttccattttcgctgtggaatctgtcatgtacattacttgagagctgacaaaatatatacaaacagggaggagtatggtataattttgaagaatatgtcgaaatattggaatttttttatttaagaagtaaaaaatattaccgccccaagaaacgtttggaagctttggaagcttgaaaaaagggaggcttgacggggcttgaaggataaaaaaatattgatcgtggaagacagtaaatttcaagcaaaaaccatagccaatatcctgaataaatacggttataccgttgaaattgctctaaccggtgaagcggcagtcgaaaaagtaagtggtggatggtaccctgatctcatcttaatggatattgagctgggagaagggatggatggagtacaaacagcgctggcaattcagcagattagtgagctgcccgttgtttttctaactgcgcatactgaaccagcagtggtagaaaaaattcgttctgttacggcctacggatatgtaatgaaaagtgctactgaacaagtgctgataaccatagttgaaatggccttgcggctttatgaggcaaacgtccatgcaaacatgtactggcagatattagaggattcgctaaatgaaatttatatttttaaccctgaaacattgagatttcatgtggtcaaccgtggtgccaggaagaacctgggatataccctggaagaattgaacaccatgacaccccttgaccttaaaccggaatttgaccttaaaagtttcagagctctgcttgaacccttgctgagcggtaaggaggaacaaattgttttttatactgtacaccggcggaaggatggttcgctatatcccgtagaagttcacctgcagctttttgactaccggggagaaaaattgtgcctggccctggttattgatttgaccgaaaggaaagcgctggaagaggaaaacaggcgtaaagaagaacagctccgtttgatgttagaagccttacccaatcctacatatctcattaacagagaacgacaaataattgccttaaatcaggtggcaaaggaacggggagcagtagttggcgattattgctggcacagcattcatcatttaaaaactatttctcctgttgaacgtcaattttttgaaaacaccggaaaaccgctgcccggtaccaagtgttatttttgccgggcggatgaggctttaaaccgaaagcaaaaagaaaattgcgaggtaaatttggatggtttattctggaatatctggtgggtaccgatcgatgaaaatacctatcttcactatgttatcgatgtaacaaaatataaaaaaatggaagaagaaataagggagcaaaaggaatttttacggcttattcttgacagtatgccggctggagttatggtcgttgatgctaaaactttcaggattgaaaacgtaaacctggaagctgctgcgatgattggagcatctccggaagagattattggcaaaagctgctttgaaatatttccggaaagtaagggattatgtctgattacagcggtaggtcaggaaatggattgggcggagcgaattttacatagaatggatggctctcaattgcctgtacttaaaatcgttaaacgacttagaactaaaagcggcgaaaagttaattgagacttttatagaccttacggaacgcaaaaagctggaggaacagctttaccgcttatccattaccgattatttaacccaggcttacaaccgccgttattttacagaaatgttagaacgggaaatagaacgtgccaaaaggactaaaatgccctttgcgttaattatgttagatatcgaccattttaagaatgtaaatgaccgttttggacatgctgctggcgatttggttttaaaaaccctggcaaatttgattaaaaacaggattcgtcaaaccgactgtctggcccgctggggtggggaagagtttgtgattctcttaccgaatactccagtggaaaaagcagcaggcttagcggaagaattgcgggagcagttaagcatgctggagattccgggcgtaggccgggtgaccgccagttttggggtaaccggttactgtcccggagatacgcttgatacgttattaatgcgtgctgaccaaatgctgtatacagccaaagcttcaggaagaaattgtgttcgtttttccgagaaatgtccggaaaagtaggactatcaatgaacaaaatacaacttataagtttgttgaattgtaaaaatataacaatattggtaaaaaaaaaaaaaaaaaaaatatatacaaatggaaaatattatattataatattacaaaagatgtcgaaatttcatgaaaacactctttttagcgtttatgacgaatattacacccttttgccttagggtaaaagggttttttgataaaaagatagagagtagagaaggggaggttaaatgttatctatcaatattacttccttagctttatctttaaacagaaactttgggttatatgaaaaaaaagagcatctttaccgtttaagaatggcattgattggtttgcttattggaaaaaagctaaatttaagtgaagaagagatgaagaaaatatttatccattctttgcttaaaggcaatctggattcaaattgtaatataatttcaaattctatcgaagaaataatatgtctggcaagattagtagcaaaattattagggagaagaaatgtttgcatttttgttaaagataaggtacgtaaatatattttaaacgaatatttaaatgtttttccaatgactccggtagttatggcacttttggaacttatggaggaagaggcattttggtttaatttggaaaaagagtttttgtttttggatattttaaaaatgacaatgggttgggaagacaacaagattcttaaagaagaagagattaaaaaagttgctaacttacttacccgtttaattgagaataaagatgtacaaactcgagaacattctcaaagggtagcgagaattgccttacgactaagcgaagaattaaaattgtctgaggagcaaattcagaaagttgagcttgcaagtctaatccatgatataggcaaacttgctatacccgctaaaatacttcataaaccaggcaagttaactgaacgtgagtttttattagtaaaatcgcatcctttttacacgtacaaactttttgaaactgttgacggattagatgaagttgctaaatgggcaggataccatcatgaaaagctggatggtagtgggtatccttttaaggttaaaaaagaagatttggatattgaagcacgtgttatccaggtggcggatataacagctgctttgttagaaaaaagaagttaccgggattcaatggataaagaacaggtgataaaaatattaagacttgaagctcagaacaacaagattgatttggaagtttcggagttaacacaaagattgttgctggaggacgaattattaaaagatgatataacttattctatagctatcctttaagcaacataaaatgggggaattaaaaatgatagcttggcatgatagtattggaagcaatttattaaacgtaacagtaaatcttttagaatttaaaaatgaatttaatataagttgtttaagggtacttttggttgataaatttacaatattgaagaacttaatagtgataataacatcaatgataacatttttgaacattctctgcaatttttttaaggcaaaaatgttgtgcatcttgcattggaaaagttgaagccggttcatcatattgcggatggtgacgattctgttgtatttataaataatgactttgtggaagaagtttgtattcctataagttttgaaaaaaataaagatattgcagtatgtgtatattttggttttcttaatagaactgctatgtatcgatgttgttaacatcatttttgaataggtttaatctttttgcaatatattcttatgcgcttttaaaatataaccaaataattgcgattgaaagagtttttaaattttttataatgattgaagattatctgaaaaataacctgccttctatgaggttgcatgcttttaatgttgcttattggactattgaaatagctaaaaaactaaatttaccaaaagatgagcgtgagaagctttattacgcggcattattccatgatataggaaaaataaatgttaaaaacagtatagtaaacaaagagggcccattaacaccagaagaatatgaagaaataaaagaacatgctgagtttggatatgtaattactagggagttatttgataatatttacccagacatacctttttggataaagtggcatcatgaaaactatgacggaagtggttatcctgaaggtttaaaaaaaaatgaaattccttttccgagtaggattctcagggttgcaaatgtaatagatgttttacattcgcctaaaagttacaagaagcctgttactgtaaaggaactggtggaagaacttaaaagatgtacaggaaaagattttgatcctgatgtggtagatgcagctcttgatgtaattaatgaaagaattgttttaccgatggacatattaaaatccaatgttgaaaaaatatttccagcattactttcgttacgtacttttagagatgtatataattttaatgggtattttgtttttaacgaaaagcggagttatttcaaatctactgatttaaatggaaatagtgttaaagatttatgggatttacaatcggcatctctggtggtagaaatatttaattcaatgtatgagtatgaagtagaagtaataccggtagaagaacacacctatataatttcgaacattcgtcctatggaaaaaaagaattttatctcaattttatgggaattggaagcggaattaattgcagcaagtggtaagagcttgaatgttaaagtaaaaagactttctggtgattatttgttatttgctcatgataattcctgccctttggatatgtcaagtctttataaaatgaagataaaatttgaagatggtgaagagttgattttaaacggtataattacctattattataatgcatcaactaattatgctttttataaatatgcatttgtaaatattggtgaaacaacaagagataaattgtttaaacagatttttaaaaaacaaatttatttaagaagttttttaaagaaagatagatggatcaaaaataaagcaggataagtttgaagtgcagattaattctctaagcaatagcataaacctatactactaatttttttttaattttcaggcgcaaaaattgagcaagaataaaaatacaagaataaaaaatacaaatattgtcaggaatctgggaagaaactgctaaatacctgggagtttttaccgttaaacttttagtagacagggtaatttacgatctaagtccagaacttccggaagtagaaattttagagtgtgatgaaacgggctttgattttgagaaaatccgaaagtttttaagagataaccccgactttgattttggagagttagtatcaaaatttaccacaaaatatgtggggattatcgccaaactggtggatccgaaaacactacaaaacctaaaagagaaattagaaagaaaggggttttaacattggagagattggtgacgggtatagaaaactttgatgaggttttaggcggtggtattcccttgtattcaataaatattatcgctggtaatcccggcagtggtaaaacgattttagttcaaaacattttatttaacgcagcaaggagaggattaaagagtttatattttaccaccgtttccgaaagccagtttaaaatggtaagaaacttggctgattttgagttttttgataatagctttttaggtgaacaaattatttaccgggacttagggcttatcttgaaaaaagaggggcttaatggtgcgtttgctgctgttgatgatttaatgaaaaaatttagaccggatattctggtaattgacagctttaaagctttaagaagtcttgttgatagcgaaaaagagttccgagccatggtttttgagttagcctctaagttggcggtttgggaaaccactacttttttagttggagagtacatagaggaagagttgagcactttatcggagtttgctattgctgacggcatcatctatctttatggccagcaggagcggaaattccagaagcggtatttaagaatcctgaagatgcgtggaaccgggacaattcccggggaacatatttttttaattggtaaagatggaattaagctttatccccgaatgttactaagtcaagaagaattggtttatgatgtggaaaagggtttaggtttagaagtgcgggataattttggtattgaagggcttgataatctcttaggtggtggaatttaccggggaagctcaactcttttggcgggagctaccggtaccgggaaaaccctttttagcttaaagtttgctttggaagcggcccaaaggggagaaaaagagcctaagtgctgaagcttggctcttttttgtttttagggcgtaatcaagtttttccgaatgttctttaagggtaatttttatttcagcaacatcttttttaagttctgcaccatcttttcttaattcttctaccgtagcattggtattacctacaatccgaatcaattcagtcatcgttcccgttaattgatcgaaccgggctaaaaataccaaattaaacctaaatgaacataatcccataactatttccccggaaatttaaaataaacttttcactacgattctggtttttccggagacgaacttaaaatcttaaactgggggaccgtactgcacgatatcggacgaaagctttctgggaacaaggataaaaaagaaaccctggtaaaatcagggtttttattaagtatgccaatattaaaaagaatacaaatggaaaatgttatgttataatattgcatctcgaaaatgtcacatattataaatcataacaagattcaccctttgtcaatagcaaacccggcgaaagccggcgacgcaaagctacaggggctaaagccgtaaggctatgccagccagctgccgaaggtgtggatttagagttaagcctccgcctttgggcaggaggtttttatattaatttaaagggaggggatggagaaatgaaaataaataaaatcctggaaactgtttctgattatcaaaaattatttactgaagacgcaacgtttatagtttctgatctggaaaagtatttgtattatcgtccggggcgaattgattttgggtttaagccgggagataaaatagtggaaggaacattaatggagagagcgatgaagcaaaacaaaaaaattgttgccagggttgaaaaagaacaaagcaaatttggatttccatatattgcaacggtaattcctataactgatgaggaaggcgttgtaggagcaatggcggtagctttcagtacggaaacccaggatatggtaattaatatgtcggccgatttagctcgagtcaccggcgaaattagggagtcggcaacggaatttagtacttcagctgcggagttggcaaatacaaaccagcgaattgccggtgaatcaaaggaacttcaagcagaaattgcaggtattcaggaaattgttaacttaatcaatataatttccgataaaacacatattttaggcttaaatgcggcgattgaagctgcccgagtgggagacaaaggtcggggctttgcggtggtagcggaagaaataagaaaacttgcccagcaaaccaagttttcggcccaggatattagaaacaagataaatcaaagcttacatagactcaatgaattagtacagagcattcaaaacctggcagcgataagtgaggaacaaagtgcgatggctcagcaattaacggcagcgattgaagaaatttcaggggtagctgaggatttaaagaatattgcatttaagttaaaataaattaagaagtgattatgattataaaagttgtgaaggagggaaaggaatgccggtaatccagattgatgcagggcctatgtccaaggaaaaaaaagcggagcttattaaaaatcttaccgatgcagcaagttctacgctgaatattccgcctcaagcttttattgtaataattcgggaaaattctttggacaatgtaggtagcggtggcaaacctcttgcggagataaataagtaagaaaaccggaaaaagtaagatttagtaagtttataattggaaaaacttgagagaaaccttgttttttataaaaatgcaaggtttctctttttgctttatttactaaaaaaaggcttttttcggcatcaagttattagaccggaaggccctcaaaaaaaattattcttctggcgaacggagtttttgttaactataaaataaaaaacgttgacaaatgtgaaattcaaccggtattataactataaaccgagagagggggtagagccatgtttaatcggatagtagccttaacccaaaaagtactggatggcggacaaattaatcaaattgaagcgctggagcttgcgcaggctgagggcgcagatattctgatattggcagcaatggcggccaagatcagggaaaagtacgtgggggataaggtggagttatgttcaatcatcagtgtaaaaaccggtcattgtcctgaggactgtgccttttgcgctcaatcggtccatcatcatacagaaattacacccactgaaatgctcgaggaagaaaaaatcttggcaaaagctaaggctatggaagcggccggggcccatcgttttgatttggtaacggccggtctgggaatgaccgaggaggacgaggattttaaaaaaattttagctatttataaacgtttgcgtcaggaagtaaaactggaattatgcgcttgcctggggacattaaccgaaaaagcagctatgcagctgcgcgaagtcggagttactcggtataatcataatctggaaacagcgcgaagtttttttagcaatatcgttacaactcatacttatgatgaacggatagaaaccattaaaaatgttaaaaaagctggaatggaagtatgttgtggtggtattatcggtatgggagaaactatggaacagcgaattgagtttgcttttacgctaaaagaattagatgttgatgccataccgataaacgtgctcaatccaattaaaggaacaaaactggaaaaccggccgcttttatcgcccctggaagttatcaagacttttgcaattttccgcttcattttgccggataaaaatatcagatatgccggtggtcgggaggtaaatttgcgggatatgcaggctctggggttaatggcggggttaaacggcatgttaatcgggcattatttaacaactaaaggccgggaagtggaaacagatttacaaatgattagagatttaggtttaaaaatttagaagagggggccactggccaaggaaagcggtgggagataaatgtagctgcggaaaaaacggtggacgaaggctgagcgtgaaatttcgatgaatttcgttaacatgggtttggagggtttaaaatgggctcttttaactttctctttaaagccagtgacggacaggaaatttattgctaccgctgggttccggataaagagcagaaactccgggcgattgtttacattgcccatggtatggcggaaaccgcagcacggtatgagcgatttgctttggctttaaccaaagaaggttatcttgtctttgcccacgaccaccgggggcacgggaaaacggcgaaaagcattgaggaaatagggtatttgggtcccgatggatttaaccggatggttcaggacatgaaggaacttattgattttgttaaaaacgaaaaccgggaacttccaattatcttatttggccacagcatgggctctttcttggctcagcggtatatttccctttacggggaaagcataaatggagtgattttatccgggacttcctgcgatcccgggcctattgttaatcttggcatctttttggccaaaaaagaagtcgaaaaatacggccctaaacatagaagcgttcgtttaacaaagcttagctttggcaactacaataaaaagtttaaaccaaaccgcaccgagtttgactggctttcccgcgatgccgaagaagtagataaatacattaatgacccttactgcgggggagtatttaccgcaagtttctactacgattttttaagagggttaaaggaaactttccgccgggaaaacttggctaaaatccccaaagagcttcctattttcatttttagcggcgatatggacccggtaggtaacatgggtagaggtgttttaaagttaataaaaacttacgaaaaattaggtttaaaaaatgtagcatacaagctctatcctggaggccggcacgaaatgttaaacgaaattaatcgggaggaagtggtcggggatattataaactggttaaataagttgttttaagttggagaaaaattgtgaaacgaggtaaatatagtgaatctttaacgaattttcaggctttattcttcgagttccatatggtaaaatttaacatcctcgttagaaatattttttaagtattctcttttaatactaaatccaacttttttgtagcagtttatagctcttcgattaaagcttctaacttcaagggctaccgtctgatttggaaatctttttttactgttgttcaaaattactctctccttcttcatggtgacattttctcaaaataattctaaggggacaatatcacagattaataacaaaggatacctaaattcttgacatattttaaaattgaaaatagaataatactcgtaaactattttggttttttgggggtagctaagtatgattttgaccgaacgccgcaagcaatttctagagaaattaattgatctattccaaaaaacgaatgttccagttcactacgaaacaatagcgaatgcacttggcgtcagcaaatggacggcatacgacgttttgaaagaattagaaaaacttggctaccttacccgggattatacagtaaatcctaacgaaatgggacgttcccaggttgtttttatgcctactattaaagctataaatttgtttgaagaaaaacgtacaaaagaaataaatatagatgagtggaataaaataaagacaaaggtacttgagctgctaaacagtttaaaaactcacagcattagtgatgctgtacaaaaaatgctggaggaaattccaaaggttcaggtacgagtaacttttggggcatatgtcatagggttatttatcgtgtatcttagaaaattgggcggaagaacagaaatgctggttaaaagtttggttcaaaatgcacctaccagtgaaatgcgcatcataatctttattggaactgttcttggtactattattcaaacgatgaatcatgagataggggttggggtaaccgagttagtcggaaggtatttaaagtcgcttaccgatctttctgataaggaaaagggtatgcttgcggattttcttgttgaagctttagcttgaaattggtcacaaatttaagttacgacctttttattttaccaagttttttggttttttgggtatatatgtagattatttgtttggtgagatgggaagtggcgtgatggtataccccttggttaaatatttttttaagtattttttgtgtcttttgggtacaccggttattatcgggaaagaaaatattcctaaaaatatgtagaggcaatggaggcgaaaatatgtgtaaaaaacagaaggttaaagtaaggccacgtattggaatagctctgggaagcggtggtgctagaggttatgcccatataggtgtgctcaaggcattgcaggaagcaaatataccaattgatattatagcggggaccagcatgggggcagttgtaggtgcagcttatgctgcaggataccggatcgaagagttggaggatatagctctcaaaatgcggtggcgctggatacttaaccttttcgatcctactctaccccgccagggcataatagccggaaacaaagtagaaaagtactttgaaatattaacccaggggaaagagttttcccagttgcggaagcctttgactgttgttgctactgatatcgtttctggagaagaagttcgtataagtaaaggattggtggctaaagccttacgagccagcatagctatacccggggtattttctcctgttaagattgatgaacgaattttagtggacggttcggtaacaactccagtacctgtccgggcagctaaagaagcaggtgcagatattgtaatagcgattgacgttagttcaaatgtagatcagacttccaccttggttcatacctggaagaggataaaaaatatgccttctcaaaaagtggtccgttatattaaaaattcacgcttcgagattatcaatgttctagataatactttggaactgtgtgcccggcctaaagaagtttctttgaattctggacttcatggtaaacattattatttgcttaagccagaggtaggaaatattaagtggtatgagttctatcgtgctggtgagtgtattcgtgctggggaaattgcagggaagaaagtgactgaaaaaataaaaattgctcttgatactggaaattttattgaagaaggagtaaaggaaagcttttgggaattaaaagcaatctaaaaaaatctttatggctttttaagcagaagatattgactttatggaattaaaaaaaggggggtgagtaaccaatataaaagcaagcaaatggttatttttagtatttaataaagacaacattaaaaaaatacttcgggggtgactaaggtgagcaaaaaatttgggacaagtttagaatttgccaaacggtacgtaagtgaaaaaaccttgcagcagctgttaaattatctgagtaaagatccagttaacaatttagatcggatatttactctgggaaaaattttagccagacgagaagaacacaaacaagcaattttgacggttgagagaaatcttaataactatcctgcaatacgccaattagttgaaagtttattacgagacactcatcccaatgtacgtcagcgtttgctttttaacttttttataaactcgattattttcggtattccaaaacagttacaattatccgaaaccttaggatttaaagtacctcatacaattttagtggatcctacaagcaattgtaatttacggtgtgaaggttgctgggctggtgcatatgccaaacatgatgaattggagtatgaacgtttggaccgtcttttcaatgaagctaaggagttaggaatttactggatagtaatgtcaggtggggaaccctttatgtatccttatttgtttgacttagcggcaaaacataacgatatggcttttatgatatataccaatgggacaagaattgatgaaaaaactgccgataaaattatagaagttggtaatatttcaccggcttttagtcttgaaggttgggaggaacgaactgatcggcgccggggaacaggagtatttaaaaaagtaataaatgcaatggagatgttgcgggaaaggggagcggtttttggtatttctcttacggcaacacgagaaaatgtagaagaaataatgtctgatgagtttattgattatatgatagataaaggagcaaaatacggctggatattccattacattcccattggtcgcaatccaaacacggatttaatgttaactcctgagcagcgagcctatttagcaaaggttgtccctaatatccgtagaaataaacctatattcctggccgatttttggaatgatggcgaatttactcaaggttgcattgctggaggaaaatattatttccacattactgcaagtggtgctgtagaaccgtgtgcctttgttcatatttctactcataatattaacgaatgcagtcttaaagatgttttaaattcacctttgtttaaagcttaccaaaagagacaaccgtttaataataaccacttaagaccatgcccaattattgacgtaccttctgcccttagagagattgtaactgaaaccggggcaaaacctacccatcctggagctgatgatatcttaaaaggtgaagtaagcgaataccttgaccggttgtctgaagcctgggcagaggttgctgccgagatcaaggaacgttaaaaattattttagctcgaattgatacgccctgaggttacccagaaaaacgttagaattactgcaatactttaaaatgttttatgaattcttgatttgccaatatcttataaaccgctggcaaaactcatgggaatttgtgttcggaataataacaatatcttacaaacactggaaaggaagggctatataagggatgaatactcatttgcaatatgagaatatctcttggggagcgtgcgatttatggatatttttagaaggagccttttgttaggattgggattaatatctttaacgaaagaaaaaacggaagagtttttaaaggaacttatggaaagaggcaagatgagtaaagaagaagctcaaaggtttttggatgaattaattgaaaaaggaaagaaccaaaaggaggagttaaaatctgaaatagacgaagaactgcgaaaaatcataaaagatttaaatttagtaactcgtgaagaattaaatcttttagaaaatcggataaaagagttagagaataaaatacaagaaataaatctttttggggtagagtaataataaaaggagccatccgggctccttttaaagttgccaaaggctaaaagtgttaattttcatggtgggcgcggcagggttcgaacctgcgacctcttgaatgtgagtcaagcgctctcccgctgagctacgcgcccgcatttcgtaaatttattttagcatggactattaagagtgtcaattattccattcttccaatccctggaggtgtgtggtaaaattaaggaaaagtgagcaggtggttttgatgattgagactactattaatgctcagacgaaaaattatctttcggaagaagaattagttcgaatgctaaaaaatatgaagtttaatgatgaatatgctgtccagatttttaatttttttaccgatgtgccgcttgaaggcatttatcgctttttaattaaacataaccttacagagaaacagcttttaaattactaccggatgtttgtaaaaaagtattatcccaatcctgaatttgaggagacttttggctatggaatttccatgggctaaactttttaaattagcggtagactttttaaatgattccttaattcctactactgattggacttttgggggaggaagtgccctattttattatttttatcaccgggaaagtaaagatgttgatatttttttaaccgatgctcagtatctaacttggcttactccaagactaaacagtttaattgctaaaagcactgaagattatgtggaaagtgcaaattttttaaaattacaactaactgatggggaaattgattttatcatagctccatattttactgccgacccatataaaaaaattaatttacttggaaaagaaattcaaatcgaaaccccatgggaaattgttttaaaaaaacttttttatcgggcgcaaagcttaaaagtaagggatattgttgatgttgccgtggtatataaaaatcatagggaaacgcttgttagatatgcaaaagggcttggcaagaaaaaagaaattattgaaaaaaggtttcaaaatttaatagaaatttatcccaaagaaattgaaaatttaaagattttggatgaaagtttaaaagttgacgcgttaaatattttaaaaaaatttctgcgagaaatttaaatcctggaggaataaaaatggcggttattgaggtaaccggacttaccaagcgctttaaagaggttgaagcggtgaaaggggtggaccttaccgttaatgaaggtgaggtctttggttttttaggacccaatggagccggcaaaactactactatttccatgctttgtacaattttaaaacccgatgggggccagggccaggtggcgggttatgacctgtggcgggagaaggataaggtcaggcaaaatattgggttagtttttcaggacccaacgctggaccggaatttaacggcctacgaaaacctatggtttcatgctttaatctatggcattcccgcccgggaacgccgggagcggattgagatggttcttaagatggtggagctttatgaacgaaaggacagtctggtacagactttttccggcggcatgaagcgaagactggaaatcgcccgggggcttttacaccatccgaaaattctttttttagatgaaccgacggttggtcttgacccgcaaactagggcccacatttgggattatatccataaaattcgcaaagaaaaagggattactatctttcttactacccactacatggatgaggcggaaaactgcgaccggattgcggtaatcgatcagggtaagattattgccttagataccccggacaatttaaagcaaatggttggaaataatatcgtctacataaactctccggaagcagcgggaattgttacttttattaaagaaaagtttaatttagaagccaagctcgtaaaaaatcaggtagtggtggaagtaaaagaagcggaaacctttatcccggcccttttgcgggaactttcttttccggtgacttcggtgtccatcaaaaagccaacccttgatgatgtgtttttaaaacttaccggacgggaaatacgggatgaagtaggggaaaaccatagaacacctaaatttaggcgcaggaggtggcggtgatggcggctctctgggcgattttttaccgggagttaattcgctactggcgagaaaaaatcaggataataacttcgttagttcagccggccatctggctttttgtcatgggcggtggaatgggagcagcttttaccggacccggtggagttaactaccgtacttttatttttccaggaattgtgggtatgaccgtattgttttcggcggtattttcgtcaatttccattgtttgggaccgggagttcgggtttttaaaagaagtgttggtctccccggcttcccgcgaaagtattgttttggggaaagccctggggggagctaccactgcggttattcaggggatgattattttaatttttgctccggcagttggaatcaatctttctttttccatggtggtaaaagcttttgttaccatgtattttattgcccttaccatggcggcttttggaattgtgattgctgcccggatgcagtcgatgcaggggtttcaatttgtcacgaactttattgtaatgccattatttttcttaagtggagctatctaccctttaaaaggaattcccggttggttggctactttggctgcgattgaccctctggcttacgggattgatcttttaaagcacgtatttctgccctaccatgaatatagcttagctaccgatattacggtgatggctggattttgtttattgtttttatttttgggggtacttctttttaaaaaagatggataaaatttaaaatccggcaggaaaaaattatattttgttgaatatactaaatagtttgaaaccggagggatttagtttggacgagcataccggggtcatgatagaggagtttaagaggttagtccagttagttgccgagggtgtggccgataacagccggcaaattgccgatttatccttagaagtccggcagggccttaccgctattaccgagctgaaattccgggacgaactggcgtttaaccgcattgatgaaatcagccgccagcttacttctggtttacaatacatggaaagcattcagcagcagttaattgaagtgaaagccaaccaggagcgggtgctcctggtaaccaggcagttggaagaaagccttgccaagatcgacaaaaaacttgtggagtatgacaaccgcttaaaacttttagaattaaaagctttttaacccccaatatttcgggggttttattttttcggcaaattttgttaagataaaagaaaaaaggtgacgaaaatggaaaggtattattcctatacaaggtatttaaaggagaaatttggcggcaaagtatataaaattcccgtgaatcttccccatacctgcccaaaccgcgatggtacggtgggaaccggtggctgtattttttgcgaagactcgcccgggggatttgtttgtctgcccgatacccgggccatatctcagaaagtagaggagttaaaaaagtattttcaagataaatttaaagcgcaaaaatttatcgtttattttcaggcctataccaatacctatcatccgcttgcggttttccgggattatattttagcagcggtggataacaccgatattgttggcctctccgtttccacccgacccgatgcggtaaacgataaatacctggaggtgctggcggaggtaaaaaataaaaaaaatatagaagtagatgtggaacttggtttgcagacggttaattataaaaacttaatagcgataaaccggggccataccttggccgaatttatcgatgcggtcttgcgcataaaaaagtttggcttaaatgttacgacccacttaattttaaacctgcccggggaaacgttagttgatgtcattgaaaatgccaaaattatgtcagcattaaagatagattttgtaaagctccataccctgtttattccagaaaaaacggttttaggggatatgtaccgggaggggaaaattgagattatacccttggaggaatatgtccagtgggtggtaacctttttggagtatttaagtccggaagtggtggtgcagcggttaattggaaagggtcccgatgaagggattctcttttccaactggggcgtcagctggtggaaaattaaacatttaattgaggaagagctggaaaaaagggatacccgacagggggcaaaatgcgattatttaaacgggaaggcagtacaaaagtttttaagctaagttaggggggcttttggtgaaatttattgatcttcgcagtgatacggtaacaactcctactccaaagatgcgtgaggccatgttttctgccgaggtaggggatgatgtttacggcgatgaccctacggtgcgggaattagaagaacttgctgctcaacgaattggcaaggaagcggccctttttgttcccagtgggaccatggggaatcaactggctcttatgacccatacccagcggggggacgaagtgattctgggggaagattgccatatttttaaatatgaagttggggcaccggcagtattatccggggtgcagctccggggacttaagacaaatggtggcatgatggatttagaggaagtaaaagctgcgatacgacccaacgatattcacatgccgaggacttcccttatttgcctggagaatgcttacagtagcggagaagtagtgccccttcactacctggaaaaaatccgggaaattgctgaaagccacggtcttaaaatccacctggacggggcaagaatttttaatgccgctatttacctgggggttgatgcccgggaaattgccaggtatgccgattcggtcatgttttgtctctccaaaggtttatcggctccggtagggtcaattctcgccggaagtagagagtttgtggaaaaagccaggaaataccggaaattattaggtggaggcatgcggcaggcgggaattttagcggcagcgggaatggtagctttgaaagaaatggtggataggctttgtgaagaccacgaaaatgcattatatcttgcccaaaagttaattaaccttggctttgaagtggatttaaaaaaggtgcagattaacatggtgtgggccagggctaaatcgcatcttaatatagaagatttaccagaaaagcttttagcagaaggaataaaaataaatcctcccattaatgggctgtttcgtttcgtaacccataaagatgttacgaaaggtgatattgataaatttgtcgaaattttagctaaaactatgcaggtaggggaacaggtatgaatttcaaatggataattgagagttacggggaatatttagagcggataagccacaagtttcaggatatattaaccgaacaaaatggcgcctttattttgctggttgaggttagtgaaagtaacagatatgtatgccgattttgtgagtttgctggaaatgtgccctatgatttaaaaagggaaattaatgaaaaagttaatggcagtttaattccgggaaatctcgattggcttaaaacattaaccgaaccccgggtgttaaacaaggaccaggtacaaagctattttcccgaattaaatcaagttgaagtaatgcagattatacctatttatgtggataaaaacagtaaaaatataatgattattggttactttcaagatttgactccctcaagtatctcttttaatgttaatgaacttcaaaactacctttatattgaacaattttacaatctaatttttgaaataataataatgtttaacagagttattgaagaaaaagaaccgctgatccgtgggcatatggagcgagtggtggagtatgctgacctcattgccggggaaatcgggcgtgaggaaacccagcgcttgattttacaaatagcgggagccgtgcatgatgttggaaaaatcatggtaccggattttattttacagcacatcggtaagtacaccgaggaaatgagacaaaagatgcaaaaacattcggaattcggttatgaacttttaaaaaatctaccgatgtttaatgaggtggccgaagttattttataccatcatgagcattatgacggccaggggtatcccaaaggactcaaaggaaatgaaattcccctttattcccggatattggccattgccgacagttttgatgctatggtcagtgagcgggtttacaaggtatcaatgggttatgatgaagcattagaagaactggttaataataaaggtaagcagtttgatcccgaattagtagaagcttttattgcgggatttagaaaaacccgcctcttaaatcctctaaaatacaaagttccggatttgcccaagctcttttgcagagttactttagcggttggcaatcagtactttgacggaagggtttcttatagacttgaaaactcccaaaaagtgtttattaagctttatcaaactctttcatttgatatgaaagaagcttacgaaaaaccgctgaccttgtattttcaggataaggggatgtcggcctatgttcgtggccatatgcagttttataatgtgtacaaccagacgttaattttcgaggttaaggaaaatcccggatttgtggtaccggaacagtttgtatcgctgcccatttcccggggtggacttctggtaagcggcagcaataatatacctatattaatagttgagcttggtggtaacgggttaagatttgtggttaataaagcaaagttaaaagaagtaggccttgtattaaaagaaaataccagggtaacaatactttttggattaaaagttgaggaggaagagcagtattttggatttaagggaacgattatcgaaactcctaaaacatcattaaacgagtcttaccttgtgaaattcgaagatgtggatgaaaaacatcgagatagacttataagtaccctcttaaaataccagataagtttacgccggcgtggtttgctgtaataagtattgacgaaaaaataaaatagtattaatttattttttgtaaataaaaacttacctgaaggagcgtgaaaagatggaaacgagagagttagtgataattggcggaggccctgcggggctggctgcggcaatatacggagccagagcggctttaaatccgcttgttttggaacggggtgtacccggcggacaggctgctactaccgaatggattgaaaattatccgggatttgaggacgggattggcggttttgagctgatggttcatatgcaaaggcaggcggaaaagtttggggctgagttcaaaaatgccgatgtaacggggattaaaaaagaaaacggagtttttatcttaaatacttcaaccggtgaaattgcagcgaaaacggtaattatagctaccggagcggaaccaaaagaattgggcgttccgggtgaacgggaattcaggggaaggggcgtttcctactgtgctacctgtgacggcaatttctttagaggaaagaccgtggcggtagtagggggcggtgattctgccttagaagaagcgatttaccttacgaaattagtggaaaaagtttatctcatccaccggcgggatggatttagagcggcgaaggttattcaggagcgggctaaagctaatcccaagattgagtttgttttaaacacggtggtggaggaaatcgccggagagcgaaaggttgaaaaagtgatagtgaaaaatgtccagaccggggaaaagtccgagattctcgttgacggtgtgtttatttatgtgggtctaaaaccgaacaccgcttttttggaaggctttttggagctggaaaacggctatataaaaaccgatgaaaatatggctaccgctattcccgggttatttgcagcgggtgacgtgcggctaaaagacctgcgtcaggtagttaccgctgttgctgatggagctcaggctgcggtagcggcggaaaagtatctggagggaaataaatagccgtggaagtaataaaagttagcagctcaagaaaaattgagctaattgatatcacagccagagtagctgagaaagtttgtaattttcccgaagcaaaggccctaatgctttttgttcctcacactaccgccgggattttaattaatgaaaatgccgatcccgatgtcaaaagggacttagaaatgtattttgcgaaagttgttcctgaacttccctttcggcacttcgagggaaactccccggctcacatcctgtcttctttagtgggggtatcgttgtatgtgccaatcaatcagggaaagcttggtcttggaacctggcaggggatttactttgcggaatttgatggcccccgggagcgcaaggtttacttaactccagtttaaaattttaaataaaaaagccgcaaaacccatgaaggttttgcggcttttaaaatatatatagagaaaagggagaggagattaggcttcgatataagtataaccaaaaacccctgaggataaacagtaaaagtcggtgaatggtaaaaaattaagtgtaaacggtaattagaaagatttaactgaacagtatttacttttcaatcgaacatatgtactataaagtaagggggggattttagtggagtttttggcgatagacccggagcaaaaagccattaaattatttccggaggtgaacgttttctgtggtccgtattttcttggtttaaaacgggcgtatgaaaaaattaaagagcagcaggaagtagtggcactaacttacggggagatttacgagattaacccggaggtagcaacaattaagccaaaaaatgcagaatagtgcaataatacttactcagcaatggatgaggttaattttacgaaattgcaagcgtggtgaaagccgtgaagcaagtcataacaatacaggcacggttatttccaaaggcagaggagaaagaggtattagataacttaatgcgaaagtggaactcctgcaagagatatgcctataaccggttgcttgaaggaaaagcccgaaaagaactgaagaaagaactgcaaagcctctttggattgaattccagatatgtagacgatgctatttttgaagctaacgaaattttgcaaagtatcagagaacttggagaaaacccacgcaaggttatctttggcgggaaagtattgttttatagactaaaaaggaaacatttaagcagtaagcaaaggcaaaagtacaaaaaagaatgggaagataaacgcaaaggaactcttttctctcgaggtgataggtccaagcaaggtaacttaaacttaagagttattgaagaaaatggccaattctttttaagagtaaatgcaggtaatagaaaatggctgtttatagaacttaaaagttcgcataaaaaatggagaaagtttgcaaaaacaatgctaaatttctgtccttacagtgttcgcctgcagagaaagaataataaatattatgcttacatttcctttgaagacgacttaccaaatacagcaatagatttcagcaatggagctatcgggatagacttaaatgcttttccatcccacatagcctgggctgaaataaaaaaagacggcactctgaaaagctttggagaaatccccacaccacatctctgggacgggagaaaagaaaaaagagattactttgcatgggtatatgccaacgaaattgtaaaattagcccttgagaaaaacaaaggcatcgtagtagaaaagttagcgataaaagacaaaggctaccggggagattacaagggaagaaaatccagaagggtaaagcacggttttagctatagaaagcttattgccagaataaagacccttgcccagaggtacggtgtagccataagagaagtaagtccagcttatacaagcgtgataggaatgctaaagtatgcaccacaattcaacctaacaaaagatacagcagcagcctatgtgatagcccgaagaggattggctttaagggagaaaattcccttgaagtatagagagcttttgaaaagcctgcaaagcaagtcacggtcggtatcttcattaaccgaaggaaggaatgaaggtactgcggtaaaggggaaaaccttaccgtacaaaccgtggcgagttttgcgggtagccctcctgaccggagctctcctggacaggccattatatcgtgacctgtcaccgctgaagaggatgctcgtaagcggtatgggagaaggtggctgaaggccacggccagttcctgcttcttggggcaggggctatggctgtcccaaataccgccagttggggctggggcagtctgaaaggcggacaacaaataccccagccatctaaacttggcaaaaatgcacagtttagatgaccaggccaggaaaactttgtccggcgccaaagttattatcaaatataaggaagagaaagttattgtggatgctttttatgaacagtaccagcactactttgccgacaaaacaaagattactttaaaaaattatttaacccccaccgaatatcgcttgctggttttcctctgggaaaaccggggcagaattgtttctaaggaagtaattatggaaagggttttagcggattttgccggagttagcgatgaaagcctcaaatggcatttaaaaaatctgagaaagaagcttcgggatttgggatacgaaaatattattctctgtcataaaggttacggttattcgtttaataaggaaaccctttttaattttgaatttgattaaaactcccttaaatcctccctttttgctacacgaaaacctcccccgggcaaaagtaaattgctgggcggaggtgtttttatgtcgataaagtataacgaagtgatcggcttttatccatgtttaaagccgggagttggtgaaggaacgatggtggtaatgaaaggcggggatgaggtgtttctcccgaaaagtattaaaagctttcgacgagaaatattgtggtattattttgtggattttaaagccttaaggagtatggccagagctttaggggagccggtacctttggttctgggggaacgggtgttcgttcccttaaaatttcgccaccgtgcttttgccggggatttttgttatggttatttttctctggatgaaattgttttttgcggtgggaaggggaaagcagcaattattttaagttgcggtaaaaaatatggtttagcttgccgggtaaaaacagcaactgcttcgttaataagggcaaaaatctttcgtttggagataagtttcagaaaataagttatttttttcaccaggcaggaaattaaaaaaataaagagaaaaatatgaaaattaagaatatatataatattagtaaaaaagatttaaattgtatagtgtatacaaagttgattttttatttttcaacataaatttattcagcaaggagggaaggtagtgaaactttttgaataccaggtaaagaaaattatgagggagttcgggattttagttccccggggtgaggttttttttgatttagagcaggccaaaaaccatctggaaaaagttggcgaaggagtaatcaaagcgcaggtattaaccggtggcaggggtaaagccgggggggtaaaaatcttttccaatccggcagaaggttttgaactggcggaagctatcttgaagatgaccattaagggagagaaagttcaggcaatcttaattgaagagaaaattcccattgagcaggagctttatttatcaatttttgtggatggacggattaaaaagccggtagtgattgcttcaaaagcgggtggcgtggacattgaagaagtaccggaagaggaaattttaaaacttcccgtagacccgttaattggagttagaaattatcacggaaacctggtggcgcaaaagctgggacttacgggagatttaggaaaacagcttgctactttgttaattaacttataccgcatttttgaaacttaccaggcggagcttgtggagataaatcccctggtgatttcccgggaaaagcttatcgccgccgatggcaagatgacggtggatgatgatgcgcgttttcgctggcccgcggaccttccctttaacgaagaaaaaaccccgttggaaaaaagagccgaggaaattggcgtatcctttgtcgaactggatggggatatagcggtgatggccaatggtgcgggaattaccatggctactttggacttaattgcctattttggcggaaggccaaagaattttatggatgccggtggtggggctaacgccgagcaaatggccaaagcgctggaccttttaatctccaccaatcccaaggcaattttaataaatatttttggcggtataacccgttgtgatgaggtggcaaaagcttacttaacggtgaaacaggagagggaaataacggtgccggtggtgattcgcctggtgggaaccaatgaagatatcggggtaaaaatgcttcaggaggcgggagtggaaagcttttcttccctgcgggaagcggtgattaaagcggtggagcttgccaaagttgggggggataattagtggctatcattattaccgaagaaacgcggatagttgtccaggggattacgggtaatcagggacggtttcataccgggaaaatgctggaatacgggagcaaagttgtggccggtgtaagtcccggtaaaggggggacagaggttttaggggtgccggtttttaataccgttttagatgcggtaaaaaataccggagccaatacctcgatattgtttatccctgcgccctttgttttggatgctgctctggaagcaatggaagcggggattaaaaccattgttattattagcgagcatgtacccttacacgatgctctgaaaattatgcgggtggcagaagcctacggagttaccgttgttggtccaaacacttttggagttatctccccgggaattgccaaagttgggattatgcccaataccatttaccagaaaggtccggttgggatcgtggcccgaagcggtactttaagctaccagattgcttatgaattaaccagggcgggtttgggtcaatcgacggtcgtggggctggggggagatcgaatagtgggactttccctggccgaagtgatcttaagccttgcccgggatgaggaaacccagggaattgtggtggtgggtgaaattggcggtacagcggaagaagaagcggcggaggtcattcgccacattaataagccggtagtggcttttattgctggaaaaacagcgcctccgggaaaaagaatggggcatgccggggctattattgagagggggcggggcacttaccagagtaaaattgatgccctctggaatgccggcgctttaattgcggaagtgccctgggaagtgccggtgttaatgaaatcagctttggttaagtaggagggtgttggggatggctgttgaggagaaaaaagtggttttagactcggggatcgaggtcaaaaccgtttacggccccgatgatcttgcaggctttaactatcaagagaaactcggtgaaccggggcagtacccgtatacccggggcattcagcccaatatgtaccggggaagactgtggacgatgcgccagtatgcggggtttggtactgccagggaaaccaatgcccgttttcactaccttttacaacaggggcagacggggttatcggtagcctttgatttacccacccagattggctatgattcggaccatgagctggcccggggagaggttggcaaggttggtgttgccgtggattctcttttggatatggaagagctattttccggaataccccttgataaagttagcaccagcatgaccattaatgcaccggcggcggttttactggcgatgtatattgcgttagccaaaaagcagggagtggaccccaaaaatttaaacggcaccatccaaaacgatattttaaaggagtatgtggcccggggaacgtatatttttccgccggaaccatctatgcggattattaccgatatttttgccttttgtaaaaaagaagtacccaagtggaataccattagtatttccggctaccatatccgggaagcgggcgcgactgccgtgcaggagttagcctttaccatcgccaacggaattgcctacgttgaagcggcaattcaagcgggcttatcggtggatgaatttgccccgcgtctttcctttttctttaacgcccatttaaacttttttgaggaaatttccaaattccgggcggcccggcggatttgggccaaaatcatgaaggaacggtttggcgcgcaaaatcccaaaagcttacttttgcgcttccacacccaaacggccggctgcacccttactgcccagcagcccaaggtaaatcttatccgtgttgcctatcaggctttaatggcggtgcttggcggtacccagtcgctgcacaccaacagttacgatgaagctttatgtcttcccaccgatgaagcggctcttctggccttacgaacccagcaggtgattgcttatgaaattggcgttaccgataccgttgacccccttggcggaagttattatgtggaaagtttaaccgatgccattgaagaaaaggtctgggagtatctaaagaaaatcgatgagatgggtggggcggtagaagcggtgaaaaatggttttatgcgccgggaaattgagaagagcagttatgagtaccagcgggcgatagaaaagggggaaaaaacggttataggagttaatcgttttgtaattgatgaggaaccgccaaaggatttattaagggttaacccggaaattgagaaggtgcagcgggaaaaactacaaaaattaagagcaaatcgggataacgaacgggtggcaaaagccttaaagcgcttaagagaagttgccgaaagtaaggataatatagtttaccccattttagaagcggtggaggcttatgcgactttaggtgaaatctgcggagttttacgggaagtctttggtgagtaccgtcaggaataggggggttacgatgcgaaaaattcgggttttaatagccaaaccgggtttagatggccatgaccggggagctaaggttatcgctcaggcgctgcgggatgcaggtatggaggttatttatacggggattcgccaaactccggaacaaatcgccaaagcggcggtggaggaagatgtggatgtagtcgggctttcctgcctttcgggagcgcacaatgagcttttcccccgggtagtggaatgtttaaaagaactgggagccggagatattccggtaatcgggggaggcattattccccatgaagatcacgcttacttaaaagagaaagggattaaggcgatttttggtcccggaagtttgacggcggatgtggtgaaagtgatagaagagctggtaagggaggcgggaaaagatgtttaaaaaaatcgaccatataggcattgcggtttcgaatttggaacaggcagtaaaaacttttgagcttttaggctttcaaattgcgggaacggaggaagtaccggaacaaaaggttaaagtagcttttttcccggtgggcgaaagtaatctcgaattattaatgcccaccgatgaaaaaagtgctgttacccggtttttaatgaatcacggagaaggaatccatcacattgcttttttagtggaaaatttggaagggatgctggccgctttaaaggaaaaaggttttaacttaatagatgaaaaaccgcgccctggagctcacgggaaaaaaattgcctttatccatccgaaatcaactaacagtgttttaatagaactttgtgaggtggtggacgatggagaataagttacaggaacttaaccggaaaagacaggaatcccttttggggggcggcgaaaaaaggataaaacggcagcacgaagcaggcaaacttacagcacgggaaaggattaaccttttgttggatccgggaagtttcgtcgaattggatatgtttgtgcggggagaacagggagagtttgccaagagcgacatggaaaactacggggaaggggtggtaaccggctttggtaccatcaatgggcgcacggtttacctcttttcccaggattttaccgtttacggcggatcactgggggaactccattcggccaagatctgtaaggtaatggacttagccatgaaagcgggagttccctttatcgggcttaacgactccggcggagccaggattcaggaaggggtatattccttgagtgcctacggaaatattttttaccggaataccctggcttcgggagttatcccgcagatttcggtgattatggggccgtgtgccgggggagcggtttattcgccggcaataaccgattttattttcatggttgataaaaccagccagatgtttattaccggcccccaggtcattaaatcggttaccggtgaagaagtaagtcccgaagagctcggcggtgctatgacccataaccacataagcggcgttgcccattttgtgggggaaaacgaagaaatcaccctgagtatggtgcgaaagcttttagagtaccttccccagaacaacatggaagaaccgccggttaaggctccgctaccgccaaaatattcgaccgaagagctcctggatatagttccggaagatcccaaccggcagtacgatgtccgggaggtaattttacgcattgtcgatgacagcgaattttttgaagtgcataagtattttgcggaaaatgcggtggtgggttttgcccgcctatccggaagggtagtgggtattgtggccaaccagcccaagtatttagcggggactttggacatcaatgcttccgataaaattgcccggtttgtgcgtttttgcgattgctttaatattccgcttctaacctttgtggatgtaccgggctttttgccgggaatcaatcaggagtacggtggaattatccggcacggagccaagatactgtatgcttattccgaagctaccgttcccaagcttacggtaatcctgcggaaagcttacggtggggcttatgtggccatgtgcagtcgttctctgggagccgatgcggcttttgcctggccgaccgcggaaatcgcggtgatgggccctgacggtgctgccaatattattttccgggatgagatcgcccaggcggaagacccggccaaggtgcgggcggaaaaaacggcgatgtaccgggaaaagttctgcaatccctatgtcgcggctgccaaagggatgatcgatgatgtgattgatcccagggagacccgggaccgtttgattaaagcccttctggctgtaagtaccaagagagaatcaagacccatgaagaagcacggaaatattcccttttaacaacccccggggaggtgataggggtgcaggaaaaaatcttaatagccaatcggggtgaaattgccctaagaataatccgggcttgcaaagaactgggaataacttcggcggtggtttataccccggcagataaagatagccttccggtgaaaatggccgatgaagcttaccccttaaaagaaaataagagttacttaaatattgaggaaataatcaataccgcattaaaaaaccaggttaccgcaattcatcccggttacggctttcttgcggaaaactctaagttcgctaaaagctgcctggatgccgggataaaatttatcgggccttcggccaaagctattgaacttatgggggataaagcggtagccagggaaatcatgaaaaaagccggcgttccggtaattcccgggtccgatggcgagattgatgatttccgggaagccctgaaggttgccgatgaaattggctacccggtaattgtcaaagctgccggcggaggcgggggccgggggatgcggattgttcacactcccaaggaattggaagaagcgattcaatccgcggcccgggaagccgcgtcaacctttggtaattccaaattatatttagagaagtatcttcaggactgccggcacgtggagtttcaaattttagccgaccagtacgggaacgcggtttatttgggagagcgggactgctccctgcagcggcgcaaccaaaaggtaatcgaagaaggaccgtgccacgtcttaacggaaagaatgcggaaaaaaatgggcgaactggcggtgcgctccgccatggccgttcattacgccggggccggaacggtggaatttttgctggatgatcggggaaacttttattttattgaaatgaatacccggatacaggtggaacatccggtaaccgaaatgattaccggcatagatatcgtcaaggaacaaataaaaatcggcctcggagaaaggttaagcattacccagaaagatgtgaaaatttacggacacgctattgagtgccgggtaaatgcggaagacccgatatcgtttattcctaccccgggggaaataaaaaaattaatgctgccccaggggccttttgtccgggtggatacggcagtttacgaaggttataccataccgccttactatgattcgatgattgccaagttaattgtctggggaagaaatcgggaagaagcgattatcaggatgaaacgagcgctggaggagtttgtaattggcggtgttaccaccaacttaccttttttacgcaaggtgatggataatgccttttaccgccggggtgaggtttataccaactttatcaaacgccggatggaacctttaaccgaagaagacctggaaacctaccgggataaacagatatttggtgccgaaggggagcaagaacaacctttagaggaaataattgctgcggtagctgccgcctttgcggccgatcagacttcaaagaaagaaacgcgggagcagcatttaacgttatctccctggaaaatcggaggccttttggaacaaatgcagcgtcggctttttagaggaggtgtataagatggtaaaaaaatttaaaatccgggtaaacggccgggaatacgagatagaggtggaagaaatccacaccgaaggttggggagttttaccaaatacccgggatatagaacgaaaagcggttggttcggaaataagaagcctttcttcgcctgtaccggcagcaaaggccagtggggcttccgcggggataaaagctccgatgcccggagtggtggtagctattaaggttaaacccggagatacggtagggccccaggacgtggtgataaccattgaagccatgaaaatggaaaatgaaattactgccggaagaagcggggtggtagaccagattttagttgccgaaggagatacggtacaggcggggcaggttttgataaccttaaaataaaagggccttttggctcttttttcttttaattaaaaggattttgggttattataaagaaaatagataaataaatttacatattcagatggaggggatggaaggtgaaaataacttttctgggtcatgccgcttttttagtggaggaagaagggcttaagttcttgtttgatccttttttaacgggaaatcctcaggccaaaattcgccccgacgaaattactgccgattacatcttggtaagtcacggccacggtgaccacctgggggataccgtagcaattgcccaaagaagcggtgctaccgtaattggtgtttttgaactttgcaattttctttcccgccagaacgttaaaacccatcccatgcatattggcggaagatataactttgggcagtttacagtaaagcttactcccgcctggcatggaagctcctttggagaagggccagtggaatacctgggaaatccctgcggctttttactttccgttggcgggaaaacattataccataccggagataccggactcttttacgatatgaaattacttgccgaaatagacccggtggatattttactggtaccgattggtggcaattttaccatggacgttaaagatgcgctaaaagctctggaacttgttaaacccaaatatgctattcccatgcactacaacacctggccggtaattgctgcggatgtcggggaatttcaagataaaggccgggctttaggagtagcaatcaaagtattgaatcccggggagatggttgttctttaaaggaaataatgataaaataaacgttagattttccggcggaggagtttatgaaagagccactggtaatgtatcgcgaagggttttggtatttggttgccttaggagttctaacagtattaggagctcttattaatttctggctgggccttttggtgtttcttttgtttctttttgtcgtttttttctttagaaatccgcgaagaaccattccggaagatgaaaaagcaattatttcaccggcggatggtgtggttttggatgtagcggaagtgaatgaaagctattacttaaaaggtccggcggttaaaatcagtatctttttatcaatttttgatgttcatgtcaatcgagccccggtggaaggacaggtggagtatgtctactaccgtgagggaaaatttcttccggcgtttaaaagtcacgcttcggaaatcaatgaacgaaattacattgggataaaaaatccgtatcttcaggtgttggtggtacaaattaccggttttattgcccggcggattgtaagttttgtaaaaccgggggacatattaaaaaaaggacagctactgggcatgattaaatttgggtcgtgtaccgagatttatttgccgaaagaaacggtggaagttttggtgcaaaaaggccagcgggtgtatggtggcattacggttatcgggaggattaagggatgattttaagggcaataccgtcggtatgtactcttttaaatttagcgatgggcatgctttcaattattgccacaatcaatgagaactacctattggcagcggttttaattttgataagcgtgttttccgatggcatagatggcaggctggcccgtcgttttgcggtagcttcggattttggcaagcagttggactccctggcggatttggtatcctttggggtggctcccgccctgttagtttatgccgatagtttaagcggttacggctatattggtttatttattatagtggtatatacgatggccggtgcctggaggcttgcccgttttaatattttagacattaccggttattttatcggcgtacccataacttttgccggaggttttaccgcggtactggtacttttatcgttaaaacttgcggcttttccgccggtagcgtttctcgttattactcctctattggcttatcttatggtcagtagaataaaagttcccaagtattaatttttcattaaagtaagtatgaaccaatcaccaatcccttttagcaatcgtatactatggtagccctaaaaggagggattggtgtgcgggtaatttatattcctttaccgggtattttaaaatccataattaaactttttcttaagtaggcgggtccatcccgtcttttttgttattttttgcctccttttggtattgctttggggtcatctggaaggcttttttaaattctttgatgaagtacgaaatattttcatagcccacctcatagcaggtttcggtgacgctctgatattgtaatagttccttggcttttttaagtctgagttcttttatatattcctttggggttttgcaagtataggtcttaaaatatctgcaaaactcatactcttccattccaaaaattttggcaatatcggctactttaatgttcttatgataactttcattaatatagcttaaaatattgttgatcctggcgttctttacggagtttataatttcctttgcacctctaaattttaatatttcatagagcatttcctggatatagaggtccagcaaaaactctttgcccttttcctggctgtttaaggtccttacaatccttttataagtttccaacatttcctcagtaaagttacataagaaaaagtaattggtaattttttttatttcttcatagcctaattcaaattggatcctctcaattaactgattaacaacattattatcgacttcaataacaagagctttggttttattttcgatgtttaagtctacctttgaattaggggctaagattgcaaagttctctttagtatattcgacgcgctctaattcatttatcgaaacttgctttttaccttctaaaattgtacaaattcttaagtaattcttggaatagtaagtagctttaactggtttaacaaaatcataatataaaattttcgccttttcggtatcaaactctttatcgggggttaaactaggtaaaagcattattttcacccctcgtgcaattttgggttattttttgcaaaaacgggttagattcggcgttttttgcttgttataattttatcaaactttaaaaataaaatgaataggaggttataaaaatgaagacgtaccgtttttacatgccgccggttagcctaatgggtattggctgcctgaaagaggccggcgaggaaattaaaaagctcggttttaaaaaagctcttattgtaaccgataaggtactggttaagattggtcttgttaataagttaaccgaaatcctggacaacgaaggaatcgagtacgttatttttgatgaaactaaaccaaatcctacggttaaaaatgttgaagatggtcttaaaatgttaaaagagaacaactgtgattttttaatttcctttggtggaggttcgcctcatgactgtgccaaaggcattgggctggtggcaactaatggtggctccatcaaggattatgaaggggtaaataagtcggctaaacccatgttacctctggtggcggtaaacactactgctggtaccgcaagtgaaatgacgagattttcaataataaccgacgaggatagacacgtaaagatggccattgtcgactggcatgtaactccgataatggctgttaacgatcccgaattaatggtagagatgccaaaagctttaactgccgcaacgggtatggatgccttaacccatgctattgaagcttacgtatctattgatgcaactccggttaccgacgcggcagctttaaaggcaatcgagcttatttttaaatacctgaaacgggcagtagaaaatggaaaggatattgaggcaagggataaaatggcttatgcggagtatttagccggggtagcctttaacaatgcaggcttaggatatgtacacgcgatggcccaccagctgggagggttttacgatcttcctcatggtgtgtgtaatgctgtattgctacctcatgtgcaggcctataatctgcaggttgtacccgaaaggtttattgatatagctaaggcaatgggaataaatgtagaaaacttaacggcaaaagaagctggagaaaaggtacttgaagcaattaaaaatctttcgcgggaaattggcataccatcgggtcttaaggaattaggagttaaggaagaggatcttaagactttagccgaaaatgccctgaaagatgcttgcggatttaccaatccaaagcaggcgagcttagatgatattatacggatatttaaagaagcaatgtaattttaactgcatcgatagactttttgccgtttaatattcgccaatacttcgggtattggcgaatttctttgcctctggcatttacccgttgaatcctaataccccataaaaaaaattaatgatatttgtcgaaaaaatcgctaaggaaaagaggaattttcccctgaaagaagaatataaataccgtatgaaaaaccttatctttgacgggaaagggataggaggtgaagataaacaccttaaaaggtgtaaaacattatgaatgttctaaattatacaaagctcagagatgaaaaatttattgaagaggttgaaaaggaaagcggccagcatttgagggattgctaccagtgcggtaagtgtaccgctggttgtccggtggcgtatgccatggattacaccccgaaccagattatgcatttatcaaaaatcgggataggggaagaggttttacggagccggaccatctggatttgcgcttcctgcaacacctgtacgacccgttgtccgaaaaatatcgacattgccagagttatggacagcttaaggataattgcccgccgtaaaggttatacggcaaacagccggaatgtagcggcttttaaccggattttcctggatatgattagaaaatacgggaagctttatgagctgggtttaattcttaattttaacctgaaaaccggtcaaccctttaaagatgccagcttaggaccgaaaatgttagccttaggtaaactgacctttttcccatccaaggtaaagaattcgggagaaattaaaaagatttttgaaactatagaaaaactggaagttcaaacagctgagccgaacaatgtaaaatagtacaataataaaataactgttttgcaatacaaaattggaaggtagcgaaggtaatgaagcaagtcataacaatccaggcgaggttattcccaaagaaagaagaaaaagaaatattagataacttaatgcgaaagtggagctcctgcaagagatatgcctttaaccggttgcttgaaggaaaagcccgaaaagaactgaagaaagaactgcaaagcctctttggattgaattccagatatgtagacgacgctattcttgaagctaaagaagttttgcaaagtatcagagaacttggagaaaacccacgcaaggttatctttggcgggaaagtattgttttatagactaaaaagcaagcatttaagcagcaagcaaaggcaaaagtacaaaaaagagtgggaagataaacgcaaaggaactcttttctccagaggggataaaaccaagcagggaaacttaaatttaagagttatcgaagaaaatggccaattctttttaagagtaaatgcaggtaatagaaaatggctgtttatccagcttaatagttcgcataaaaaatggagaaagtttgcaaaaacaatgctaaatttctgtccttacagtgttcgcctgcagagaaagaataataaatattatgcttacatttcctttgaagacgacttaccaaatacagcaatagatttcagcaatggagctatcgggatagacttaaatgcttttccatcacacatagcctgggctgaaataaaaaaagacggcaatctgaaaagctttggggaaatccccacaccacatctctgggacgggagaaaagaaaaaagagattactttgcatgggtatatgccaacgaaattgtaaaattagcccttgagaaaaacaaaggcatagtaatagaaaagttagcgataaaagacaaaggctaccggggagattacaagggaagaaaatccagaagggtaaaacacagttttagctatagaaagcttattgccagaataaagatacttgccaaaaggtacggggtagccataagagaagtaaatccggcttacacaagcataatagggatgctaaagtatgcaccgcagtttaatttaactaaagatacagcagcagcctatgtgatagcacgaagaggattggttttaagggagaaaattcccttgaagtatagagagcttttgaaaagcctgcagagcaagtcacggtcggtatcttcagctaccgacggaaggaatgaaggtactgcggtaaaggggaaaaccttaccgtacaaaccgtggcgagttttgcgggtagccctcctgaccggagctctcctggacaggccattatatcgtgacctgtcaccgctgaagaggatgctcgtaagcggtatgggagaaggtggctgaaggccacggcaagttccatagcttggtgatgggactatgggagtgtctaaataccgcctgctgggaatgggcactctctgaaagggcggactacaaatagcccagcctcaaactgtacagttttgtacagtttgggataccagggcggcaattaatgaaatacgcatactatcccggttgttccctccactcaaccgctaaggaatacgacaagtccaccaaaaaggtggctcaggctttaaacattgagctggtagagattcccgattggaactgctgcggggctactgccgggcacagcaccagtcacttactggcggtagctttaggggcgcggaatcttgctcaggcggaaaccttgggtctggatattgctgcaccctgcgctgcctgttaccagcggttggtggtggccgaaagagaaatgaaagaaaacccggaaatccgggaaaaaatcaatggtactttagcgcggccgtatgaaggaaatacccatacctactctctggtggaagttatcgccaaggcaaaggaccaaatagaaaatttgaaagttaggtcttttaccggactaaaggttgcagcttattacggctgtctattggtcaagccacctcaaattatgcagtttgacgacccggaaaaccctcagattttagatgatttggttaaagcgaccggtgcggaaacggttgactggtcttttaagaccgaatgctgcggtggagcgctggcggtttccaataccgaaattgtcttaaaacttacccgtgatatcctgcgggtggctaaagaccgcggagcggatgttatcgttaccgcctgtcccctttgtcagtccaaccttgacacccgtcaggggcagattaaagaagtttacggggacgacttcaacctgcccatattgtactttaccgaattaattggtttagctctcggtttaaaaccggaggagcttggcttaaatacccactttgttagcaccaaaaaagtactggagtggagagatgcacgatgaagagaataggagtatttgtctgctggtgcggttctaatatcggtggggttgtggatgtcccgagagtagctgaggcggcaaaggaaatgcccaatgtggtgtttgctaccgattataaatacatgtgttcggagcccggccaggagctaattatcaaagcggctaaagagcacaacttggaccgggtcgtggtggcatcctgctcgccgcgtttgcatgaacaaacctttagaaaggctgccgaacgggcaggacttaacccctatatgtttgaaatggccaacatccgggagcacgtttcctgggtccatgctcaagaaaaagagaaagcgaccgaaaaggcaattgaactggtcagacgggctgtctttaaggctgcacgcttggagcccctttacaaatcagccatcggtatcacaaaaaaagccctggtcatcggtggtggtattgccgggattcaggcagctttggatattgccgatgccgggtatcaggttatattggtggaaaaggagccaaccattggcgggaaaatggcgcagctcgataaaaccttcccaaccttagactgttccagctgaatatctaccccgaagatggcggctgcggcgcagcacccaaacattaagctttatacttatgcggaagttaccgaagtttccggttatattggtaattttgaagttaccattaagcaaaaggccaaatcggtggaccataataaatgtaccggatgcggtacttgctgggaaaaatgtcccaccaaagttgatagtgaatttgacttagggcttggtaaacggaaagctatttacattccttttgcccaggcggttcccaataagccggttattgaccgtactacctgccggcaatttaccaaaggcaagtgcggcgtttgccagaaagtttgtcctaccggtgctgtagattacgaccagcaggatgaatatattaaagaaaaagtcggagccattatcatggctaccggctatgacctgtttgagtgggaaaaagtctacggtgagtacggttacggtcagtatccggacgtgattaccggattacattttgagcggatggccagtgcttccggtcctaccggtggcaagattattcgtccgtccgatggcaaagagcccaaaacggttgtatttattaaatgcgttggttcaagggatgaccaaaaaggcaagagctactgctcccgggcctgctgtatgtatactgccaagcatgcgcaccaggttttggaaaagattcccggagcgcaggtgtatatcttctacatggacgttcggacagccggcaagatgtacgaagaattttacgccaaaaccctggaagatggtgcccagtacattcgcgggcgagtatcgaagatttatcctttaggagataaattaattgttcgcggagctgacaccctggccggagttccggtggaaattgaagccgacctggtggtcttggccaccgctatggtaccggccaaggggtcggaggaaattgccaaaattgtcggcttttctttagataaagatggcttcttccaggaagctcaccccaagcttgggccggtggagaccactaccggaggcgtatttttagccggcgcttgccaggggcccaaggatattccggacacggtagcgcaggccagtgcagcggcggccaaggttatcgggcttttatccaaggatcagttagctgccgagccaatcgtcagccaggttaacgaagcactttgttccggttgcgaattatgtaaacccatttgtccgtataaggctatcgacatgaagaagattaccgaacgggttcacggtaaggttatcgaacgcaccgtggcaacggttaacaccagtctgtgtcagggttgcggagcctgtaccgttgcctgccgggtaggagcccttaacctcaaaggctttaccaacgaacagctcctggcggaggtggaagcaatatgtctgtagagcaaaactttgagccgaaaataatagcgttcttttgcaactggtgtagctacgccggagcagacctggccggggttagccggatgcagtaccccaccaacttgcggataatccgggtaccctgttccggccgggttaatccccagtttgtcatcaaagcttttcagcggggcattgatggggttttggtatccggctgacatcccggtgactgccactatgttagtggcaattactacacccgcagaagattccttttaatgaaacggctttttgaatttattggttttgagccagggcgttttcatgcccgctggatttccggctcggaggcccagaaagtggtggaaactgccaagaaagttaccgaagaggtgcgggccttaggaccaaacaagaagatgagggatgaccgatgctaaaggaaaaaattaagtctaccgttaccgaacttttggaaaataaacaggttgattttgttattggttacggcgccggttccgatgccgggaccgtgcggccggctttcgtaaagtcggtggaggaagtggagcagcttatttggtcgccctttgcggttaataatttagcgaaatttgtgatggatcatttgtatgaaaatataaaaattggggtaattgttaaaggttgtgattcccgttctgtaatccggctggttcaggacaaagtattcccccgggagaacttttatgtaatcggtataccctgtaagggtatattggataaaaataaagttgctaaagattttgacctttccggggatttggtagattttaccgagcagggcgacgaagttatcgtaaaaacttcaaaaggcgagtttaaacttcgcaaagaagattatctactggataaatgttaccggtgtgaaaccccaacgcccgttgtttacgatgtgttattgggcgaggaagtggctccttttagaacggacgattatgaagatgttaaagctattgaaaacctttcggtagaggaaaaatccaggtactgggataaacagtttgaaaaatgcatccgttgttatgcctgccggaacgtttgttctgcctgtaactgccgggattgcgtttttgacatggcagaacccaactgggtgggtaaagcggctaatttatcggaaaataccgctttccacttaatccgggcgtggcacgttgccggacggtgtgtggactgtggcgagtgttcccgggtctgtcctatggggatacccgttaacaccttgaaccgcaaaatgattaaagatatgaaggaactgtttgccgtagaaactccgggcaaaaatcccgagcaggggccggttctggggacctttaaaaccgatgatccggaagagtttatgtagttaaacctacgaggtgacttaaagatgagaaaaggatacatcttaaaggaaaatcttaaaacctggttaggggcaattaaagaaaagtttcccctaatagccccggtacaggacgatggtctaaccctttttagagaagtggaaaaggttgacgatatagtttttgattacggaattacccggatgcctccgaaggatcttttctttccgcaaaccgaaaagatgtttcgcataaaaaacaagaacaatgtggcgattgaattggaatccccggaaaaaataaccgacgaacaggtactgtttggcgttcattcctgtgatttaaaaagcattttggctttagatccggtctttaccacctgttttcccgaccgttattatcaggaacgccgggataaaacctatgtgataggtttatcctgcactaaagctttacccacttgtttttgcaccgcctatggcatcaatcctaccgatgccgatggggctgatgttcatttaaccgaggttggggataagtaccttgtggaagtggttaccgagcgcggggaaaggttagtttcggctattcccggaatagtttttgaagataccacgaatttagaagcggaaaaagctaagcttaccgaaaaggttaaaggagaaataaagtttattgacttaaccggggttaaagaggtgttggatgaaaactttgaacttcccctctgggaaaagtgggcgcaaaaatgccttggttgtgggatctgtacctacgtttgtccgacctgccactgcttcgatatcaatgattttaaccggggtgacggggtcggtgaacggtttagatgctgggattcgtgtatgttttccgattttacccggatggctggcggccataacccgcgtcccacgaaaaaggaaagggttagaaaccgctttatgcataagttaaagtaccacctggaccggtatagcatagtggggtgcgtaggctgtggccgttgcgtccagcgttgccccgaaaatatcgacatccgggcaataatttccgacataaagggtggggtgtaatggcactggaaaatcctttattaccgtatattgcaaccataaccaaggtgattgatgaaacccccgatgtgaaaacttttcaaatggtttttgacgatcccggggtatttgaagtttttaaacaaaaaccaggacaagttgcgcagatatccatttttggggtgggggaagccaccatttctataacctcttcgccaaccaggacgggaatgctcgagttttccatcaagaaggtgggaagacttacttccgttatccaccagatggagccaggaatgaaggtgggaatccggggtccctacggcaatcattttccctatgaaatgatgaaaggaaaggatctcctttttatcggcggaggtattggtttagcgccgctaagatcgcttattgactttgttttagccccggaaaaccgcaaggattacggtaaggtggaaatcctttacggagcccgttcctccgccgacctttgctttaaatacgatttatttgacaactggcccaagcagccggacaccaaggtttacgttaccatcgaccgtcccgaagaaggctgggatggccatgtgggatttgttcctgcttacctggaagaactgaatcccaatcctcaaaataaagtaaccattacctgcggacctccgatcatgattaagtttgtcttgcaggcgttggagaagatgggttattccgaggaccaggtggtaaccactttggaattaaaaatgaaatgcggtattgggaaatgcggacgctgcaatatcggaagcaaatttgtatgcgttgatggtcccgtctttactttgcgtgaccttaaaaaactgcctccggagttttaaaaaattacccggcgtatgccgggtttttattttgtagaaatagcgtgaattgtgtagaaatattttgataaatattctgggcgaagggaaaggaatattaaacaaagtggcgaaatttatagaatgatgaacattaaagggggcagttaatgattttttgtgttttaatatcgtttttctttcttttaacgttaatcttagtctttaatcaaaaaggtctttttacattaagcattaaaaatagcaaaaaaagtaaaatattaaaaaagattttgagttttaaccggctcacttacttgtattttaccattcttgataattctcccaatataattatcgcaatagataaaaataacaaagtgatatttttaaatagtagagctgaagaggtctttggtataacaaaagaagaaattttaggaaaaaattatgaaatattttttcaaaaattcggggttttggagcgctctattttaatggattctttgaagtacaaaaagacctttgaggtagaaaattatccgatagaggttaagaactgtgtaaagcgtttctggggaaaaagttatccgctttttgggccaaagggagaaatttccggagcagttttggtactttgggataccaaagataaacaaatattaacgcgggaattaattaaccaggagaagttttcggtggttaaaactattgctaccggcacggctcatgaaattagaaaccctttaactactgttaaagggtttatccagcttttaggccaggaaaaattaaatgacccggagagtaaagtatttttaaacaccgttttgcaggaaattaatcggattgaaaaaattatttccgagttattaattttgggaagcgataaaggacttaaaaaaacttttttcaacttaaattacctgattgaaaaggttgtagaaaattttactccgacagcgtatttaaacaatatttctattgtaaaaaacctggctaaagaattgcctttattttatggagatgaagaaagcctctatcttgccattacgagtattttaaataatgcctttgaagccctgcaaaaagatggggtgattgtaattgaaactttttatgaacacggtagtaacgagataggtttaaggattgcggataacggaccgggaattccggaagagctaagatcgaaaatttttgaaccgttctttaccacaaaaccggaaggcaccgggcttggactggccatttgttaccgtacgattgaagaacacgggggtgaaattagagtatataacaacgaaacgggtggggcgacctttgaaattactcttccgttacccttagaaaatgctcacacccaaaattccgccaattgcgccggctaaaaggataattaagcttttttctaaaaaggaaacccaggaaaagggtgtgtgaaataatactgcagacgcgattaaaaaaataacgataaagattactccgattaaaaggccgtgccaaaggccttttttttgcgccctgcgacttgcggcaaagccgccggctaaaaggcttataaaaagaaccgcaaagcttaaagctgtccaccaggcaaaattggtgataaaataataaaaaataacggcaaagatcgtacctaagaaaagtaaagttccgagggctattatcgtaccccagaaaactgctttaaagttcattgtataccccctttaccatcgtttcttcagtaaaaaatatgaacaagcttattttttcagaaccgaaggagtgaggaaaatggcagaaattgcctatgaacttggtaacagtttgtatatcaacttaactaaccggtgtaccaatgcctgtgtattttgcatccgaaaaaccgagaagggggtcggttacgacctctggttagaccgggagccggataccggggagataatcgctgccctaaaagaaaaagatccgttaaaatacgaagaagtggtattctgtggttatggtgaaccgcttttaagaataaaagaggtggtggaagtagcccggtggttaaaagaaattggggtcaaaaaagttcgtatcaataccaacggccttgccaaccggtatcatgggagaaatattttgccggagctcaaggggctggttgatgtaatctccatcagtttaaatgctcaggatgccgaagcttaccagaaggtgagccgctcccgatacgggcaagaggcgtatgctgaagttttaaaatttatcgaagaaagcaaaaaatatataccggaggtagtggttacggtggtccgctgggaaggagttgatgtggaggagactaaaaaagttgccgaacgcctgggagtcaagctgcgcgtgcgggagttttatggaaattaaaattaaaaaattaaaaagtgcttgacaaaaacgacaaaatgtaatactataaaatcaaagaaataccccccgggggtataggaggagaagatgtacgttcgcgataaggaagggataactaagcggttaaagcgtttggaagggcaaattcgaggtattgccaaaatggtggaggaagaccgctactgtattgatattttaaatcaaattgaagcggcaaagggggcgctcgacaaagttgcgttgttaattttagagggacacctgaaagggtgtgttaagagggcgattaaaaccggtgaagaagaaccggtaatcaaagaacttttagaggttttggataaatttatacgataagggggaatttaaaatgtgtgaacattgcggagctcacaatcatgcggcagagcaaactgtggttttaaaagtcgatgggatgacctgcaaccactgcaaaatgtctgtggaaaaagccctttatacagttaacggggtaaaaatggctgctgtcaatcttgctgaaggtctggctaccgttttatacgacccgaacctggccactgttgaacaaatgaaagcggccgtagaaaaagcgggctatgaagtggtaggcgtacagtaaaaagggggagtaatcccctttttttaacaccaaaatcagggatggttattgctacctgcgactaaacgccaaaaaatctaagtttggcgttgggatgcgcctttggggatggtgattgcgatggagacggttaatttaaaggtttacgggatgagctgtgccgcctgcgtgaaaaaggtagaaaaaggtatcagcggtgttcccggggtggaacaggtagtggttaatcttattaataaccaggtggcggtaaagtatgacccgcaaaaaaccggcatttccgattttgccagggttatcgaggatttgggttatgagatgggagttgctgaatataagttccgggtcgaggggatgagttgcgctgcttgcgtgcagaaggtggaaaaggcagcccgcgggtttgctggcgtccttgatgccgtagtaaatctccctgcccagcagcttacggtaaaagcctacgaaggggttttagatgttggccggcttaagcgggaaatccgggaactggggtatgaaatctttaattttgaggaaattgaccctttggccagggagaaagaagcccgggaaaaggaaatccgccatcagcggttaaaaatgatagtagtatggcccctggctatcttggcaatgataggtaccatgcgccatttgtggatatttaaatattttgtgcccgaatttttgggaaacaactattttttgatggccattaccacaccggtggttttgtatggcggttatgagttttttgttaaaagttatcaggggttaaagcgcggagtaaccgatatgaaccttttatacgctaccggtattgggtcggcgtatttaatagcagtaattaataccctatttcccaatgccggttttggcgggccgaaggcgaccttttttgagtcagcggctcttttaacggcgtttattatcttgggccgttatttagaagcgctaacccggggaagaacttcggaagccttgagaaaattaataagcctaaagcccaaaaccgcccgggtgctaataaacggtgaagaaaaggaaattccggccgatgaggtggaaataggcgacctggtggtggtaagacccggggagacaattcccgtggatggggtggttgaacggggaaccgcttctgtagatgaatccatgctgaccggggaaagtttgccggtggataaaggcgaaggcagcatggttcttggaggtagtatcattaaaacgggagctttaaccgtaaaggctacccgggtgggaaaagaaacctctctctcccggattataaaacttatggaggaagctcaaaccaccaaagcgcctttgcaaaaacttgccgatgtggtagcgggcaattttattctcggcgtgcacattctggcgctggttacttttttcttttggtttttttacggttaccaggcctattttactcctgaaactcgctttctcatgtcaccagccaagattgccgaaatgggagttttcgggttttcgatgctgataagcttaacggtgctggtaatttcctgcccgtgtgcggtgggcctggctatgcccagtgcgatcatggctggaaccggaaaaggtgcggagtacggtgtcctgtttaaaaatgccgaggtaattgaaaaaatgaccaaggtcaaagtaatagccttcgataagaccggtaccataaccaaaggggaaccggaagtgacggacctcattccttttgaaataaatgaacagcaacttttggaacttgctggagtggctgagaaattatccgaacatcctttagcccaggcaataattaaaaaataccgggaaataaaccaaaaggagccttctgagcctgcaacctttcataatataccggggaaaggaattatggccacgtattccggggtaaacatactggcgggaagcgaaaagttcttgcaggaaaaccgggtggatacatcactggccggagaaattgccaaaaaacttaaaggggaaggcaagacattggtgtactttgcagccgatcataggttggttggagttatagccctagccgatacagtaaaagaaagttccgccaaagcaattgaacttttaaagaaaaaaggttacattccggtaatgctgaccggggataacgaagttaccgcccgggctatcgcccaaaaggttggtatttccgaagtggtggccggcgtcttacccgaaggtaaggtagaagcgattaaagcttatcaagaaaaaggttatatggtagctatggccggagatggaataaatgatgccccagctttaactcaggctgatgtggggatagccatgggtaccggtacggacatcgccaaggaagcgggagaagtggtgatagtaaaaggagaccttgtcgatattgtcaatgccatggacattgcccgggctacctttggcaaggtcaagcaaaacttcttctgggcgtttgtgtataacaccctggggataccttttgctgcgggagtgttttacccctggaccaaggcgttagtaagcccggagctggcagctcttttgatggcgtttagctcggtatcggtgactttaaatacgcttcttttgaaaagatttaagccttcgggaaaggcggtgggttaaatgaccgaacaagaagcattgagaaaaagccgggtgatatactggacgttatctctgttaacgggttttgtttttttagcattggctttggtcaccggtgattatcgcttaaccgaactaattggaggcttcatctgggttacctttttaatgctgataataaccatgccggtggtaataccgtattacaagagtaaggttaagtaaagaaaaaaggctaactcccattgaagtggagttagccttttttaaatattcattaaaaaggatttacattttttacatcgatagtttttgaggaatctactatctgagttccgccaaggtcttttgcagttattttcaccttatagataccgggggcgacaaaacttatagcgttttttaagtcccaggcaatttgcaccggaccatccataaagttattgcttataagattttttacaactctgttgtagctatctaaaatttggacagtgaccattgccggacggctcaaggtaaagcttatgctggcaaaattgtaaccatttgcggttctattatatacggcgctatttacacttactgtacccagacttagtgaccgattatccagtacaaaataattgctgtagatatcgaaaggattaccggttacatcactacccagtaaacggaaataatatacgccgtaacttacggaattaaaaacagggttaccgtagacggaaaagtttaaggtgttgcttccaagcttaaaggctggataaagggtatagacctccgagttaacacctttttcgtaaactaaaagggaaaccgcacccggaggctcaaaaaagttaaaggtagctttaaggaattttttgggagcaacagcgtgatagttatcgcttgcaccgggcattaccaggtcgtatcctttaaaagtaacaccgttagtattgctggatttttttactatagctatcaacggtgagacataattgtttttggtattgccagccagatcttttaaagtaaagacaaatacataactaccattgtttacgaatttaccgctgctggtaagcccggaccaggtgacaaaattagcacctgctttttgcggaacaccgtttaataaagtggctaccactgtacctttacctttaacattatcataggctgccacttgcacggttacataactgttttcacttaggttatactcggcaataaacttttccccagcaacggggtcaaagtaacttttcgttattacggtattgtttttgtcgtatacttcgtaagtagtggaagatacggaaatgtcaggagctatattatcaaaataaacgtactcgtaaacaccgcttgcaattgtgttatttaaatcaaagatatacactttataaaaagcactggtagtgaaattttttaaatcggtattttttaacgacaaagaaaattttccgctttttacggaagttgatttaaagagcttttcttgattgttttgatcgtagattgcagctccaatggtgtcggcggtagaataaccagcaaccgttaaatttttgccattaaacaccggtggacttatagtgacgtacagacctttttgtacttcccccagggaaataaagctaaagaaaactaaggcgataaaagtgataaccaggattagggggtaaggcttggctttcttcacgctaatacctcctaaactttagtaaactcgaatgtccttggactaaatacccctcttttaattaattcggaagaaaaaaatattttttaagtaaaggtagactgaaatatgtgaaatggtgcagggaattgaaaaaataagacgaatttatttatcgaggtgaaacgtatgtttgatttaagtccggaactccaaaataaacttcgtgaattaaacagtttattaaaaaaccgccgggaaaatttaaaaaaccgggtggccataagagaaatgcttaaaaaccgtggagctaaatttattaaccttaagaattatgacagcaacgaaaacctcctcattaccggaatagacggttcggtaaattactacggagtctacccctatcgcatcttttttttccaggcctatgcggccaccccgaaaggcgataaaattatagtaagcgatgtcaaagcaccttttttagaggataaaccggacgatgaccccaaagatcgtgtgcttccggctttagagcttgaagcttcattaaaggcaatagaccggtttaagccggatataatgctttttgatgggggatttatccgttaccgccggcacgctcccgaaaggtgggaacaggtggaaaaggcccttttggaaaaggatgtcttgggaattggaattattgaagaagcccagtctcaggcaattgccaaaatcgtaaccgaccagataggggtttacgaccgggaaattctttttggcctcttaaatcccggagaggcacttttctttgacgaaacgttaaaagatggtttctttacggtttttgcaagacttagcaggcatccccaggctatcgcggtggatttcttagagagtcaaaaagaacgggcgaagatggcgttagagcttttatatgcactaacgccggaagattctcgcggaattccttttttccttgatgtcatcgattccaagactaaattatcgaaagaagcggtagagatactccttgcttcttgttttgaccgagaaattttagagttatacttacggccgcttagggaagaacggttactttaaaaggagaggatcaaaggtgcgggttgttggtgttagcacccagcagtttgtttatcttgcgtcggagagaaaaaagttttatgttaatgaaattttagtaatcgaagacccggatttgggaaaattacggggggtagtcattgaagctaaagccataaaccgctatcttcccctgtcctttgagaaaggaacggtccttgaccaaaaagtttttgatagcttaaccaggcttggctttaatcttgccgatgaagaagttaatattgcttacgttcgcctcctggatacggcggcccttccggtaaaagttggttccccggccagggttccgacttttcccgaagtagcggacctgttagtacgccaaacaccggataaaggactgatcttaggggagattgcgggaagcgaagctttaggaacactgccgccggaatattctaacttgtactgtcttcttgaaaatacagggccggtaatgggaaaaggcgttccctttatttttgactaccgctctatggctgattacccacatataggaatttttgggggttcaggctcgggtaagtcgtttggattaagggtccttttggaagaattaatggccaagaaaattccctgcctcgtttttgatccccacggggagatggagttttccgaaccctatccgggaatccccaaagaaattgcccgggattaccgggatagatatctttcattaaaaattggggacgaagtggggattagattttcggagcttaccactccggaactggtgagtcttttaaatgccataagcagcattagcgaatcgatggaaagtgccgtggaagctttatttgaaccgggaaaagatagtgaggttacctttggggaaaaaatcaaagcattactggaagctttggaaaatgaaaaattatataaagggcccgtacccgattatttggaaggagaaactttaaaaagacacctgtttgtccgggaaatttatgagaaatacggctaccgggtaaaccagtaccagagtttaaaaggtattctctggcgctttgaaagtttaagagccaaaaatctttttgccaaatcggtagcgattgcccaggaggctttgcttcagcgaaaaacggtagttatccggggaaatttgagcttacttaagatttattctgcctatcttttaagaaagctgtactatgcccggcgaaattacgtggatttacgcactttcggagaaaccggcgaatattttcccccgttttttatcgtaaccgatgaagcgcataactttgcccctaagggagagaaagaaacgcctacccggagaatattgcgggaaattgcccaggaaggacgaaaatacggggtattcctgacgttagccacccagcggccggcccttttggatgaaactattaccgcccagctatccaccaagtttattttccgcaccgttcgggctaccgatatcagcaccattcgggaagaaacggatattaccggggaagaggcagccaaacttccctacctgccttcgggtttagcttatataagctctgcctggatcgggcgaaccgtaccggtaaaaattcgagccgctcacaccaagagtccgtatacggagaatccttttgatgagttagtcgaaaagacatcagtagcttcggaaaaattactggcaacattaaaaaaatttctccccattagaaccacttcgctgaacgccctgttaccgtatattggcgatgagttagggcgggaaatcagttatgatgaaattatcgcttttttaaatgaccaggtggaacagggggttttcgtaaaaattgatcacggtccctttggtttcgagtatgttttaaaggagtagagaaaatgcgttttttatatataaccgatacccattttcgcgggaattcgccccaaaaccggatggatgattttccccaaactttaagaaaaaaaatggaggaagtggtacaggtagcccaggaccttcaggtggaggccgttttgcacggtggggatttgtttgaaattcccaatcctgcggtaaacgttgttggtgatgtggtaagatttttaaaagcactggggaaaccgttttacattgttcccggcaaccacgacctttttggccaaaacccgcaaactttaaaccgcaccatgctgggcttgctgggtcaggtagggcttttaaaaattttagaaccgggagaaaaagttttctttaaaaaagacggaataagcttgcagcttaccgggcagggttatcactttgacctcgataccgaacgggggcgggaaggctatctggtaaaaaataaagaagcggaccttgccattcacattgtccacggtatgcttttagatcggccttttttccagacggtggcgtataccttaattgatgatattaaagaaaccgaagctgatttaaccttaacgggtcatgctcatcttggttttaacgaaatcgtcgttaacaataaaaaatttataaatcccggagcattagttagaaccacggtactgccggcggaagtaaaccgttggccgcaaatggtcttaattgaagctgggaaagacggaattactactaagtttttgcccttaaaaacagcactacccggggagcaggtcttaaatattgaaaaggcgacggaaatgaagttacgggaagaacggttagcccggataatcagcgaagtaagatcatccggggatttccgcagtttaaagctggaaaatatcctgcgggaaattgcccaaaaagaacagctaccggaagaagtccgggaagaagctttaaaaagaatagctcaagcggaaatagaaatggcccgggaggaggtagacgatgtaccttgaaaaattaattctggtaaattttcagtcccataaatattcggaatttaattttgcaccgggcttaaatgtcatcgttggagaatcggaccgcgggaaaacggcggtaatccgggcgctgcgctggcttttttacaacgaacccaaagggagcgagtttatccgggtaggagaaagggaagcaagggtgaccgcccatttttctaacggcttaattgtttcccgggaaaggagcgaccggaaaaaccgctatgttttaataaaacccggggaagcaccggtagttttcgaaaagtttggtcaggaggtaccaccggaaattagcgaagttttgggagtgcaaaaaatccgcctggataaagattgggaagtagctttgaatttaagtacccagttagaaccgccttttttacttttcgaatcggccacccgtaaggccaaagctatcgggcagtttcaaggggtgcatcttttggattacgcggcgaaaaacgtatcccgggatatccggaacatcgatgaagagatacgttataaaaatactgaaattgccgcattaaaagaaaaacttgaggagtttgcggatttgccgcacctttccgcaagattaaataacttaaaaaccagaaaatttattgcccaaagtgttattgaacgcttgaataacttaaccgcccttcgggaaaatctggaacaggtaaggcagaaaattcaagaaaatagagatatagttaaaaaatttggggtggtctcggtagaaaaattttggaaaatcgaagctttgtataaacgttatcaggaacttttaaagttaaaggaaagttatacgggaattctacaaaagaaaagagaagctctggaaattctaaaccacaccacagcgctacccagggcgaaagagtatttagaggaagctatggatacttactttaagctaaaaactttacagcaattggcggaaaaacggcaaaagattagcgaacagaaaagaaaacttctgtatataatcagtatcttaactccggtggaagttaccgcaaggaaataccaggagatattgcccgactgcaaaaaacagcaggagttacttggtaaataccaggagttacagaaacttggcaggcataaaacttattacgcgggaattatttacaaataccggaaaataccggaattggcccaaactttaaaaaatcttgaagaaaaattaaaaaggtatgaacagttaacggttctctttcataacctttcggggatacaccggaggaaaaaagagcaggaaagggaacttgagagaattaagcaggaggtagttagcctgcaagatcagtatagagaggcgctcctgcaggccggacgctgcccgacctgtaatacacctctggatgaaataaccgtgcaaaagataatctttggggaggtagtgcgatgaattttgaagaaaagctcaatcaattaaaaaagggaatagacacagccttaaaccataaaaaccgggcggaagcccttttaatgcacgttcaggaacaggaaaaagaactcttgcggcaaattgaagaactcggggttgagccggacaaattggaggaagaaatcaagcgcctggaagaagagctgacccggcaaattgctgaaatggaacgggaaattccctgggacttaattgaaaagttagaggcgaaggccaaatgagagaaaaacttttacagttagaggaagcgttaaatcaattagaacagtattatcttattcggaagggtcaaaaggagcaaatagaaaaagaacttttggaaaaagaagagaagttaaaagagcttaccgcggagcgggataaactcgaaaaaacccgttatctcttactggtggccgggcaatacgcccgggaacaggcgaaaaaatatctggaagatattgctacaagcactctgcagtacgtgtttggcccggaaataagcctggaaatagaactttccgagcgggccggagccaatactgccgagttttttgtggtatccgattacggtagcttaaaagtaaaaaaccgcccggaagatgcccggggcggcggagtggtggacatcctgtccttagctttaagaatatttttattaaatgccgttgaaccaaaaattaaaggtcccctgcttttagatgaaccgggaaaacacgtatcggaagagtttgtaggttctcttgccctgtttttaaaagaaacatcccgccattttaaccggcaggtaataatggttacgcacaatcaaaacctggcgggaattgccgataaagcgtttttagtggagttaaaagaaggggtttcggaagtaagggagttaaacctttaggggacaaacggtatttctccctttattttttgcctggtagagcgcactgtcggcagcttttaatacttcccgaaaagatttcccattttgcgggaagtgtccgatgccaatacttatggtaagggaaagttccagatcgcgagccacggagtttcggattcgttcggctatttgccgtgctttttcgggagaggtttccggtaaaaggataagaaactcttctcccccaaaacgaaagactttatcctgtttcctaacagagtttttgattataccggcaattttttttagtgcttcatctccggctaaatgacctaaagagtcgttatactgcttaaaaaaatcaatgtcggccattaagattgcgtattcaaaatttgactggcttgtttgccggtcaattatttttgcttctttttctaaaaaatgccggttgtataagcctgtgaggttgtcggtataggaaagatttaaaagctcccttacttcttctgcggaatagttttccctttggctggttttttcctttaaatttactttaattaatacttccgttaaggctattgttaagaatggtttaaaaatacttgtcaaatcaaaaggggtgtgataaaaaatagtagaaagtagcatcccggtgaaaatagccgggaaaaagaggacactttttaaagataggtttaaaagaaaaattaaagggtaagaagcaaaatcgttccagttgaaggtaaaataaagggtacttaaaaagtaggtcgctgtcaccaccattggcttacttaaatacctgtttagatgagaattatagacaaaaattaagccggataatgtcaatagcagcaaaataagaaccggggagtttacattaaagaccaataataaaagcaaaatcagcccttttgttaaattttgctccatctttttcacccaaaccttaaactaaaataccaaaaatttaattcaataaatttccaaaaatccctgctaaagtcaaggcaaaaaattccaacaaattccgctatagaccccaagaaaattgcaaaaaatatttacggaggtagaatttagtgtttaaaatatccgtttctacaacttttgacgcagctcattttttaaaagattatgacggaaaatgtgccaatttacatggccatacctggcgggttgaagcagaagtggaagggcagacaaccaatgatttggggcttttaattgattttggtatgattaaagattatttaaaagatataacttctcgcctggaccacaagcttttaaatgacgttttgcaggttaatccaactgccgaaaatattgcccggtatatatttaaagagttaaaagcaaaacttattgtctatcccgaaataaaactatgttctgttaaagtttgggagtctcccaataacgctgctacctatatggagtgatgatatggaaaaagcaattgtgttactttcggcgggtcttgattctacggtttcccttgcttatggagtaagaaattttcaggtggtgctgggcctgacctttaattacgggcaaaaagcttcccggaaggaaatcgaacacagtaaaaaaattttggattattacggtattccccaggaagtaattgaactaccgtttttaaagaagattaccaaaacttctctggtggctgaagatcaagaaatacctactggtatagatttggaaagtgctgctgccgttaaaacctcaatggaaaaagtttgggttcccaatagaaatggtctttttattaatatcgctgccgcttatgccgaaagtttgggagcaaaatacataattacgggatttaatgcggaagaagcaaaaacttttagcgataactcgcgggagtttgtggatgctgtgaatcacgctttaaaatacagcaccttaaatcacgttcaagtggtcagctttacccaaaatttagaaaaatccgagatttaccgcctgggagttgaactgggggctcctctggacttaatctggagttgttactacggcggagacgaaatgtgcggggtatgtgaaagctgtttaaggctaaaacgggcgcggggaggaaattaaatgtttgctcgctttatcgaccaaaaaattgattatgacggatctcaacttcgacctcattttatctacgaaaattttggtttaattggcgatgcgataattgcctttcgcggtaaggccgaagtttcggatcacctggtggatttagaggataaaaaggaaaacgcttttatttacagtgaagacatgcttcattttctcgttgaacattttgaccaggatttggaaaaggcggttttaagacagcggcttttggtggccatcattaaagaaactctggaagctttaatcgataaaccaattgtccggatgggcgatgacctttatattgatgaccggaaactttccgtatcgattgctaccaagtccctagtttcgactttaattcataccggcataaacgtaaaaagcgataatgcaccggtggcggcaattggtcttgcggatttaggactggaaagcagggttgaatatcttggacgcttaattgttcagcgctatggcatggaaatggaagcgataaatttggcaaaggctaaggtaagaggagttttttaatcctgaaatcgaggtgttttttcttttatggcaaatattgtagaaatctttccatcactccagggagaaggtttgtatgccggtgtttccaccctttttattcgcttttccggatgtaatttaaactgcagttattgtgacaccgaagatgccagggaaaaaagggaaagatttacggtaacgaaagaagacggttcccttttagaatttttaaatccggtaactccggaaaaattggtggaaattttgcgagaaaattacgattttacctactttccacagcttgccctaacggggggagaacctctccttcacgcttcctttttaaaagaatttttgccaaaattgtcttatcccggagaggtccttttagaaactaatgggactttgccggataaattaaacgaggttttaaattctgtagacataataagccaggattttaagttaaagccttttattgcggaagattgttttacccttcaccgggagtttttacaggaagcttcccgcaaaaaagtttatgtaaaaatggttatctctcctgaagttcaagattcggagtttaacggggctataaacgagattgctttggtaaattctaaaatacccttaatattgcaaccggtaatgccaataaattattctcttgattttcttttccaaaagcaaaaaatggctttaaaaaagctttgggatgttcggataattccgcaggttcataaacttctgcagctaaaataaggtattggaggcgttttcatggttgataaagaaaaaattgaaattgccgtgcggatgattttggaagctattggagaagatccggaccgggaagggcttaaggatactccgaaaagagttgcccggatgtatgaagaagtttttgcgggactgtcgcaggacccatcagaacacctggaacggtattttaccgaagaacacgaagagatggttctggttaaggacattcccctgtattccatgtgtgaacatcacttgctgccattttacggtaaagcccatgtggcctatattccgcgcaagggaaaggtaaccggtctttccaaattagcccgggtagtggaaggttttgccaaaagaccgcagcttcaggaaaggcttaccagccaaattgccgatgctatcatggagaagctcaatccgcggggagttttggtggttattgaagcggagcacatgtgtatgaccatgcggggggtcaaaaaaccgggttccaagaccattacttccgcggtgcggggtatttttgccacttcggttgccacccgggcggaagcaatggcgttaattgggcatcaatcacccttaagggattaatacgatataataagaaagaggtgagtttagtgagcgagaaaaaggaaggaaagctggaactcatagcccagaagcattttacaccctgggatgaaatgtatttggtggtggattttttaaacaaacatttaaaggataaaaaagtgatgtttggtttaaacaaaaaaaacggcgagatggtaatgtccatttacgaagtagagtaggtgggaagggtgcggattttattaaccaatgatgacgggatttatgccccggggattaaagctttaaggcaggtattggaaaaagaagggaaatatgagctaacggtggtggctccggaccgggaaaaaagtgctaccggtcacgggattaccgtccaccggccgcttcgggcttttgacattacttttaaaaacagcaaggtgcggggtgtctcggtggatggtaccccggcggattgtgttaagctggccgtggaagcgcttctcgataaaccgccggatttagttttatcggggattaactccggtcccaacctcggtaccgatgtgctttattccgggacggtttcggcggccattgaagccatgattaacggcataccggccatagctatttccatgggttcttttgccttcgaagatgaggaatatttgagggctgcggagatttttgcccgcctgttaccccggattttagaacatccctggccccgggacactatcttaaatattaacattcccaatgtacctctggaagaaattaaagggatagccattacccggcttggagtgagaaagtatatcaatgtttttgaagaaagaaaggatccccgggggctttcttattactggatgtccggggaagcggtaaattacgaaaatggccaggacaccgataccgcggccctggcgcgcaaagaaatttccattactcccgttcattttgaccttaccaattatcattacttgaacgagcttaaaacctgggtaaaagcgttagaaggggctttggccacgggctaaagtctcttcggctcttttaatcatcagttttaccatgttacccccaattttaccgccgacccggccgcagtcgcggcttgcaacgttgccccagtaatcgttagccgtatcaatttttcccgtgattcccagctccgcggcgatttcgtacttaagggcatcggcgacgtcggcggggagaagagttccctcaggagtaaattttgccatctttgtttcaccccttctttttatttttattattgctgacggtgacggtaaatattttcgcaaaatggtggtaacggtgttattttttttgtataataaaatcgaacatacattcgaaagagggaagttttatgatagagtatgtgccattaaacattaaaaccggatatagctttttggaaagcagcattaagcttgacggtttaatggagaaaaccgctcgccttggcttaaaagcagtgggcattgccgataccaatctttttggcgctgccaaagcgttttttgccgcgaaaaattttaatttaaagcttcttttagggcttgaagttaaaagtgaggcaggacccctctggctttacgcccgggataatgaaggttataaatttttggtgcgggcagctacccaaaagtatttcggtaaggaagtactgtcccttgccgaaattttggaagcccggggccttatcatccttggcggggcagagtttttagcggcggggttaaaaaatgttcttaattttaaagaggcgtttggcgatgatttttacctcctggcaaaggtagacgatcttttaactaatcccgaaaacatcagagcacttttagctattgccaaaaaataccgtttaaagattgctggaagccccaatccccgctttttagaaaaaaaccattatttcttctaccggctgctgtgcgctatgaaaaacaatgtaactttagaccagattaagaaaagaacttccccttatgcttactatctttcaccaaacgagatggcgaagatttttgcgccgattaatcatagtttaaagaccaccctggaaattgccgaaaaagttggggacttttttcccggggatgacttgaaacttccggagtttacctgtccgggagaaaaggatgagtatttaagaaagctttgccttgaaggggcctatgcgcgctatggccggatctcccgggaagtaaaagaaaggcttaactatgaacttgagatcataaaacgcctggggcttgcaggctattttttaatcgtgcatgatttggtacggttttccagatcccaggatttagctttaggtcccggacggggctcggccgcaggaagtcttgtgctttatcttttaggcgttaccgaggttgatcctctaaaacacggtcttttgtttgaacggtttttgaaccccgggcggaaagttttacccgatgtggatttagattttggccatctggaccgggagaaagttatccgctatcttttccaaaaatacggcgatgacggagtagcccatatcggtacggtaataacctttgccgcccggggtgcggtgcgggaagtggcaaaggctttgggctatcccgagcctttacttaacaaaataacccctcttctcccggcttttggcgggagcagcattgaaaaggccgttagggctttgccggaggtacgtaaagctttagaagatccggtaatgcgcaagctattaactttagcccggttttttgaaggacatccccggcacttttcggttcatgcttccgggttggtagtggctcgccgggaagatttagagcaaattcccctggcttcctcttttcgcggtgagaaaattacccagtttgacaaggatgatgtggaacggttaggatttttaaaagtggaccttttgggtttaaggctgttaaccgttgtccaccggagtcgaaggagcgcttctattcccctaaacgacggggaaacctggaaaaggattcaaaaggcccagaccatcggttgctttcagctggaaagcgatggtatgcggtattatcttgggaaagttgctccccgaaatattgaagagttagcccaggtgctggccctttttcgcccggggccgttagagagcggacaggtggacaactatctgttagccaaacaccaaaaagccccaccggtataccctcatcccgctttaaaaccggttttagaggaaagtcacggtttagttctttaccaggaacaggtgcttaaaatagcggcgttagttgccggctttgatcttgccaaaagtgatgatctcaggcgagcgatgtccaaacacgaccggaagattatggcggaacttaaagaagagtttatgatgggagcggtaaaaaacggttattcggctgctgacgcggaaaaaatttttagcctgttacaaaactttgccggttacggatttaataaagcccacggcgtatcatacgcttatctggcttattactccaccttccttattacccattggcccaaaacttatttcaccttacttttaaattccgatgggggattttatccaccgtccttttacctgagggaagctggacgaagagggattaaaatcctgcttccggatattaacgaaagccagtacggttttaccgaagttaaagacgggattagaataggctttaaagatatcgaaggggttggccccaaagcggcttcaataattttagaagggagaacaaggccctacacgtctttttgggatttctggcagcgggcggggcacaagctttcggtcgaaacaataagaaacctcattttagccggagcttttgacggttttggggtaagccgggaaagtcttctttattgtttggaggtttataaactttttaaaccaatccccggtctttttgcggaaccaaacttttccctgaaaaaggaaaaagaggccggcgattatcttaaaaaagctcagaaagttatcggtgttaaattctggttggatttggaggcaaaagtagaaaaaacaggggagggattaatcatcaccggagaggtaacttttggtcgccgccgctatacgcgcaaaggagaaccgtttttaacccttactctggaaaaccggcaggaattttacgaagtgttagttccagcatccctgtacggcaaatcgttctggagtttaaccaaaaagtttgtccaaatttgggcgcaggaaaaagacgagcgcctttttgctcgaaaaattgtccctatcgcttaaaaagccggtacaaacggtttaattcataagaggtaatcccgcccataattaaaaggagtaagaggtaagaaatacctacgaacaatattcccaaaacaaggttaaaggggatggcgggattgaaaattttcgaaaagccataacccaggccaagggagccgagaaaagcaaaaaccacttttaaaagggtttggtcgtaagttaaagtgcgaagcttaagttttaaggcaaacaaacttaagatgaaaaggagaaaatggtaaagggcaaaagaaagacacgtgccggtaatccctatcttaggagttaaaagcagaaggcttaggattttaactccgcttgctcctaacaaaatgtaaaaaggggtttggggtttggacagaccctgaaagatgccggtaaccgtttggtaccagtacaaaaaaggcccgcttacagctaaaattaccagaagttcaccggcttcgggatatttaaagagtaaagccgtaaggggagcggcgtataacagcaaaatagccgtaacgggaaggccggctatgagggaaagcttaaaagcgtaaaaactccggcttcttattaaggaaaagttttcctgaccgaaagcctcagcaataccgggcactaaagtggtagaaagggtattggtaataactgccggcgttaaaagaagggtcatggccactcctgaaaataaaccgtaggtggcggtggcttcccgaaaggataagccggataagactaaagcctttgggattaaaagagcgtctaaagccgaaagaagggtggccatcacccgggtaagggtcacgggaattgccagggaaaagattttgcgaaggtaatttaggggaattttcggggaaaaccaggattttttatccaaaaatgctactcctaccagaaaaccaacggcttctccggcaaggactcccagggaaggaccgcgaagagcatcttttaaacttatgttaataaaggctgaggttaaacttagggagaccaaaattctaacgatttgttcgatattttgcgccagggccggaatattccagcgtaaaaggccgataaaatatcctcttaaagctgaggagacggcgattaccggaattgaaggtatcagccataaaaaagcgtaaaaactatattccgaaggaaatagaagatgccgaattaggggaagtaaggaaaaaaacagtcctaaaacggtaaggctaaacaacaaaaggaaaattatggagaagaaaagaaggtttttactgtgagtccggtttttaaaaccttcctgggcaatggtttgggagagggccaggggtataccaagggttgaaagtacgagcagaaaaacgaaaaccggataggccatattatagtagccgataccttcggcgccaaggagtcttacgattaagacctggtaaacaaaacctaaaatacgatttaaaaagcttacgaaactcattaaaagagttccgtacaaaagagacataccgttactcctttacccgatgaatttagccgttgttaaaaagtttatgctttagaaaattcccgtagaattaaaaaaatttcaaaaaaataaaaggaaaacccgaaattatgctgaaataatatattactaataaaaaatccttaggagggcttttaaatgaaaagctaccctacagagtttttaagaaacatcggtatctttgcccacagcggggcgggcaaaaccagtcttaccgaagctttactttacaatactggagtattgaaaagaatgggccgggtggaggacggaaatactgtttctgattaccaccccgaggaaattaaaaggaaggtgaccattcacgcttcccttgtgccctgcgagtggaacaaccataagttaaactttatcgatactccgggatatgcggattttatcggtgaggtaaaaagtgttttaaaagttgtagaaggggcaatatttgtggtttgcgcggcgtccggcgtggagattcagacggaagtggtctggaatcttgcagacaatgctggtttgccgcgttttgtgtttattaacaaaatagaacgggaaaatgccaattttgaaaaaacgttaaatcagatccgggagattctttcggctaaagtagtaccccttcatttaccgattggcgaaggggaaaactttaaaggatatattgatgttttaaaaaataaagcttacttctttgatggtaccaatttaacggaaggggctatccccgccgagtatgaagaacgagttttagaagcctggctgcaattaacggaagctgcggcggaaaatgatgatgagctattaatgatgtatttggatggagcggaactgacccctgagcaggttgcactggggctcaaaaaaggggtacgggccggcaaactttacccgctttttgtgggctctgccacaaaaaatatcggcattagagatttattggatgcttcctgtgaactgctgccgcctccccaaaaaaattatgatcacccggtggcttatgtgtttaaaaccttagctgacccgtatgtaggcaggattaactttgttaaagttttggggggttctttaaagccagaaactacactctataactttaaaaaagataaaccggaaaaaatcggccatatcctttttatgcgaggcaaagatcaagttcaaagccaggaggtaaatgccggagatatcgcttgcttaataaagctttccgaaaccggtaccggcgatgttttgagtttaaaagataaaccggtggaaattgaaccggtagattatcccactcctaacatgaccattgccattctccccaaaagtaaaaacgatgaagaccgcctttccactgctctccatcgcgccttagaggaagaccccacacttagccttgagaaaaacctggaaacccgccagaacctcctttccggcatgggggaactccatttggaaattgttctcgaagcaattaaacggaagtatggtgttgaagtggtaaccgaagaattacgggtgccttaccgggagactatccggaaaacggttcaggtggaaggtaaatataaaaagcaaaccggtggccggggtcagtacggccatgtgtggcttagattagaacccctgccggataaagagtttgagtttggtgaagagatttttggcggtgccgttcccaaacagtattttccggcggtagaaaaaggaattcgcgaagcgttaaatgaaggagtactggccggttataaagtaatgaatgtgcgggcggtactgtacgatggttcgtatcacccggtggactcttccgaactggcttttaagattgcggccagtcaggctttcaagaaaggggttaaggaagcaaatccggtacttttggaaccggtaatgcttgttgaagtgacggtgccggagcaatttatgggggatgtgatcagcgactttaacggtaaacgtggccatgttcttggcatggaaacccagggacgctgggccagggttaaagcttatgtaccgtatgccgagatgttaaaatataatattgacttaaaagcgatgacccaggccaggggcttctacaccatgactttcagccactaccaggaagtacctcccaaactacaggaagaaattataaagaaagcaaacttaaataagaaagaagaagaataaaccagtttagcaaatttttcttgacgatttttcctgattaatgatttaattttgtatggcaagattggtgtaaagtacaattaaataacattttccgaaaaaggcaaacccggcgaaagccggggacgcaaagctacaggggctaaagcaggttgtcctgctatgccagccagctgccgaaggtggaaattaaaaaaaaaaccctccgcccgaccttacggcaggagggttttagtattttccaaagttcaatgaggaaaagttcgaaatatcttttgaaagtaagaactatgttgtacaataaaaaaataatggcgatagaggtggaaatatgcgtcgcattcccgtggagtatcttattcccggtcttaaagttggttatccggtaatggacgggcaggggcggattttaattaatgccgggactattttaacttctgtcatgattaatcggctcaaaaaattgaaatatagctggctttacatttacgatggcaaggatgattttaccgaagccttcgtaatatcagaaatggttcgacgacgggcgttaaatgtggttaacaacctttatcaggatattttgcaggaaaggtattttgccattaaagtcgccaattaccgggagcaacttaaagaaatcgcagcggaaatgttagcggaacttttagataaaaagggttttcttttagacctttatgatatccggaatcttgacgattatacttactttcattcagtaaatgtagccttgctttctatggccactgctttaaaagccggctttaaacacgatgaaatcatcaatttagggataagcggtcttttacacgatatcggcaaaacccaagtaccatggaccatcttaaataaaccgggaaaattgtccccggaggaaatggagataattcgccttcatccggaaaaaggaggggaaattgtttcgcgctatcttaacttcggcagcagtgtggttcagggtgtaatccagcaccatgagcggctggatggcagcgggtatctccaggggttaagtggcgataaaattcataaatttgctaagataatcatggtggccgatgtttatgatgccatgacttccaaaagagtttaccgcgatcccatagaccccaaagaggtttacgaatttgttttagcccttggaggcggcgaatttgacctgaatacggttaaaagttttgcttcgtctattgccgtttatccggtgggggcaaaggttttattaaataatggctttgaaggcatagttaccggaaccccggttgggtttcctgatcgaccggtaattcgggtaattgccgataatgggcggccggtagaaccgtactatctttccctggcagaagaatataaattgatggttacgaaaattgttttgtatcccgaagttgctaacgaaagtattgtgcaaattttaacgcaaaggtgacaaaaactaacaaatattttaaaaaatctggtataattaggttaaaagacgcttaaaaaagatttaaggggcgagaaaagatggaaataatggtggtgttaggggtagttatagcttttacttcactggtaaccgggtttttaatggaaggcggtactatttctgccctggtagcaccttcggcggctttaataatttttggcggaacaatcggtgctagtatcattgctttttcgacggaagaggtactggcgattcccaagtattttaaaatcatgcttttccaaaagccgttaaacgaactggaagtggtaaagcaaatagtttcccttgcccaaaaagcccggcgggaagggttactggctctggaaaatgacctgcccaacatcaaggatgactttttacgccggggtttacagttaattgtcgatggtaccgacccggaacttttccgctcgattttggaaaatgaaatttatgccatagccgaaagacaccgggcaggagccgaattttttgaagcggccggtggttatgctccgacgatggggattatcggtacggttatgggactggttcacgttttagggcaactttctaccccggaaaagcttggcccggcaattgcgatggcttttaccgctaccctttacggggtgtcttcggctaacatattgtggctgcctttttcggcaaaactaaaaaatttaagcaaaaaagaactgttagtgcgggaaatgatgcttgaaggtttggtgtcattgcaggaaggacataacccgatgctgattgaagaaaaactccggtcattcttaaagcctaaactccgggagcaaagcttaagagaaggtaagggtgaattaaatgaagcggcgtcagcatgaggaaaaaaaaccaaaccacgaacgctggcttattacttatgcggatatgattactttattgatggttttttttatcgttatgtatgccctttccaatgttgatgccaataaatttcgggctttagccgaatctttaagtaaagctcttggcgggggaggaattgtgcttaccaatgccggaccggatgtggttaccgggagcaatgcaactgtacagggcaacctgggaaaagccagccaggagcaattaccggcggttgatgaaaaggatttgaaggaaacggctaatttagcgctaattaaggctaaagttgattcttacataaaagcgaaaggtttaaatgccagtgtgacggctaccttagaagaaaggggtgtggttatctcctttaaagatgccattttatttaaattgggttcggcggagcttacgcctcaggcaaaggctattgtgcggcaaattggtgaaattttgttgccacttccgaactatatccgcatcgaggggcacaccgacaacctaccgataaacaccagtcgatttccgtccaactgggaactttccacggcccgggcaacttcggttgtccatgaattaattgatgggcttcattttccgccctatcgtttatcggcagtaggatacggagaatatcgccctaaagttcccaatacttcagagcaaaaccggcagaagaaccgacgggtggatattgtcattttgaggagcaagtatgaaccggtagagccaaaaagcgggaaagtacccggacaaaattaaagggggagaattaatggggggatttaaactgcgtttgggtatcagggccaagctgtttatcctaacttttattctggcttcgatgatggtgattgggggaaccggtgcggtcttttctacgtacctggtaaaccggagccatgaaaagcaaaataaagaacttttaggggaactccagcggttgggggaattaaaaacgtccctttttcaatatttcaatactgctaacgattttttgctttttcccaactcccaaagattagtagaggtgcaaaaaacctatcaggaactaaagaatcttttaacaaatgccagaaaactggctcatagcagcgaagaaacgcaacaatatgatgaaattgcagctattttaaataaatcccaaaatttattagaaaaaaatgccactaatcccaatttcgaacaaacccagaacgccatgaatatgctccaaaccagtgcacggaatataatgcaccatttaaacaaacttgaagatactgctaaacaagaagataacaaagccagggaaaagcttttaaaaatctttaaaattgcagccggagccgtgggcggcagtaccgttttggcggcaattttagcaatgattatcggttacttcattaccaacccgattattgtagcgattcaaaaattacgagaaacggtgcataaggtggaagaaggctgtcttaattgcacggtggatatcaaacaggccgatgaattgggagaactggcaacggatttaaataatatggtggaaaagctaaacagcttgatttcgaccatatccacggaactcgaaaacttgtacgggatttccgatcaggtggcttcggtggcggagcaggtctccaggggagcaacggaacaagcggctcaggttcagggagcaactacggcagttgatgagatcgtgcagggaatccaggaagctgccaatcaagcggccaatgcggccagggtttcggaagaaaccatggcccaggcgcaaaccggtgccaaaaccgtagaccagttaagcgccagtatggaaaaaattaaccgggagatcaagcgtctgggaagcaatatctccaggattaccgagtttttggcggttattgaggatattgccgaacaaacaagccttttagcccttaatgcggcaattgaagcggctcgtgccggtgaacatggtcggggatttgcggtagtggcggaaaatgttagaaagcttgcggaacgttcggcaaaatccaccaaagaaatcgaacaactggtttttgaaattcaaaagagcagtcaggagacctttgcggctataaacgatggcaatgaaatggtgggcaaaaataaagatgctttcaaccagattttaaatgcggttaattcggtagtggcaatgattgaagaaattgcaaaacatggcaatgaagttgctgagcgcgctaatcgcaccatggaaatgattaactctatttctgcagttatccaggaaacggcggccaccaccgaagaattggcggcaacatctcacaccctggttgagacttccaataagattaagtcccaggtagcgtattttaataccaaataaaaagatgaggaggagttttgaagatggctgaaaatttaacgaataaaagtgaggcgcaaattgtcatttttaccttaaaccagcagcagtacggcgttgacattgctcaggtctacgaaatcattcgtatgaccgatatcaccaaaattcccaataccccttactttgtcgaaggagtaattaacctgaggggaaaaattatcccggttattgatttaaggaaacgcctggggatgccggaagcggaaagagataaagctacccggattattgtagtggatgttgatggaataacggtggggatgattgtggactcggtgatggaagtatttcgtttaaacgatgtggaaatcgaatcaaccccttccatgattaatgatatcgattcgtcttttattcaggggattgccattaaagacgagcggatgattatcttactggacttaaaccgggttttaaaaggtgaagaaaaagaagctttggcaaatatgtaaatttgaggtgagctaaggtgttttccgatgtggaaatggcggtttttttggatgaattggaagaaaaaattcaggtattaaccgataatttactcttactggaacagtcgggggaagatgatcccaaagttttacaggagattttccgggctgcccataccattaaaggttcctcggcggtaatgggttttaccaagatgtcttcccttacccatgaaattgaaaatatctttgataagatgcggaataacgaattaaagcccacttcttccctcataaacgttctttttgaggctttagatgccttaaaaattttgagggatgaaatcgtggccgaaaatgcggaaaattatgacaccaccgagattatagccaaacttaaagaagcggtggcgggtacgggagctaaatcttccgaaactcaagctcctaagggagagacggcagaattttccggggacgaaatagaaaaaattagggaatttgagttaaaagggtatcagctatctgaaatcaaggtttatcttgatcctgctgcggtaatgaaatcggttagggcatttatcgtattgcagcaattaaaggagcttgggactgtgatcaaaaccgttcctgccgaggaaattttagtaaaaacagaagatttcaacgattttattgtttatttggcaacaaatgaagacgaagaccggctgcaaaacatcttattaactatcccggaagtagaacgggtagaaattagcgcaaaacagttagaagataacatagaagcaagaaacgaggagcaaaaggtagaaaaaactgacgtacaagatatagtttcggaaaaaacagcaacggtggaaaagccggcggcagaggtaaaaactaaaacttccgctgtagctccagcggaggagaaaaaggtaacgcaaaccgttcgggtggatgttcaaaagctggacacattaatgaacctggtgggagaactggtcattgaccggactcgccttttaagtgtcattgataaactttatactctcagccgggaaaataatgaattagtagagaccttagcggaaatatcgtcccatgtcggacaaattactaccgatttgcaggatgtaattatgaaagcccgcatgctgcccattgctcaggtttttaaccgctttccacggatggtgcgggatttagcccagaagcttaataaagaagttgagtttattatagaaggtaaggaaacggagctggaccgaaacgtcatcgaagtaatcggggacccgttaattcatttaattagaaatgctttggaccatggaattgagcctcccgaagaacgggaaaagctgggaaaacccagagcaggacggctgcgtctggctgctgcttatttagaaaataatattgttattaccgttgaagatgacgggcgggggattgatcctgatgcggttcggaaaaaggcggtggaaaaaggcctgatatccgagcgggaagcggaaatgctttcggataaagaggccattaaactaatcttccgttcggggctttcgacagcccagaaggtcaatgatatttccggccggggcgttggtatggatatagtgaaatcccagatcgagcagataaacggtgaagtccaggtggaaagccaggtagggaaagggacaacgtttaccattcgcctgcccctgacattggcaattatccgggctcttttagtagagcatcaagggcaaatctatgcgtttcccttaaattttgtgcaggaaaccttaattgtcggtcaagaagagctccgcaaggtttcggattatgatgtgatgttattacggggcaaggtgctaccgctaatttccctgtccaagctctttaatctgcccgaagatcaggagcaaaaacaatggtattttgtggtaatcttaggtaccggcaatcaccggctgggcgtgattgtcgataaccttttgggtgaacaggaaattgtgattaaatccctgggtgaatacctcggtcaggtcaagggtctatcgggagctacaatccttggcgatggccggatcggtcttatcattgatgcccgcgggattttgcaggagaatgaaataggtgaattaaatgtcgcggtataaactttttattgtggatgattcggccttaatccgtctccggctgaagacaagtctggctttatggcccgaaatccagatagttggggaagcggaaaatggtcaggaagctttaaagaaaatcccattagttaagcccgatgtagttacgctggatttagaaatgccggtactggatggtcttagtaccttaaaagagttaaacaaagtttatccggtaccggtaatcatgctttcttctttaacaacccacggagctaaggcaactattgaggccctggaaaatggtgcggtagattttgtaccaaaagatggggattggaataaggttgtttctgagttaaaagaaaagataaaaatagctgtcttagctaaaaaacgtccgaaaccttttaccggagggacgcttaaccccaaaaatgttattctcggtaaaaacggccggcaattggtggtgataggtgcttctaccggtggaccgccggccttacgagaaatcattcccaaacttccgcaaacctttccggtgcccattgtaattatccagcatattacccgcgggtttagcaagccgctggcggaccagctggccagagtttcccggttaaaggtaaaggaagcggaaaaagacgagcagttgctcccgggaacggtctatgtggcccctgccggctatacttttaaaattgataaacaaggaggcagtttaacagctaaaataattgagccggtggaatacttgccggctcatttctacccctccgttgatgaggcgatgctttcggcagcagaagtgacgggcagcaaaaccataggagttttgctaactggcatgggaaaggatggggcgctcgggatgaaagctatcaaagaacggggagggtataccattgcccaggacgaagaaacttcggtagtttacggtatgcccaaagcggcaattgatatagggggagtttctcgggttttgcccctatcggcaattgctgaagaaattgcggccaatatctaaagaaattaaatttttttccgaagtattagatagcaccaaaatgatacgaggggatagtatgaggataaacggggtagattttaagaatgtagtggagctttacactaaagcggttccttcggcggcacggaacgagaaaagcaaaaccgatgaggttgttttaaccgaaagcgggcaggaaatccttaaactcaggaaaaaacttgcggaaattcccgaagtgcgggaggaactggtaagtaaaataaaaggaaggattttatccggggagtaccaaattgacttagaaaaattggctgccaagttaaaagaatggggcgaattttaaatggacgaagggattaaagagctttttaggaaagaagttcggcttttagccgaacttttagttatcattgaagaacagattcaaaacataatcgaccaaaagattgaagactttagcaggaacttacagaaaatggcgggaatagcggcggaagtggcggaagtagaaaaagaacgatatgcaacaacgtacggtcaggatttaagcaaagaagaggatgaaataatagccaaactaaaggaatatgtccgaaaagtacgggaaaaaaatgaaaccctgacgcttcttttacggcaggaacttgcattcaatcaatttttgcaaaaaaatttactgccggagggcaatacttcaatcctggaccggcaggtttaagggggatttaaatgtttaatataagtttggaaacggctttaagttcccttcgggcccagcagttagctttagatattacttcccacaacattgccaatgccaatacgccaggttatacccggcagcgggtaaattttgctcccaataccccctttccggtgccatccctttttgccccgatgcagccgggccaggtaggtaccggggtagtggtggcgtcaattgaacgggttcgggatacttttatggacattgagtaccgcaaggaattaatgaatttaggctactgggaaacccggtttgatgttttagataaaattcagctaatcatcaacgaaccttccgataccggtttaaatcagcttatggaccgcttctggaatgcctggcaggagctttctaaaaacccggaaaacctcgcaacccgggcggtggtgcagcaaacggccaaggctctggtcgaaacttttaaccacctgcggggacagttagacagcctgcaaaatgattttgattttgcggttcaggctaatgttgaagaaataaattccattgcccggcagattcgggatataaatgaccagatttttaaaacaaatatcgtcaaatttaacgccaacgacctcatggaccagcgggatgaacttttaaacaagctggccaagcttattgacttcacattaattgataatcaggatgggactatttccattgacatcggtgggaaaaaattagttgatggtttaacggtggattcgcttaaggtagagaaaaacgccagtggcttttttgaagttttttggagtgatgatacgccggtaaccatcacatcccaaaaaggggagttggctgccaaccttgcggcccgggatgtcgatgtccaggcgatgaaagattacctcgattccctggcccagacgttgattatagaaaccaataatcttcatacgcagggttatgtattgggttcacccatgaccaatccgggatacaacttttttgacggaaccgatgctaaaaccattgccctttctcctgaagtaagtgccaatttaaacaacattgctgcggccaaaactcccagtcccggtgatggcgaaattgctttagctatcgcccagttaaaggacaagcttacgatgacccttccgggttcgactaccccaacggcaacttttaatgatttttaccgcaccatcatttcccgcctgggggttgatgcccaggaagccgagcgcatgtaccagaacgaacagcttttaacgaaaaacttgaacaacaagcggatggagtcgggcggggtatctatagacgaagaaatggccaatatgattttgtaccaaaatgcttacagcgctgctgcccgcatcgtcaccgctatcgatgaaatgatggatattgtcataaaccgcatgggcatagtgggccggtaaaggagggtagttaaatgcgcgtaactccgggaatgctcaaagataacttcctttacaacttacaccgcaccctggccgatatggaaaaaagccagcagatgctgtctaacggtaaagcattaaccaaaccgtccgatgacccggtgaagctgctgcgggcgatgaaataccgcagtgatattactcagggagagcagtatcagagaaacatcgaagatgggttaaactggctaaatactactgatgccgctcttaatgaacttaccaatctcctgcagcgggttaaagagttaaccgtgtatggagccaatggtgctttacctcaggaatccttaaactccatagctgaagagattaaacaaattaaagagcaagtaggcgttattgccaacacccagtttgccggtaagtatatttttgggggcacggaagtagaaaaacaaccctgggatggcagtaattggcagggaaatagtagcggaatatactttgagataggaagtaatattaaagttcaggtaaatactgttggtttaccgcttttcaccaatgttatgcaaacattagaccaaattattaatcatttgactgctggtgatgtagctgctgtatcatcggacttaggttctctggataacaacttaaatactgttttggctgttcgtgccgatgtgggagcccggacaaaccggttggaattaatgcaaaaccgccttttagcccagttagaaacggaaaaagaacttttatccaaaactgaagatgcagacatagccgctacaattattgatttaaaaaatcaggagaacgtttatcggtcggcattagccgtgggggcaaggattttaccaccgacattagtagattttttacggtaaattagtgtgggttgagaaattatgaataatgtacgggtgttaattgatacgactcgttgttgggctgatattgggtatttaacgccggtagagttttcgcgagctcaagctaagaaagggatggatgcggcccttgagggaatcgccagaagggttgatgaggggaacttattagcagcatttgaaagaggaaatactattgaaaatatcgttgtaccgccattacaagaggtcgagcttactgtccgcatgcttcctacggtaaggcctgaaattaactttataaaaagcaactctgcttttcttgatatttatctttaaatattttaaggtggtgtttattttgcgtcttttttctccagcttttggggaaattgaagctgatgaatcgcaaatattttcttttcccgaaggacttcctgggttcagtcatctaaagaagtttttacttatacggcaccgggataatagtccttttttctttttaatagccatagacgaaccggaaatttactttatcttaattgagccgtcacggctacttgctgactatcatgttgagttgagttgcgaacaacaaggtcttttgcatttatctgaggagacaccagttttaagtttaaatatagttcgcataccgcctgaagctaaagaaatgattataaatttaaaagcgccggttgtctttaatttacaagaaaaaatagcccgccagattattcttgatgcggattaccccgttcgctacccaattcctttaagcaaggtaaaggagaaagccgatgctggtactaaatagaaaggtgaaccaaaaaattattattaacggtgaaatagaaattaccgtgctggcggttgacagcggacggggacaggtcaagcttgggatatccgctccgcagcattattccatttaccgggaagaaatctggcgggagattgagaaggagaataaagaagcggtgggggaaagtattgaaaaaattaattttgacatgtagaggggaatttttatgaaagccctaattctctccggtggtcaaggcacgcgccttcgcccgttaacctacagtatagcaaagcaattagtacctgtggccaataaacccatattacattttgtaattgaagacataattaatgccggtataactgatattggagtaattattgctcccgaaacgggagaagagatcaagaaaagcattaccaatgctggttttcctgcaaaatttacttttattcttcaggaaaaacctttaggtcttgcccatgcggtaaaagtagccaaagactatcttgaagatgatgattttatcatgtacttaggagacaacttaataaactccggaattaaggaatttgtggaagaatacaaagaaaaccgctatgatgcgacgatcttgttaaaagaagttcaggatccaacccgctttggggtggcagtggttgatgaaaattttaaagttcaaagactaattgaaaagcccaaagagccaccatcaaatttagctttggttggtatttatattttttcaccaaaaatcttttctgcgattgacagaattaagccttcttggcgtggagagttggaaataactgatgctattcaggaattaataaaccagggaggcatggttaaagcgcataagattaccggctggtggcttgataccgggaaaaaagacgatttattggaagcaaaccgggtagtattagatgacttaatacaaagggatataagaggaaaaattgatgagcaaacaaaaataaacggaagagtagtaattgaaggaggagcagaaatagaaaactccattatccgcggcccagcagtaattgggaaaaacaccaaagttaaaaactcctttatcggttcctataccagtataggtaacaactgtttagttgaaaattcagccatagaattttcggtaatccttgaccactcggaaatcattggtgtagaaagacttgatgaaagcttaatcggaagaaaaacaagggtaataaaagacggttcagtaaacaaagccgtaaagctaatgattggtgacgatgcggaggtacggttatagtggaattccaaaaaggagaaattgaaggggtaataataagacctttaaaaaaacacatagacgaacgcggttggctctgtgaactctttcggcaggatgaaatagaagaaacaataatgccggttatgagctatatttcacagacattaccgggcatagttcgaggtccccacgaacacaaagaacaaaccgactactttgcttttataggccccggcaactttaaaatctatctttgggacaaccgaagagacagttcaacatatggcaaccggcagataatttatgctggcgaagataacccggcagtaatcatcgtaccgccgggagtagttcatgcgtataaaaacgtaagtaccaaacccggcttagtttttaattctcccaataagctttatgccggctggggaagaaaagagcaagtcgatgaggtgcgctgggaaaataaagagaactctccattcataattgattaaaaataaacagaataaatcaaattaaaggaaagaagagcatgaaaaaaatagtgatagccggagccggaggacaattaggaaaagcctttaccaagaagctacaatccttaggtatagaatgcttaccccttacccggaaagaattagatatcactgatttacacctgctaaaagagctctttttaaactttcgtcctcagtacttaataaactgtgccgcctataacgaagtagataaagccgaagaagaaaaagaaaaagcacttttggtaaatggaatagcattaagatacatagggaatttagctgcccaataccaaaccaccgtgatccattacagcaccgattatgtttttaatggcgaaaaagaagagccataccttatatccgatcagccaaagccaattaaccactacgggcgaaccaaacttttgggagaaaaagaaatcctgactcataatcctaaaacgtatgtaattcgggttagctgggtctttggcgatggcgaacaaaactttatttataagcttctaaactgggccagcaaaaatgaaaaattaaaaatagtagcagaccaggttagtagtcccacctatactgaagaaatcgtaaaaataaccttagacctaattaaaaccgaacagtatggtttatatcaactgtcaggggaaggccaagcatcaaggtacgactgggcaaaattcattttagattacctaaactggcagggagaactaataccggcagcaagtcatgattttcctaccaaagccaagagacctagatattcaaaactaagtaaccttcccttaaaaaacctgttaggttatcttcccgaaacctggcaggaatctacggaaaaatatctaaaagaactaaaaaagatataaaaaaaataaaaaactaaataaacttgaaaggagtcaaaaatgaagatcctagtaaccggaggagcaggctttattggcagtgcctttgtaagaaagtatgcttatgaccacgagttaataatagtggacaagcttacctatgccggagatttgagaaggatagaagaagtaagagaccggataaagttctataaggcagatgtagcagataaaactgccatagaagaaatctttgacaaagagaaaccagaagcggtagtccactttgcagctgaatcccatgtagaccgcagcatccaggacccaacaccttttatagaaaccaacgttaaaggcacccaggtaatgcttgatgccagtagaaaatacggcattgaaaaatttgtccatatctctaccgatgaagtatacggggaattaggaaaagaaggacaatttaccgaagaatcacccttacgacctaattctccttactccgtatcgaaggcagcagccgacatgttagctcgggcctatcaccggacttatggacttccggtaatcgtagcaagaccgtgcaacaattatgggccatggcagtatccagaaaagctaatccctgtagtaatcaaaaaagccttaaacaatgaaccaattcccgtatacgggcaaggattaaacgtccgagaatggctttatgtagatgactgtatagaagcggtttatctcttacttcagaaaggcaaacctggagaagcctacaacatcggaagtggagaagaaaaaggaaatattgaggtggtaaaagaaatactgagaattcttggaaaacccgagtccttaattacttttgttgaagataggccaggacatgattttaggtattctctaaattcaaaaaagataaaaatgaattatgcttggaaacataaagttaattttaatgagggaataagatttgtaatagactggtataagaagcatttttagctgtaaattatgaatatagagctatagtttcatgtaatagaggctttgttaaataaggagtgtagttaagttgaataaaaaaatatgttttataacatgtgtaaataataataaactatatgaagagtgtttaaaatatataaataatttaagggttcccgagggatatgaaatcgaaataaaaataataaaaaatgcgaaaagtctaacatcaggttataatgaagggatgctaagtagtgatgcaaaatataaagtatatttgcaccaagatacatttatcataaataaaaactttataaatgatatattaaaaatatttgataaagataaaacaataggtatgattggggtagttggagcgaaaactttaccgataaatgctgtatggtggcattcaaataaaaaatatggaaaagtttatgaaaatcgaactggtgagattgaattattggcatttaatgaggttgaaggagattttgaagaagtaaaggtaattgatggactgattatgataacgcaatatgatattccctggagagaagatatatttactggctggcacttttatgacttgtcgcaatgtatggaatttatgaaaagaggattcaaaatagttattccaaaacaaaatgagccgtggtgtattcataattgtggttttatagagataaaagatgattatgaaaaatatagaaaaatatttttaaatgaataccccttgaataaatattcatctgtttatgattacttttacaatgaacgacaagaaattatttctcttattgagtctaaagccagtagagttttagatgtaggttgtgctgctggtttattagggaagaagctaaaaactgagaggcctggaactattgtctatggtgtagaaattaatcgagatattgcccaagaagcagagcagtaccttgataaggtattagtgggagacatttatgaaaagataaatgagctacctgaccgttttttcgatacaattattcttgctgatgttatcgaacatttaaatgtgccagaagttattattaagaaattaaaaagtaaattggctcacaatggggaatttattattagtgttccaaattttcgtcattggtctgtaattatgaaaattttatttggcgatttatcatatgaggaagctggaataatggataaaactcacttacgtatttttacgaaatatattattcataatatgatgaaaaatcttaatttagaagttattaaaattagtaaaaatgttgtgccacttgaagcaaatcagaaagaaattttaataaaattactaggagcgtttgcattagatgtaagaagctttgctgctgatattgatacttatcagtatatatataaggtaaaaccaagagaatatttacggttctcaaaattaacttcaataattatcttaacacttaataactatgaaatatcgaaacaatgcattgaatcggtattgaaatttacgaatttgccttttgaattaattattgtggataatggttcaacggaaactcagttacttgaatatttaaaaaatttacaggaaaggcgagatgatgttaaagtttattttcttcccgaaaatgtgggttatgggcttggtaataattttggtttattacattctgtgggtaaatatgtggtttttttgaacaatgatacaattgttacacctgattggctagaaaagttaattatagatttgaatatggatgaaaaaaccggattaattgggccgcgaacaaactatgtttcgggagaacaaattgttaataaagtaaattacaaaaatatgaatgaattattggaatttgccaacaaatgggaagcggttaattaccgtgaagttacagagacaaaaaaacttgtaggtttttgccttcttgctaaaagagaagtgattgagaaaattggtggttttgatcctttatttgaaatcggaaactttgaggatgatgatttatgtagaagagcctatctagccggttttaaacttaaaattgctgatgatgtgtttattcatcattatgggagtaaaacatttatttcggaaaaaattaattatgatgaaattatgaaaaaaaatagagaaaaatatttaaagaaatgggaagtgtttaatgaaatagttaaaaccaattatttaagtataattgaaaactttttatttataaagttagtgaaggatagggaggattttggaataccagaaaatagagaggttttattcttggcattaggaaaaaatgacaataatttagatgaaacattaatatctaaattaattaaaaaaataaatgaaaatgaaattttagtgattttagtagatgacaatcaaaatcatgaagaagtggaggaaaaattaataaaagctattacaatggctgggtttactcctgaagattgtccagacgtattactgcattatagtaaaagttatttttatgatctaataagtttaattaaactggcgaaggcgtgtattgttatcgatgaaagaactaaaaaatgggcagaagtttttgacaaagataaggttgatatagattaaaatttataaaacgctaaaaaatttgcttttgcttccgaaataaaaaatagaaagggtaggtggccacctgacttaaaataactggcagggatgccaaagaaaaaatcaaggaggaggaaaaaatatgagtcttagaatcaacaacaatattgaagcattaaatgcgtggagagcgcttaatagcacttcaaatgctttacaaaaatcgatggaaaagctttcatccggtttacggattaaccgtgctggagatgatgctgctggattggctatttcggaaaagttaagagcgcagattcgtggcttaaaccaagcgattagaaatgctcaagacggtatttctttaattcaaactgctgaaggtggcttgagcgaaattcaaaatatcttgcaacggatgcgagagctgggagttcaagcggcaaacggtactttaaacaatcaagacatttcagcgattacgactgagcttaatcaattatttaacgaaattgatagaattgctggggccacagaatttaacaccaagaatttgttggctgtatctactggtttagtagtaactttacaagttggagcaaatgcaggtcaagttattgcgtttaccattgataatgccggtacagcttctttaggcttgagttcagctgacttagctattaatgataatgcatctgcaagtgcgtttattagtaaagtagattctgcattacaaaaggtatctacctatagagctaacctcggttcaatacaaaaccgcttagaacataccattgctaacttaggtatagcatctgaaaaccttagtgcttctgagtcccggattagagacgttgatatggctgcagaaatgatgaactttactaagaaccaaatcttacaacaagctggtgttgctatcttagctcaagctaaccaggcgccgcaagcggttttacagcttctccgataaacaaatacattttatcttttgggccagccattttaagggctggcctctttaaaatttgcttaaagtggtgaaaaaatgggagaaaaaaaactatcggtttgcatgattgtaaaagacgaggaaagatatattagaaattgccttgagagtgtgcaagatattgctgatgaaattgttgttgtcgatacgggatctacagataatactaaagctatagctaatgattttggggcgaaaatttttgattttccgtgggttgatgatttcagtgcagcaaggaacttttcgttggaaaaagcaacaggtgattgggttttacttttagatgctgatgaagaattagatgttagtagcaaggataaagtgttggagctagttaataaaaatgaaaatgttgcttatttagtcaatgtaattaatttcctggattttacaaaacaaagaacagttacagccaaaagaatgcttttatttcctatgcgagctgaaccatactttattaatcctattcacgagcaactacgtttcaaaaaaaatgttgaaattagagatagtaccattattataaaacactacggttatattccagaaactgtttctactaaaaagaaaagtgagcggaatatatcaattcttaaaaaaatagccaataactctgttgaaaatattaatgttgaaattaaagcattcaattattacaatcttggtgtagagtattatagaaaacaagaatacgaaaaagctttacaaaatttccaaaagtcttttttattgatacgtaaaaaagaaccaggctttaagtatgctttaatttggcatattgttaattcattaataaatttaaaaaaatttcaagaggctttaaaggttattgaagatgccgaacagttatatccttggtatgttgatttagtgtattttaaaggagttgtttattatagtcaaagaagctataagaaagctattgaaacttttatgaaatgtctcgaaattggtgaaagcttagaaacttcaatatttcattatgatggtactggttcttatttagcaagttatggaattggtagttgcgaagaagctttaggcaattataataaagctttagttttttatgaaatgtctttggcacaaaattatattttagctgtaatccctattttgaagttgtaatatgaacgggggagttaccgtgaattggaagaaaaggaagataaattacttcgaaaatataaggactattcttttataatcgaaaaatacgttgattttctgtttttaaaaggcgattatgaaagagctttaaaggtagtaaatagttatttgtcagaccaaacgaacaaattaataaaagaagctgaattgtatcttcatctgaaaaaatatgaagaagccaaagaagtcatagaaaaacttgagggtcaaaatttaaatgaaaaccatttaatgattaaaacttttctacaaatattattaaatttaagtcttaaatctaaaactgaagaaatagtttggaatatgaaaaaacttactcgagcagaggaaataaagtggcaaataataggtaagttgttgcttgcggcatttaacagtgaggtaataaaaattttgaaaaacgactatgaaaagtatgaagagcaacttacttttttaatggcaaagtttttagatttagagttatttgaagcatttgaaaaaatttataatttatttcaaaaaatcgaatggattgaagggaaaaatttaaaacttggcaagctgtactttgctacaaggtattatgacagtgctgtggaagaattgttggcttcggttgaaaaaggtgttgcagatgcggaagctttttatctcttagggaaaatagcccatatgcgtggtttaatcgaggaagctgaaacatttatcaaagaagcaataagtagggaaaagcagttaagttattatttatatctaattggtttattacaagaaaaaaacgatttaaaatctacaaaagaagttttgcaagaagcttcgacgtactatcccgatgttgagattttaaaatctgcgttgcaagtttatagttcattataattaaaaggggaatggagtatggctggcttagttcctccggtaaatttaggagtgaataatggggttaattttcaatcgataggaattatagtaagtgcggataaaaaacaggaattagtaggtaagaatggattacaaagtcgggatgatgtaggtttatcagagagcagtgatgtaaaatttttagaaaaagaattacaaagattgacaaaaattgtaaactcctttactcctacggaattaaaatttgaaatccatcaggcctcacaggagctgatggtaaaggtaattaatgccgagaccaaagaagtaatcagggaaattccgccccatcaggttttagaaatagtggcggagatcaagaaacttttgggaatactggtcgatactaaaatttaagaggtgagggcaatgcccattcaaattggtggtttggcttccgggcttgatactaataaaattgtagagcaattaatgcagattgaaagaaaacctctggaaagattagagcagcgaaaagcgaatttagaagcagtacgaaaagcctggagtgaaataaaaacaaagctaagcacgttatactcaactctgcagtcgctgcagtcagcgtctctctacacttcccttaccgctacttcttcagatacaactatccttacagcatctgctcaatcaactgctgttaaaggaagctataccatagaagtgcaaagtgtagctaccagctacgttattggctcaaaccaacaaacttctattacagcaaccttaaacttgaatccaacttcctttaaaatagcaattggcggggtagtgcaaaaagacagccagggtaatgatattgttatctctattgattctaccgatagcttggtaagtattcgagataaaataaataatgccaaggccggcgttactgcttcaattgttgataatagacttttattaacagccaatgttaccgggtcagctaactcgatatcttttacggcagtaagcggtgatgccttacaagcattgggaattgctgatgccaatggtaatgcggttaatgttgttcagtcaggtgtcgatgctaaattgattattaacggcttaacggtgattcgcagttcgaatacaattagtgacgccatatacggcgtaacccttaatgtaaaaaaaatcgggactgttagtgttactgttgataacgatactgcttccatcattgagaaaataaaaacttttgtaaaccagtataatgatttaatgaacgatttagcaacaaaaactgcttatgaccccaataccaaaacaaaaggagttttgcagggagatgctacggcccagcaaattatgtttcaattaagacaaattgtgggaagtgccgtttccggtcttaccgatacggcaacttacaatggcaagacggttactttaaatagtttaatggctataggcatatctacttccggaaaggaagctaccttatctctggatgaaaataagcttacggagcttatcaagcaaaatgcccaagcggtaggaaaaattttcacaaatactgccaataatggaataatcgataatttaaaaccatacgttgaaagcctggcggtttatgctactgcaaatggagttcatactgatgccattttggtaactaaagataagtcacttgctgaccaattgaaatatcttcaagagcaaattgatcgctttaacgattatttaacgcgcaaagaagaagaactgtggaataaatttacgcagcttgaaaaagtgatgtccggtttgcaggcccagagcaattggttggcggcccaggtaagtagcttaacaggagctaacaagaaatagctgaggtgaaagagccatgaataatccctatgctcaataccaaacgcaaaatatcgctaccgctccaccagaaaaattgttaatcatgctttatgacggtgcgattaaatttttaaaacaagggcttaaagccttggatgagaaaaaatacgatgactttagctattatataagccgcacgcaggacataatttccgaattaatggttactttggatatggattacgaaatatccaaaaacctttaccagctttatgattactttatgtaccggctaattcatggaaatgtcaagaaagaccgccaaagtatcgaagaagtgcaaaaacatttggaagaactgagagaaacctgggttcaagcagctgctgctaaagagaaagctacaatttaaaggatgataatggtgaaaacttctaaggaaattcttaatgagcttaaaaggcttcaggaaaaaattgcgtcttcaaaagatgaattggtaataactgatgaattccagaaaataagtgaaaaatttaaaaaatattattcgggagaagaagagattacaattgaggaaattcaggagttattacctgagtacgaaaaaacgataaagcttttagaagaagaaaagaaaaaaattttaacagaaattgaaaaagtgaaaagagaaaaaaagatgattaattcctatttagcaaatggctttcaagtggaaggtattttcttagataaaaaacgttaatttccccacaaaggggggataaaagggtgatcatacccaatatagacccattgcttttacaaaaataccgggagcaggtaaagccgaaagtaccggagataaaaaagactgccgatgaagtgcggtatgagccggagtatgacggggaaaaggagtttatcccgaagctggcggcggatgtgtttcaccgggtgattaactttttaaacccggcactggaatttgtttatgatgagcaggaagaaatggggtatgtcattgataaggtgaaaaaccgggtattaaaacgagttagcttagagcatttaaaaacggcgtttaccgaccttaccaaaaccataggacttttgctggacgagagggtgtaggccctcttttttttgttttcgttttatattgacaattttcgttattttttataagttaatttttgtgaaagatttcctcgaaaagtttggcaaaaccggcgaaagccggcgacgcaaagctaaaggggctaaggcgggtaaccgctatgccagccagctgccgggggtaggaattaaagcctccttgggcaggaggtttttattttttctgaaagcaaagatatcttgctgaatttttttttggaaaaagttaaaataaaatcgagaaggtaaaggaatttagctaattttgtcaaatatattatagaaagttatgaaaaaaggggagaagcgcatggacctttttggaggggttacctacaaccttttgaaactggggattgatgctgcaacaatccgccagcaggcgattgcccataacattgccaacgtcaatactccaggataccggaaggaagtagtggtgtttgaggaaaaggttcaggaatttttaaaccaaaaaaaaggtaatttttctttaaaaactacccatcctcgccatctaacggccaaagggttcagtttaccttttgcagaaattaagcgagaaaattctactgccatgagaattgacaagaataacgtggacatcgaaacggaaatggtagatttggcatataaccagctttattatgaaacggctgtggagcggttaaaaggcacccttgcttctttagaaatggtgattaccggtggaaggaggtaagtgtagatggcattttttagttctttccaaataaccgcttcggcccttaccgcccaccgtttatggctggatacgatagttgataacattgccaatgccaatactacccggacgcctgcaggtggtacctacaatcgaaaagacgtgatttttgaggaaatcctggaggcaaaggccgggtttaaaggcggcggggtcagggtcagtcagattgtagaagataccaaaactccctaccgctatgtctttaatcctaaccatcccgatgcggatcccaataccggtttagtaaaatatcccaacgttaatatcaacgatgagatagtaaatttactggccgctcagagggcgtacgaagccaatgttacggtattcaatacggctaaagccatgtatgcgaaggctctcgagctcagccgttaggaggggttaatgtggagattaccggcatttcttttcccaatattatcctacttaataactcggcacaatcaacaaaaactttagattttgaaaagaaacttgctgaggctttagataaagttaacgaaaaacagctgaaagccgagcaagcgacccaggattttttagccgggaaagtggatgatattcaccaggttttaattttagcccaggaagctaaattgagtttggaattagcggtggaggttcgcaacaaaatagttgaggcctatcaggaaattagccggatgcagatttaatcatggacgggaatagggggaaataaatggattttcagagcctcctggcaagtataaaggaacgtttccaaaatttaagcagctttcaaaagcgggcttacgggattttaatacttacggcggtactgtcgttgttgctcgggtatatttttttgggacgtcccagttatactcctttggctaccggtttagatgccaaagaagcgggagccattgcggaaaagttgaaggaatggaaaataaattacaagcttggcgatgaggggacaacgattttggttcccaaaagtcaagtgtatgaggcccggattaaactggccagtgccggggtgttagaaaccaacagcggtattggttttgaattatttgaccagaccaagttgggtgccagtgattttgaaaaccaggttaactaccagcgagcgctgcaggaggagctacggcggacaattgtgcagttggatgcggtggaggatgcccgtgttcatttagtccttcccgaaaaaagcgtttttatctccgaggaaaaaccggcaaccgccagcattttgctgaaattaaagcccctaaaaaaattaacgccgcaagagataaaagggataatttacctggtagcgaacagtgtagaaggtttaaagccggaaaatgttcaggtagtggatacatacggaaatgtgctctctgaccaggtggatttaagctcaagtttatcagcgcaatccggacgtcagcaagaaatgaaaaagcagtttgaaacggagttaacaaatcgaattaataacctgctcaccactattttaggtcctggaaaggcagtagttagtatcaatgctgatctggattttaaccaggaagaaactacctcccagatcgctctccctgggccgctggtcagcgaacaggggagcaaagaagtggtttacggaagccctggtgcttccggaacggttgggacgggaccaaacaccaatcaaaattatccctacatcaatggcagtacgaacggcgaagttcaggttaaagaagactttacccgcaattatcaggttggacaaaccgtctataaattggtcaaggcaccggggacggtgaagcggttatccgccgctattgctatcgattcgggggtgccggcggcggacgtaaataaaatccgggacatcgtagcggcggccatgggctatgaccaaaaccgcggcgaccagataattatcaacaccattacctttgataaaacattggcaaaacaaatggaagaacagcaggcgcaagctcagaaggaacagcaggcaagacaagcattgtataaatggcttgccataggggccggggccctggtttttcttagcattatagtattttttgggatacgccgttttcggaaaaaacctgcggcagttgcggacatttcccccagagctccggttggagtcagtgagctggaagctgcggctgcggccgaaagaggtcctgggattattgtaagagaaatgactgctgaaccgatagtaatccagaaagttcaatcggatatcgaaaaaataaaatcgctggtggacaaaaatccggatgaagttgcgatggtactgcgagcctggctgacggacgagtaagacagacaaggaggaggccagatggccagggaagaaacacgcaagaaaaatatcaataaaatagccaagcttctaattgccctggggccggaacattcggccaaaattttagccaaacattttaccgaagaagaaattgaaaaaatttccatggcggtagctactatcggccagattacaccggaagaaaggcaaaaggtggcagaagaatttttggaactttaccaggcccaggaatatatttccaccggcggtgtgagttatgccaaggaaatgctggaaaaagctttgggaccgcaaaaagcaaacgaaatcattaaaaaattaataagtttaaccaccaaaatgccttttcagatgttgcgcaaagccgatgcccggcagcttattaactttattcaaaatgagcatccgcaaaccatcgctttaattttatcttatcttttaccggagcaggcggcgatgattctgtcatcaatgccggcggaaatgcagagcgatattatcaaaagaattgccactatggagagaacgtcaccggaagttatccgggaaattgaggaagtattggaaaaaaaggtatcatcggtttttgaacaaaactatacaaaagccggtggtatagaaacggttgtggaaattttaaaccgggttgaccgttcgaccgaaaaaaatatcctcgaagatttagaacaggaaaaccaggagttagccgaagaaattagaaagcgaatgtttgttttcgaggatattgttaccttggacgatatggcgatccagcgggtgctgcgggaagtggaaagccgggatttggcttttgctttaaaaggttctaccgaagaagtcaagcagcgaattatgaagaacctctccaagcgggcggcggaaatgttaaacgacgaattggcttacatgggaccggtgcggcttaaagatgtggagcaggcgcagcagaaaattgtggctattattcgccgtttagaagaagctggagaaattataatatcccggggtggtgaagatgccctggtcttctaaaagtaagcttttagaaggggttgcggtaaggcccgacggggaagcgctgaaaattcccattaaaaaaattgtcattttaccagaagaagtggaaaaaaacaatgaagaatcttcggctttattaaacgaagcaaaaattaaagcgcaggaaataattaacgctgcccggcgagaggccgagataatcagagaagaggccaaagcaaaaggttaccaacagggttataccgaaggtcaggctaaagcccggcaagaatttgaaaaacttcaagagactttaaaagaggagtacgaaaagaaaattgccgaaaaagttttggaaataaacagggaacgggaaaaaatcatcaaaggggtagaacaggagattatagcttttatcgagacttcccttgaaaagcttttaggggagctaccggaggctgtaacgcttttttaccggaaatggcttgtagacgctcttgccaagttttcgcaaaggatggtgccggtaattcaggtaagtcctgctgaccgggagaaaattgaagaaattttacagcaacagggtttggaagaaaaaatacccgtaatcaccgataccgatttaccggccggaacggttgttgttaagggtgaggaaaattacgtcatttctttaaaaatctttgctgatgaaattttagaaaagcttaaagctggagcttacggcgatgagtagggtaaaccttgggtatctcaccgaacagataaaggaacatgagtttttaaaaccctggggtgtggtccgtcaggtcataggtcttaccgttgaagcgcacggcttaaaggtttcggtaggtgagacggtagagattttggctggaaatgctcgggttttggccgaagtggtcggttttaaagaggaaaatgccattttaatgcctttgggggagattaacgggataagcttgggaagcctggtacgcccgcttcggcgtcagttgcaaattaccgtgggtaaaagcttacttgggaaagtgcttgatggcttgggaaggcctttaaatgccgataaaatttacggccggcacttttccctggaccgtaaacctcccaagccgctgcatcgccggcggataaaaaagccgtttgccaccggtatcaaagcaatcgatggcccattaacctgcggcgaaggacagagacttgggatttttgccggaagcggggtgggtaaaagtactcttcttggaatgattgcccgttatgccgaagcggatgttaacgtgatagctctaatcggggaaaggggcagggaggttttagactttatcgaaaatgatttgggcgaagggattaaaaaatcggttttggtggtggcgacttcggagcaaccagcattgtttcgggtcaaaggtgcctttgtggccacggctattgctgagtattttcgcgagcaggggaaaaaagtgctcttaatgatggattccctgacgcggtttgccatggcgcagcgggagattggccttgctgccggtgagcccccatcttcccgggggtatactccctcggtatttgctttattacccaaattggtggaaagagccggcaacgatgataaaggttcgattaccgctttttatacggttttggtggaaggggacgactttaacgagccaattgccgatgcggtcagaggacttttagatgggcatattgtgttaagccggcaattagccggaaaggggcactacccggccattgaccttttggccagcaacagccgtttaatgccggagcttgttgatgagcagcatttagcgttaacactgaaaatgcgggaaatacttgatatttaccggcaaaatgaggatttaattttaattggtgcctataagccgggaaccaatcccctccttgaccgggcaatccagcttgtaccaaaaattaaccagtttttacagcaaaagcaaaatgaaaaagtagattttactactactaaggaaatgttgaaaaccctatttgtggaggaataatcgatgaaaaaattttcttttcgcctggccaatgtggaaaagattcgcacccaggaagtagaacagcaaaaacgtgtagtgcaggaaaaaattcaagcggtccggcgccaggaagaaaagatcaaccggattggggaatccattgctgccgagctgaaaattgattcccttttatttcgcgaacatcaattggagaggatagagtacctggctacagaaaagtggcgtttggaaaaagagttggaaaggcttataaacgagcgggaaagggctaaggaagaatatcttgccaaaaaaattgagcagaaaaagatggaagtattgaaagaaaaagcaaaagcgagttaccgtgaggagcttgaaagggaaaatcaatcttttttagatgaaatttccctttttggctatatccgtaggaattgaaaggaggtgaaaaggggttgaaggtagaacagagctggcaggggctcaaaattgctccggaaggacaactgcaaactgtaggaagaccttggttagccgacagctttgagcttcttttagcaggtgttcttggcagcgaaaagtacgaaacggaacagaagaacgaggatgatactgccggggtagcaaccatagtgcctgtacttaccggtccttggaatttacctttaccgcaggaaatcttgcctaaggaagaaaccgtaataagcaatggtgacggttttttcgaaagattgcacctcccaaacgaagtagcgggaaatgctgaagatgcggaaaaggtaaaggttttccaggggaaaagtcaggtaaaggatgaggcaattaatctggtagggttagaaaaagacttaagtcgggagttaggggcaaaaggttttacggtaacggaagagggtatagcggtaccgggtaaaggagtagcagtagctttagcgggtgcaggggaaggaagctttcttcaggacgtggatggggtaaactttatagaaaaggaattgccgtcggagctaaaagtggtaccggatagcaaagggatgcggcaggagataagcccggaagggataaggaacgggagcagggtttttgaaaaagcggagcttctggtaaacaaggtagcgggaaatgctgaagatgcaggaaaggtaagggttttccgggggaaaagtcaggcaaaggatgaggcaattaatctggtagggttagaagaaggcttaagtcgggagttaggggcaaaaggttttacggtaacggaagagggtatagcggtaccgggtaaaggagtagccgtagctctggcggatgcaggggaaggaagttttcttcaagacgtggatggggtaacctttatagaaaaggaattgccggcggagttaaaagtggtaccgggtagcaaagggaagcagcaggagataagcacggaagggataaggaacgggagcagggtttttgaaaaagcggagcttctggtaaacgaagtagcgggaaatgctggagatgccggaaaggtaaaggttttccgggggaaaagtcaggcaaaggatggggcaattaatgtggtagagttagaaaaagacttaagtcgggagttaggggcaaaaggttttacggtaacggaagagggtatagcggtaccgggtaaaggagtagcagtagctttagcggatgcaggggaaggaagcgttcttcaagacgtggatgggacaatctttatagaaaaggaattaccggcggagttaaaagtggtgccgggtagcaaagggaagcagcaggagataagcccggaagggataaggaacgggagcaggggttttgaaaaagcggagcttctggtaaacgaagtatcagtaattgctgaaaacggtggaaagaaaaacattccacaagcggaacaaggtgaagtaaaagctgaactaaagcttagctcaaaagagcagctaactgagccaagccaggcgataaaggaaaaagaagcagcaaaaactcttcccaaagcagctaaagatagctttcttcgcgaagtaaatccggcaagccatgaaaagacaaagccagcggttgaaataccaacttttgacttatttccaaaggtagcaaagaatgctctcgataatttgcttcctgcggaaaatttaaagtttaactttccctcttttttggccaaagtagaaaatttggtgcaaaaagcgcaaaaggcgggtaccagtttaactgcgtcgttcaaactttatcctgaagaactgggggaagtaaaggtcacagtaaaattaacaggaaaaaatgtagaaatttcgctaaaagttttttcaaacgaagctgcctggtatttacagaatgccggcagggagttagccgtaactttacaaaagcatcacctggagttaagtagctttaatgtggggctggaacagagtagcaattttttcaatcagaataccttttctttcacaaaaaacaatgctaggctttcaaaggttagaaattatcaaaatggtccggtagctgagccggtattggaaaaaaatccgttagctgaaaaagttaccgggttgaactgtttggtataaggaggtgaaagggtgataaatgatgttaccgcggtaagctcccagatgtcaacttccgcaaatgctgcctcgcaaacaaaattgaacttggataaagatgcttttttgaaaattttcttagcgcaactgcaatatcaggatccccttaacccggcggatggtaccgaatttattgccgaactagcccagtttgggatgctggagcagcttacgaacttaaccgatgctttaacaaagcttttacaattcgagcaaaaggcccaggcagcagctttaatcggcaaaacggtgaaaatagcaaccgccgctgagacgctggtggagggggttgtgagtgccgtacggtggtccggggaccagattagtttggtggtgaacggccaggagtatagcccggacaaagttattgaggtgaggtaaggtgagtgatattggcaagatccaggggttaataacggttaacgaaaaacctgcggcccaaactctgaccaaagctgcaccgggcctaagttttgaacagctgttgcaggaaacggaggccaaactcaaagtgtcccaccatgcggaaaaacgtctgcaggaacgggggattgagctttcggagcaggagtggttgaaaatttcccgggcgttagaaaatgccagggctaaaggagccataaacagtttggtggtatacggagatttggcgataattgcttcggtagtaaataaaacggtgattaccgtttccaaaaccgaacagttggcggaacaaataattaccaatattgacagtgccattttacttaagtaaaagggctggaccgcaagggggccctcacccgctgaacgacggaggcgggtaaaaaataaaaatttaaagggggagttaaaatgattcggtcactttattcgggtatttcgggcttaaaaagccatcagtataaaatggatgttgttgccaataacatttctaacgttaatactattggttacaaatccagccgggtaaattttgaagatttaatttaccagaaaacaaaccagtcgggagtttatccttcttatgttggccttggggtcaacgtgtccggagtagacactatttttacccagggcggacttaaatctacaggtcgtcctttagatgtggcgattcagggcaatggtttctttgtgctaaaagatccggtaactaccaggacctattattcccgggaaggagtcttttaccttgacaaagacggttatttaataaacggccatggttaccgggtgcaggacgtaaacggtgctgatatacaaataaacaatccggaagctgtagtaactttaacaattcaaaacgatggacaaattaagctggttcgttccgatggcaccacagaatttgcgggtcccataggcttaatgagctttaaaaacccggaaaccttagaacggatagggcaaaacgtttattcggctactattgatacccaaacttctttttcctcgccggtaactcccggacagcaaggtcagggaatcctggtttcgggctacctggaaatgtccaatgtggatttagccagtgaatttaccgagatgattgttacccagaggggctatcaggctaatgcccgggtgattaccacatccgaccaaatgctggaggagctcttgaatattaagagataagatttgaggtgaagttaaaagtgaccaaaggaaaaacaatattgctaattgtcattgtagcgatagtagcggtactggcaggtttagggggggcttatttcttatttgggaaaaattccggggcggctcctaaagagccgccccctcctccaactgttatagccaagttaggggatatagtggtaaatttggctgataaagatacttccaggtatctgcgggttgggattaatgtggaaatcgaaggagaaggggaaggggcaacaaaagtatttgaagaaaaaagcgtcatttttaaggataaggttattgcctttcttagaagcaaggaatcaacggagcttgttggtgataattccagcgagaagttaaaaaaagagctcttgaaaattttgcaggacacagcggcggaacttaacaaaaaggtcgagaaaaagtccgaaaaaattgtcatcgtaaacgtgtatttcagcgattttattatccagtaataagggaggttgttccttgggtattcgcgatgtggatgaatttttaaaaaaaatggttgacgatgttcctacataccggaaaccggaattttcaccattagagccggtaccgaccgggcaaaggaagttaccgatgtcccttttaaataacattaaaatggagatcgtggcccggatgggtaccaccgagctgaccgtgcgccagcttttagctttaaaagaaggagatgtcctggagctggataaaagtattggcgatttaatcgacctttttattgacggtcggcggtttgctgttggagaagtggtggtgattaatgaaatgtacggagtgaggatcaccggctattctgatgaagataccgggaaagaggcgaaaaaaattgggtagttattttgtgcaaattttttggtcgttttttgtacttgttttgcttctggccggtttgttcctccttgcccggtacctgaaaaacttccgcatcggtttcaaaagccggtatatcgagattatcgaccgtttacccctttcccccaaagcgggcttagtgcttttaaaagtcaatgataaatattattttgcggggtacggtgaagataacgtttcgttactggataccttcgagaatccaccggcggaaataccgggatacggtaatgtctttgagagcaggctaaatcaaaaaatttctgaagttgtggggcagattaaaagtggcggcaaaaaataaaaagcttttaataacgggaattttattgatattaactctgggggtaagttcattagcgcttgcggaaccgcttaccatacccaatatccagcttaatattaacgggcagggttcgccccaggaagtggttaactccgtcaagcttttggtgctgttaaccgttttagctttggtacctgcctttttacttttgatgacttcctttacccgcattgtggtggttttatcgctgttaaggaatgccatgggtacccagcaagcgccacccaatcaggttttaattggccttgctttgtttttaaccatttttatcatgtcgccggtaattaataaaattaaccaggatgccatccaaccctacttaaataatcaaattacccaggagcaggctatccgggcggctgaagcgccgctgaaggatttcatgctgaaacaaacccgggaaaaagacctggccctttttattgaattggccaaattgccgcggccgcaaaccaaagacgacgtaccttttaccgtagtggttccggcttttatcatcagcgaactaaaaacggcatttcagatgggatttatgttgtttctaccgtttttgattattgacatggttgttgccagtattttaatgtccatgggcatgttcatgattccgccgatgctcgtagctttaccctttaaacttttactttttgttcttgccgatggttggtacctggtggtcaagagtttggtaagcagtttttcttaaagcgggagagaagggaaaaaatggcttcgctctatttcatccatttggcccaaaaaagctttaccgttttgagcttgctggtaggaccaccgcttattgtttcgctggtggttggcttaatagtgggaatcttgcaggcggcaacccagattcaagagcaaacgctaacctttgttccaaaattaattgccgtgtttttaacccttttactcttaagcggctggatgctaaatattatggtagactttaccggacaaatctttcaggaaatggctaaagttcgcttttaggagttcaagatacgatgacccagtggcttatttttcttataattgcggcaaggctggccggcttttttggcatctcgcctttaatcattccggtacggggtgtaccgccggcggtcaaagggttttttaccctgattgtagcctatttgttactgccgacggtggcaggaagctttacggcaacggacgttcagcggaatttttttctcctcttaatcggtgaaagtttaattggtcttttgttggggttcgtaactttaatctttgccaatttatatctcgttgccggacagtatatggacctgacttcgggactcagcgccgctaccctatttgatcccctgacccagaccaatgccggattaatggccaattttatttatctctacggcatcttaaactactttttggccaacggacaccaccgcctcttaacttttttgacggtgagttttgagctaattccacccggcaaaggtttactgcacccggggttaagcgaattactaataaagattttcgcgttggttatgttagtagcgattgaaattgccataccgtttctcatggtgatgcttatcagcgatttagctcttggcattttagcgcgaactgccccgcaaatgaatgtgtttctgctgagttttggtttaaagattttactggccatcttcactttatggcttttacttcccgggattgcgtattttaccggaatttacctggaattaatggaaaaaaatcttttagccatcataaggggaataggctatggcagatgagcagagagaccagcgtaccgaggcccccactccccgaaggttagctgaagcccggcgtcgcgggcaggtttttaagagtcaggaattaaactttgcggtaatgttcttaatattctttttgcttttgctggtactgggaggctacttttatcagcaattttatcttttaagtcgaaatgtttttcgaaatatgtttattgaacttaccccttctgctgtccggggactgttactttattattttggctggagttttaaaattgttttgccgtttttgctcctgggtatgcttgccggaatagcattaaatttagtgcaggtaggatttatctttacaacggagccgttaaagccaagctgggaaagaataaatcccctctcaggctttagcagaatttttagccggagaaactgggtggagcttcttaagaactttttgaaatttggctttttagcgttggtaatttatcttcggattaaaagtaatttaccgcttatttttcagaaaatcggtcaggcaccagctgaatactttaacggttattttagcttaattaaaaaaattgcgctggatacgcttctggtgctctttctctttggagctgttgattactggtatcagcggcgggaatattatcaatccctgaaaatgaccaaacaggagttgaaagaagaataccgccaaacggagggagatcccttaattaaagcccggttgcgggaacggcagcggcagattgctttaaaccaaattgcccgggaggtgccgcaggctaccgttgtggttactaacccggtgcacattgctgtggcgttaaaatacgaacggggcaaaatggcggctccgaaggtggtggcgaaaggagccggatttttagcagaaaagattaaggaaatagcccgggcccataacgtggagattgttgaaaatgttgaggttgcccggtttttatataaaaattgtgaagtgggcgaagaaattcccgaagagctttacaatgctgtggcggagattatcgcctgggtttaccgcaaaaaaagaaaaagataagttggtgagactgtggctaccgtttctaaaggtaacgccttcttaaaaaataattacgatttaatcgtagcggggtttgtaattttaactttggttttaatcattattccgttgcccccctttatgctggatattttactggtatttagcataaccttttccttggttattttactcattaccttgtttaccaccgaaccgctgcaattttcgatatttcccactcttctgctggtaatgactttatatcgtttggccttaaacatttcgtccaccaggcttattttaagtcaggcttcggccggacaggtaattcaggccttcggtagctttgtggtgggtggcagttatgtagtgggatttgtggtgtttttaatcatcacggtaattcagtttgtcgttattaccaacggggctggccgggtggcggaggtggcagcccggtttaccctggatgcgatgcccggaaaacaaatggccattgatgccgaatttaatgccggtctaattaccgaacaggaggcccgacaaaaacgccgcaaactgcagcgggaagcggacttttttggagcgatggacggtgccagcaagtttgtgcgcggggatgccattgccgggattgttatccttctgataaacatcctgggcggtttgatcattggggttatccagatgaaaatgcctgtattgcaggcgttgcaaacttataccgtgctgaccatcggtgatggactggttagccagataccggcacttttaatttcaaccgctaccggaattctggtaaccagggcgtcagccgatgaaaattttggccgggagtttaccaaacaggtgggtgcttttccaaaggttttaattatggcggcgatcatcatctttctgctgggattgattccggccatgcccaacctgttgtttatttccctggcgggtctattaggatacggcgggtatttggcggttcgctacaccggtcaggtaaaagataaagcccagccggtaatagaagtacccaaaaagcgggagccggaaaatgtgttaaactattttaatattgatcccctggaaattgaaattggttacaatttaataaccctgaccgatgaaacccagggaggagatttattaggaaggctggccgcggtaaggcgtcagttggctttagaacttggcctgtacgttcggcccatacgcatccgggataatctgcagttgccgcccaatcagtacgtctttaaactgcgcggggcggaagcggaaaagggtgaattgctgccgggatacgtcctggttttggacccgaccggggaaaaaactccggaacagggcattcccaccaaagagccggcctttggtttggaggcctggtgggtacgggaaagccaaaaagcaaatttggagatggaaggatttaccgtaatcgaaccatcggcggttttggttacccatcttacagagtttattaaaaagaatgctgcggaaattttgggacgccaggaagtaaaagaacttttagaaaccctcaagcaaaaccagccggcggtggttgaggaggtatatccggaacttttaaccctcggagaaattcaaaaggtgctgcaaagccttttaaaagaaaatgtttccattcgggatttaaccagcattttagaagctttggccgatgccgtacgccagaaccgggatcccgactttttaatcgaacaggtgcggcaaaaaattcgccggcaaatcgtacgccagtatttgcacgaaggtaagctttatgccgttactttgaccccgcagtgggaacagcaaattgccgaaagtttgcaaccaacaagcctgggaatttatcctttgctggatactgcaagaaccgagcagtttatagaaaaggtaaagcaaactctgacggaagttacccggaggggactgtacccgataatcattacttccagccgggtgcgcttacccctgcgacggctacttgaccgtttttatccgcaggcgattttgctgggcattaatgaaattccaccggatgttgaggtagaaattttagggacggtgaattagcggtgaagatcaaaaagtatacggccagagatatggcggaagccctccagatgatcaaatttgatttaggaccggaagcaatgattttggagagccgaaaagttcgacagcccggtattctcgggttttttaaaccgcccgttttggaggtgttggcagcggttgatgaagcggcaaaacccagaaaagacgtggctaaagaaacttttgaagttaaaaaggatttggccgaattaaaattaatggttaaggatttagcgcgggtaaccgggaccgaaacgggtaattttgcccgctggcaggaacgccttttaaaacttgaactggcaccggatattgtggagcagattttgctggaactgcaggattttttggaagaagtggcgccggaggaaacttccggagtggagcgggtaaaagagtatttaataaatttaattaaaccctattatgaaaacatccaggactttcccttaaaagcattaattggtccgaccggtgtgggaaaaacaacaaccctggccaagattgccggacgtttggcaattcatgaagaaaaaccaatacggttcattaccctggatacctttcgcgtgggggcagtcgagcagctcaagatttacggcaagtacctcggtacaacggttaaagttgccggctcaccgatggagctttggcgggcggtgcaaaagcaaaatgagggagaaactatttttattgacaccgctggccggccatccaaaaagcaaaaccaaattcaggaactggccggttttttggaagcggttaaaaaggaaaaagacatttatctggtgataagcgctaccgtcaaacccgaagatgcggaaaaaatcgctaaagacttttccccttgcggttttaataaatttatcgtaaccaaaatagatgaaaccgataaatttggagtattgattaatttaatcgttaaatttaaaaagccaatcgtttacttgggcgttgggcaaaatgttcccgatgacttaatatctgctaccccggagcttatcgtcgagcaggtgtggaaggggtggtaggagatgtaccggcaggcggtgggattaattaaaggtaataaaggtaataaaggggaagcaaaagaaaatgctactctgcagcggataattgcggtaaccagcggtaaaggcggagtgggcaaatcgaatttcacggccaatttagcactcgcgctggccgatttacagaaaaaaattttaattttggatgcggatttaggcctggccaatgtggagctcctttttggtgttattccccgctgtacgcttttggattatttaaacagcgaaaaaaatattgaggatttaatcacgccattacaaaataatgtcgatttaatttccggcggtgccggacttttagaactggcttcgttaaatgtaaaacaaaggaaaaaaattatccagttaattgaaaatcttccccaaaattatgatataatcttaattgataccggtgccgggatccataaggaagtaatgagctttgttgcggcagcccgggaagtagtgttaattattactcccgaacctacatcaataaccgatgcttatacgatgctgaaaatgttagctcggtaccagcttaagcaaaaaatctacctggtggtgaaccgcgttcgggatgaaaaagagggcgaaaaaattgccgaacgcattacacttgccgccaataaatttctaaacctcaatattgaaaaattggggtacctattggaagaccgctccctttccgaagcggtaaggcagatgaaaccgttttatttgcaatttcccaatagtttggtcaccagaaacttgaaaaaaattgccctaaagcttacttcagataaattaatcgaacaaaaaaccgacggttttgccggatttttcaccaagcttttaagaatttttggataggtgatttatgttgcaggagtttttaaaacttgagctttatcccaacccggcggtaaaaaaaagctttccggcgcaggttcaggaggttaaagaaaaaacctttctaattcttggaccttttgaccggggtactttgcttttcctgtatcctgcccaggaagttttaattgaatacgttgccgaagagtgccgttatcaattttctacccgggtagtacgccggttgcaaaagccttttttcggttacgagttactgcttccggctcccgatgagatacaaaggattcagttacgccgttatgttcgggtgaaaaaggttttggatgttttttatgctctggttaagaaggatgaggaattaaactggaaaaaggggaaatcggtagacataagtattggcggaattaagctggcaactaacgagcctttgtccgtggatgcctgtgtaaagcttcgattttacatagaattgaaaggtaatgttgtggaatttgtactggatggtttggtcaaacgggaagaaaaaaaagaaaaccatgtgtatcattacggaattgaatttgtaaacatcagccgacaggagcaggatacactttttgcgtatttgttccaggaaatgcagaagtcgcgaaggatgttggccgatgggaagtgagagcttggatgtggccggtttgtggagggaatatcggcgaaataaatcattgcaactgagaaatgagttgctggaatattacctgcctttggtccgcaaggtttccgcggccatgagtttaaaacttcccacccacctttcccgggaggatatcgagggctacggcattatcgggttgattgaagcggtggaaacgtatgatcagaaccgcggggtgaagtttgaatcgtacgcctctcttaagattcgggcggcaatcattgacgagctgcggaagcaaaacttcctaccccgttcggtgtgggataagataaaaaaagtaaccaccagcgaagaaatgctgttaaacgccctgggggaagaggtgccggtagagaaggtagcggagcagctgggagtaagcgtcagcgatgttttaaagataaaaaccttaattgctttaaaaaatcacctttccttagatgagattatcgaccccgaaggttcggttgaccgttttgcagggctggcggatgatgaaaagtattcgccggaaaacaaatttttaaaaagggttgagatagaagaattgcgagaagcgctaaagaggcttagtgaccgggagcggttaattttacagttattttatgtagaagagctatcgcttaaggaaattgccgcagtgctggacatctccacatcccgggtttcccagatagcttcaaaggctttagggaaattacggaaattgttaaatgaaggggttggagtttaatgctaaggggcatttatatttctgctactggcctgaaagcaggacttaaacagttagataccgttgccaacaacatagccaacatcaataccgttgggtaccgggccgatataacggtcaattccggttttgaggaaaagatacttaattatgcgggtaaagaggtggggaagttagagtacggggttaatcccgatataaattatttggacctgtcttccgggaagtatgtccctaccgggcggaatttagattttgccctggtgggaaacggtttttttgtggttgaaacacctgcaggcttgagatatacccgggccggcgattttcaggtaaatagggacggttatctgtgcttgcccaacggcagcagagttttgggcgaaaagggaccgattaaaatcgataatgaagaactttacgtggaaaaagacgggcggatttacaataaagaacgctcgcggtatattgaccggttgcgggttgttgagccggtggatcctgtggctttggaaaaagtcggagggaatttttttgtaactgcggccaacaacgtgcgtccgggtaatgctttggttttgcagggctatttagagcaaagcaatgttgaccccaatcgcgaatatccagcgttgttagaaagtttaaggtatcttcaaagcaatgcccgggggctcaaagtacaggatgagctgctaagcaaggcggtaaatgatttaggaaaagtacggtaggttaagagaaaaaaatggaacttcaggtgggaattgccgattacaagcttggcagcagtcctgtcaaaattgttacttacggtttggggtcctgtgttggggtaagtttttacgaaccgcggttaaagttgggtgccctgttacatatcatgcttcccgatagtacccagtttagcgggaaacttaaaccggaaaaatttgccgataccggcatccctctggtggtcagggagttagaaaagcagggggcgagaaaaagttcactggaggttaaaatggtgggcggagcccagatgttttcgggtcccggggctcagacggtcatgaatattggcgagagaaacattgaaatgtgccggaaggtaatagcacggatgggtctaaagttagttgcggaggatgttggtgggaataagggtaggacgatgatcttagataccgctaccggcaacgttacggtaaaaataattggcaacatagtaaaggtgatatgatgaactttgccgaatttaaagcagaagtttataaaagatacggaattgacttaaaccagtacaaggaaaatcaggtacaaaggcggctcaatctctttttggaaaaatcgggattgaaggatttcggtaaccttcttttagcaatggataaagattccaaaatgtttgaaaaatttatcgatacgctgaccattaacgttaccgaattttttcgcgatcccaagattttcttcaagctgtacgaaaaatacctgcccgaattcaaaggaaaagggaacttaaagatttggagcgccggttgctcgacgggagctgaaccgtactcggtggccattttcctggaagaactgggatttaaaaattatcgcttggatgcatcggatttagacgaaaatattttaaaagctgcccgggagggcaaatttgggccggaggcactgaaaaatgttccccgggaatggataaccaaatattttgaccgagaaggggaggtttaccaggtaaaagcggctttgaggcaaaaagttaactttaaaagacaaaatcttttaaaagatagttttgataaaggctaccatttaattttgtgccgcaatgtcattatttattttaccaaagaagcccaggatggcctgtaccgcaagttttccgaaagccttgcacctcagggcattttatttattggagggagcgaagtaatcttcaatcccgaaaaatatcgattaatccgtttggagccctgtttctaccggcgcctggggtgagaaaaaaggggggtaggaagtggccgaggtgaacgattccttaaaaatggacgctttaaaagaaataggaaatatcggtatagctaacgccgctactgctttggcccaatttctggcgcgaagaatcgatatggatgtgcccgaggcagtggtgataggttttgatgaaatcctacagcgcatcgggagccccgaagaactggtggcctgcgtttttttggggataaagggggatgcccctggtactattctttttatttttaatcaggaaagtaccaataagttgttgaagctggtaatcggtaccgagaccaccggttacgaaatggatgaattttccgcatcggctttaaaagaaatctgcaacatcctggccggctcttttgcccaggctattagcagtttaacggggttaaccctgctgtcggaagtgccgctttttagctatgacatgttagcggctaccctttcgaccgggcttattgcttcgggggcttttgacgatcaggttctggtaattgataccaatttgatcgaacagggagagaagattaaaggacactttttctttgttcctaagcccggttcgcttcaaaagatttttgcggccttaggccttagctaaatattctaaattcatacaggagggaaatgaatgtcagcacgtgtattaattgtggatgatgcagcttttatgcggatgatgattaaaaatattttagtaaaaaacggttatgaagttgtgggcgaagcggaaaacggtgcccaggcggtggaaatgtataaagagctcaaaccggatgtcgtaacgatggatattaccatgccggagatggatggtattcaagcggtgcgcgaaattaaaaaaattgaccccaatgctaaaattataatgtgcagtgccatggggcagcaagcgctggtaatggaagcgattcaagcgggggctatcgactttattgtaaagcctttccagcaggacaggattttacaagcctttgagaaaactttgaagaggtaatggtgaaaggcgggatataattgccggagcttggtgatagcaaagaaatattatctcaagaagaaatagacaggttattagcagctcttgcttcgggaaatattgatgaagttaccgagaagaaaaaagaagaaatccgctaccgcaaatatgattttcgtcgtcccaacaaattttccaaggaaaacctgcgcacgcttcatttaattcacgataattatgcccggttaatttctaactttctgaccggctatttgcggactaatatttctgtgaaagtagcttcggtagaccaggcaacctatgaagattttttggtttcggttcctacccctaccctgataacaacctttaagcttcatcccctgaaaggcagcatggtgatggagaccaatttgcaatttattttcccgataataagccttttatttggtgggagcggtgatatgccgccggaagttcgggaacttaccgatatcgagctggcggtgattaaaaagctcaactaccggcttttggaaaacctggcccaggcctgggcggaaattatcaaggtcgagccggagatcgaggctttagaaaacaacccaagattacatcaggtactttcccccaatgaaattgtcgcgataattacgtttactactgaaattttaggaaacaatggtttaattaatctttgccttccttttgaagttttggatccgttactggcaaagctatcggccagctactggttttcccatgccactgctgccgaccgggaagcttttgcccggcacatggaaggttttttagcggaaagtgagctggaagtatctgctattttaggggggaccgaactgcgggtgcgggaatttttgaaaattgaggttggggatatagtggttttgaatcggaaggttgatgaggaattggaactttttgtcgaagaccaaaaactgtttaaggtgcaacccggtcgtgtaggggagaaactttgttgccagataactgggatgatagagagggatgaagccgatggataaccagtttttaagccaagaagagattgatgctcttttaagaagcgagccagttccttccgaatcggaaggaagcggcaccggaattatcctaaccgatgcggaaaaagatgccctgggggaagcgggcaatatttccatgggttcggcggctacttccctgtcccagctggtgggcaggaaggttatcattaccagcccccgggtggaagtgcaaaaggaaaaggaattttttgccagcttccgcgaaccgtatatggttattgaagtggaatttaccgaggggttgtcggggaaaaatgtcctgattataaaagaaaacgaagtgggtgtaattgccagcttaatgatgggtggggacggcacccattcgggggagataacggagttagaacaaagtgccgcccaagaggcaatgaaccagatgattgccagcagtgccactgctttatcggaaatctttaaaagaaagattaacatttcaccgcccaggtccaaaatgatcaattcccgggaaaacgatacctacgaaccttttggcggccacgaagtagtggtaatttattttaatatgcaaattgaagatttggtcgataccgatatcatgcaggtgatggagccggctacggccaaagaagtggcccagatgcttttggccaaagtctacgggagcccggagacagaaccggccgtgatggctcatgaaatgcttgaaggagcaaaagctacgaatattgagaaaaaagttgaaaaagcggaagaacaatttgttttgccgacagatgaaaagttagagttaattttagatattcctctcaaagttgaggtagtgttaggacgaacccggcgtcccatcaaggaaattttaagctttgggccgggagcaataattgacctggaccaattggtggacgaagatgtagaagttttggtgaatggtacccttgtggctaaaggcgaaattgtggtagtcggggagaattttggcatcaaaataaatcaaattctctctcccaaggaacggttaagcaaaatttaaggcgagaaaacgttaagggcaaacccggcgaaagccggcgacgcaaagctacaggggctaaagccgtaaggctatgccagccagctgccaaaggataaaaaacctcctctggcaggaggtttttaattttaaaaaaggtggggggcacggtggtaaactgggaattaaagttaaccaacaataatctggaggcttatgtcaaatattctttgctggaaggggagaaagggggggaagttccggtaacggaacaggatttaaaagagtttttaagccagaaaggcattgtgtacgggataattgaagaaaacatacctgaagttttggctaatcccgaccagtttatgctaattgcccggggtaaggaaccactaccgccggtgcccgatgaaataattacttattttacagcggaagaagaaaaatattccgttgataagcttggccaccggatttattattttaaatcgctcccgcaggtgaacgaaggtcagcttttagccgaagtaaaaaggggaaaacccggggaagatgggattgatgttttcgggaaaccggtaaaggccaaaggttatatcccggtgaaactaaaagcccagaagggggctgaaattaaggacgataaagtttatgccaccgtgaaagggttaccggtacgaatcggtcataccggattcggggtacaaaatttgttaactttagaccgggacctcacctacaagactggaaattaccagtttgttggtagcataaaagttaacggtaatgtcctggaaaacgttttactaaaagccgaaggttcggtggaagtttttgggaatgtggattcggccaaaatttatgccggggaatcgtttattgggagaaaaaatgtgattaactccgaaattaccgtagggttaaaaccgatgttagcggcaaagatcgtccggattttaaacgagtttcgagaaagctttcatcctttgctgattttaattcaagagttgttgccaaatttaaatgaaaaaccggtgacattatttcgggtcttacagcagctttataaaaagccggaggaacttaataaacttttggagaaaattaaaaagacttttcaaggaatttccgaaaataaaccggaactggaggctttttggcgagctggattggaccggctcatagaagtggaaagggtttttgccgcttttttaagaagtttttctgaaacttttcctgccagtgttttaaatcaaaaaataaatctgtggtggcatttaattgaaatgggtgtaaaatattttcaggaggagcagcaaaatgctcacgctaacccctttcaactaacagtttattccggtcaaaacagcaagtttaatgtttttggggattttattttaaacggtaaatctctctaccactgtactgtgacggctaccgggtcgatcttcgcggaagggggaacggtagtagtagggggaaaattacaggcggggaagatggttgacctggacgaagtgggaaccccgatgggcacgacaatggaaattgttgtggggaaggaaagtaccgtaaaaattaaaaaagtaaacccaggggtgctactaaaaatcggtcgttttcagaaaaccttcagggaaacggaatacggggtgctttttgccggtgaaaaagatttataagggaatggagtgattattttgaaccaagacctttacgcaaaaaccataaagtgtcctctttgtggtaatgaatataaaactcttaaagtaaagacttctgccttacgtcctgctggaatggacggtgatttatgtatgcgctattccgggttaaatcccctttattataaagtaaatgtttgcccccagtgtttttatgcttttaccgatgagtttacaaatataaaaaaaacggaactggagcttttgaaaaacgaactggccaaaaaccccctgccttttaatttctgcggggagcgggactttactttggcggtaaaatcttacggacaggctttgaagtgtgctttacttaaaaaagaaaaagatagtattattggccgactgtgtcataatcttgcctgtttatatcgaacccagggagaacttgaaaatgaagaaaaatatttgcactatgccctgaattattacgaaaaagcttttaccaccgaagcgaatgccaaagatacttatacattggcttacttaattggggagcttagccgccgcttgaaagattacgaaaaggcggctaagtggtttggttatttattacaaaataaaaatatgttgccccaaaagctggtgaatctggtacaggagcagtggcaggtcttgcgggaagaaaaaagatggtatagttccaaattagtttaatacagaggtgatggtatgaaattaaattccttacgggtcaagattttagccattcttcttttgatggtaactattcctttattggttaataccgcttttaattattatgaagcccaaaaggtgttgtataacaaattacaaaatacagccagggatgcagctaagctcggtgatgtagccattgaccattttcttgggggaatccagcagactatcgatactttagctcaagaagataacgccattaacttctacgatatacctggctgcgcccagtggtttggtaagactttggataatactcgcaaaaataatccggcgataatgtcgatttacataggtaccgtccgcggggaaatttatctctatcccaaacaaccattacctgcagggtatgaccccagaaaacgtccatggtatcagaaagctttggcttcacccggaaaagccgtttggaccgagccgtatcaggatgcgtttaccggtaagaccgtagttaccgtagcccgcctggtagagaaaaatggtaagccggtgggggttgtagcggcagatattcttttagaccattttaatgataaaattaaagagataaaggttggtaaaaccggctatctttttgctatcgaccaaaagggcacggttttagcccacaaagatcccaaactcttaggcaaatcgtttgctaactatgattttgcccaaaaaatgctctcccgggattctgggttttttaaatatcattacaacggggtggataaatatcttgcttttattacctcgccccgtactggctggaaaatggcagcgaactttgaggcggcagaaattggtgccgatactaaaacaatactcacggcaagcattattattttcctaattaccgtaatcttattaaccattctggcccttttcgtggcgcgttatatcagtaaccccattcagcatgtggtggagaaacttaaccttatccgcagcggggacctgacggttgcaattgaaggaaccgaaagaaatgatgaactgggggttttggcaaaaagtttacaggataccgtagcgggagtggcagctctggtgcaaaaaatccgggaagttgcttcttcagtggcggcggcggcccaggaaatatctgccagtacccagcaaattgctaccggcagccaaaatcaaaccagtgaaatcaatgccatagccatggaaatggatgcctttgccgaaaaagctgccaaagctgcggcgtatgtttcggaaatgcttaaacttgccgaggaaaccgttttttcggcaacccagggggaaaaagctttaaatgaaaacttcggcgggcttgaagaaataaaagccaaggtttcggatttagagaaaagtgcccaggcgattagcgggatgcttgagataattaacgaaatagccgagcaaaccaatcttttagccttaaatgctgctattgaagccgccagggccggcgaacacggccggggttttgcggtggtcgccgaagaagtccgtaaacttgccgagcgctctgcccgggctaccgaggaaatctcggctgtggttaaagaaatctcggctggcatgcaggtggcgttaaaagctgttaacgaaggtgaacgtttaggaagggttgcttcggaaagctttaaggaaattttcggaaagattgaagcgttagatgaacggattcgcgagatcagcaccattgcccagcagcagtccgaaggcagcgaaaaggttgctcgatccctgcaaaacatttcggccattaccgaagaaatttccgccacgattgaggaaaacagtgcggctaccgaagagctggctgcctcggctcaggaactggtggccaatgtggagaaatttaaagtttaagaagaaaacccgcctttgggcgggttttatatttttcttttgcttttcttttatagcttcagagggtaacagataaattttgaatgaccaaggtaactgccgtaaacaggttaaacaacccttttcaatttaaactttttttttactttcatttacgttttatcaaatatcttatgttttagcagtatatgggaataatgtatatattttttaaataagtaaaaaaaaaaaaaaaaaaatattgacaagaatcggacaaaacatacaataaactaatgaaagtactgcaaagtattggcgaaaaatgtcagggcaataagtgactcatgaagttaggggcatattcttttagtgttgctttagatccccaacttaaaaaatctcggttgcgtatagcctttatcagtttagaattgggaagctgatatcttttgaaaaggttaactttgattagttaatgttaaaattaagtttacatccagcattgtaaagcctttttggcaaagagtatttttggtttagtttgcagggagattttttagagagaggtattttgcctttaagtcaagaacatgcaaaatttgaattagagcaggttcatgctctaattgttagggtgatttcagtaaaagactggtatacaagcgaacattctatcatcccaagaattaaagcttgaaagttgcgttatccaagtagctgatgttcttgccgccttcctgaaagatcgaccttatcgacgagcccttgtacctttggaaatataccaaatccttaaaggtggattaaaaaaaggtaaacttgattcgtaagtggttgaagctgctcttaaaattttcttgtaactggcttaccaggtaagatggaggtgatttaattagacaaaagcatgattccattttttgccaagaaaagggaaaatgaagaagtggtgaggagagagttgaccttggaattacaggattcattatcaattttagaaaagcaaattgaaaaggtgattcaattaagtgaagccgcagttttagaaatgggacaagctgcggaaaatagtatgaatatgttaaaaaatagtaaagatttaattaccagttctcttcaggaagttttagagctaaatcgggctaatgttgctgcaatttctaatgtggtggaggaaaatgcccgagtgctgcaggaggtgaaagcttacctccatcaattaattataaaaattgatggggtttttcgtttatgggggaaagaagaacaggaacagctggttgagctattggaaaatgttacaaggaaaacccgggtggtagcattaaatgcttccattgaagcagctcgtttgggagcggcaggacgaagctttgccgtcgtagcccaggagatccaaaacctggttggtacgacttctgaggctattgaaaatttggctgaacataaccgggcgtttgaacaaaaagtcgaagaattatctaagaatttagatgagcttgaaagttattttataaatcagcttagttcggcaaatgaaaaaattatccatagcggaaagataagccaggagtggggacagaaaaccaaggaaatttttcaaaaagctgacaaagcgctggaaaacttggaagaggtaattactcgaggagcggctaattttcagtttcaagacattattgcccaaaggctaaataacgttataaaaggtttaaagctgattaaggaatatttaaaaaataagggacagggagagttattaagaaaaattgaaacgctttatacctcggaagatgaaaaaattattcatcgtactgctttaaataattctcaagagagagatgcggagctgctaaataacgttgagttttttaaccagtgaggaggtatagcagatgaaaaaaatattggcattggatgattcggctacgatgctgcaaagtataaaaatatcgttgctaaggaaaggtcaccaggttgcaacatttactaaaggaagcgaagctttagatatgcttgggaaagaaaaatttgatttaatcataactgacttaaacatgccggaaatggacgggataacttttattcaaaaagtccgggcattatctaactacaaattcacgccagtgatagttttaacaactgagtctcaagctgcgaaaaaagagcaggctcgtagagctggagcaacagcctggattaccaaaccgtttactcctgaacagcttttaggtgtagtggaaaaagtagcacggtagttatgtctgaaagctgaggaatatgctaaaaaatttactaaaatgataaaaacaggtactcctcctttgtcaaaggcaaacccggtgaaagccgggggcgcaaagctacaggggctaaagcttaaagctaagccagccagctgccaaagggcttgggaggctttaagctctcttccgtgggggtagagagcttttatgttttcaatagaggaacgaatttcaaagataatggaggaaggcaaggtgtctgcaagcgaaaaagaaattcaggaacttttttctcagttggtgagtacagatgaccttttccagcgggaaaatatttacatagaacttttaaaaagagaagatgaagcaattatcaaaggctttatcgagttactttaccacgacgatccaagcttacgaaatttggcgattgaagctttagtgcagttagatgccaaagcttttcccgaggtaagtaaactactttccagtgaagatgaagatatccgcatttttgcggcaaatatcttaggagagatgaaagacccccggggaattgcagctattcgcgaccacttgctttctgagactaatgttaatgttgttgcctggatagttgaatatttaggcgaatatggaaatgatgaggacatttccttattagagtcgataagggaaaaatttaaacagccgtttatggaatttgcggtaaatcgggcaatacaatccttaaaaagcggtgggaacgaatgaattttgtcgagtaccaaaatttagccgagtatctttaccagaagaccgggataaaatttgaggataccaagtacgattttgtccgacggcgggttgaagaaagaattaaaaagttaggatttaaaagttttcgcgagtattttttccatctaaaatacggtgataaaggagaagaatttcaacttttaattaatattttgaccattaatgaaacgtatttttttcgcgagtattcacagcttaaatgttttgccgaagaagtaatcccggaattaatccagaaaaaaacggtaaagcatatcaaagtttggtcggcgggttgttctaccggggaagagccgtatactttggccattattttaaaagaaatgttagagggtactggctttacctttcaagtggatgcaacagatataaactcccgggtaattgagcatgctcgcaagaggttgtataccaaacggtcggtaaaagatgtacctgatgtttacttagcaaaatattttcgccccaggggcgaagtatatgagttatctgcggaaattgccaggtatgtaaattttcaactattaaacttactggatgaaatagaaatgagcaaaatgtccggttatgatgctattttttgtcgaaatgttttaatttattttgacgataaatcgcgccgggaagtagctcttcatttttaccgggctttaaatccgggaggctacatttttttgggtcattcggaatcgatgagcaggataacttcggtttttaaacttaaaaaatttaaaaacgccattatttaccaaaaaccaggggcttaatgtattttagatatttaataaaaatataaaagaggaggtattgaaatgtctaagactttaccacctttacccgaaggtagttttcaaaaagagaaaggagtaaaggcttctaccagtgaggcgcttgtgtctcaggcggaggtacagaaaaagttagaagctcagagaaaacaagccagaacttttgctaaacagcagcaaatggctgaacgtttggcagtggcaacggaagaactatcttccagtgtagcggaagcaacagcagctgtggaagaattaagaggttcaatggagcaaatttcggcaggagctgaagaagcgagagcagcaacagcagaatcgctccaagctgtaaatcagatagtcaaaaatataacgattgccgcggaaaatgctaaaaagggaaatgagaaaggtgttgcagcggaaaaacttatacatactacaggagagagcatagagggtttagtaaatggtgtagttgatgctgctcaaagaaatgaaatggcagcggatgcagtagctaaattagaagctgaagcagaaaacatcggcaatattgtaaaaactgtggtgaagattgccgaccagaccaatcttttagccttaaacgcagctatcgaagcggcccgtgcgggggaacatggacgcggttttgcggtagtagccgatgaagtaaggactttagcagaaatttcggaaaaagcagctaatgatattcggaacatggttaatgaaattcaaagtgaggttaaggctgttgctgatgcaattaataacgctgcaaaaactgcaaaagatgaagcattaaagggaaaagaagttagtgctaagttagaagaaataaacaggaatatcaaagaattagtagcgtctgcagaaaatgtggataagatgtcacaggaaatggaaagaatggctttggaattccaaaagggagttgaagaaattgctacggcagcggaactacaatcgggttctgcttatgaagctttaaccgctatagaagagcaggttaaagcaatgactgaaatttccgcagcttccaatcaactggccaacatggccgatgagctgaaacactccactgacgtgaaaaaatcatcggaagagctggctgcagcagctgagcagctttcggcgtccattgaagaagctaatcaaacttcccagcaaattatggcagctatagaacaaatcgatgaagccgctaaaaaacaatcggcagctactgaacaatccaacggtgctgtcataagacttgaacagtatactcaacaagtagcaggttttgctcaccggatgttagaggaaaccaaaaccatggtcgaattattagatgctaataagcaacgagtactaaatttaattgaaggaattaaaaaagctgtagaagctaatagggaaaatgtaaagatgctagcaagtttatctcaaaagtcgcgccaaattgacaaaattgttgatactattgttaatgtcggtattcaaaccaatatgctggctgtaagtggagcaattgaagcagcccgtgcgggagagtacggtaaagggtttgcagtagttgctgcagatattcggaatttagctcaagacagccagaaaaatgccgaacaaataaaagaactagtgcgtaatattcaggaacaggtggcggaagttgctaatgaaattaatagattaggcgagtttattgaaaaagaagcacaatcatcacaaaaaactgttgattacttaaatcaactgaccgatgatatgaacgaacttttagctgggaacgaagtaattttaactggaagtgaagaaattgccacggccttaggacaatccaagaaagctattgaacaaattgctactgcagctcaagaagctgcttctgccacagcacaagcctcctcggcagctcaagagcaggctgcgggctttagagagctggttaaggctattgaggaaatttcagcgttggcagatgaaatgcagcaactatagaatttttcagcgaggtgaagtggtatggatgatgcccgtggccagttaattacctttcatctgggtaaagaaaggtatggcataaatttaaactatgttcaggaaataattaggccgccggttatattaaaagtaccaatgactcctgagtattttttgggactagctaatcttagaggcgaaattttacctattttagatgggcggcggaaacttcagctgccgcccaatgaactttccgatagctcaagggtagtagtattaaaacttgcccaggaaaagatagggcttttggttgatcgcatggcggaagtggtagacttagaaggggcggtttttgaagaaattgccaatgcccaagtaaacacccggctggttagccgtgtggtaagacttccgcacaccgaagagttaataatggagattaagcccgaaggcatatttgaaaagaagcttgatcaagtcagtagaggacagaaaagttttgagctaacagaagttaacgaaagccaagaaattgcccaagaaaattcttcgttggagcaattaattggttttaaattaggcaacgaggaattttccttacctattgctgcagtacaggagattgtgcgggtgcctgaaattatttcaaaaactcccggattgcccgcatatgtggaaggtataataacactgcgcaataatactttacccattattaatttgcgacttttcttgggacttgaacgaaaagagtatgatgaaaaaacacgaattatagttttaaatttaagcaaggaagaaggaagctatttatttggtctggttacagatgaggttactgaagttttaagggtgcaaaagagcgacattgatgatgttccttcttatttagcaaacgatgcgggagaattgatcaatggtgtttgtaaattaaactccggtcaaaggttaatctataccttggttcctgaaaaacttttagccgaaagtaaactgcaattagaggctaaaaatgaagctgaacaaagggaagtgatttcggagttgatgtctcaagaaaatcaatttgtcatttttggtttagataccggggaatatggggtagaaattggaaacgtacaagaaataatccatgttcctgaaataacatctattccgcaggctccttattttgtcgaaggtattataaatcttcgaggagcaattttaccggtattaaacttaagaaagaaatttaacttacagttaaatagtgagcgggaagcggaaaggattattgtagttgattatcaggggttaaaacttggtttgatggttgataccgtgcgtgaagtactaaaaataaatgaaaaggaaatagagaaaacgccagctcttttaaatgatgaaattcggcaggagtttataagcggtattgctaagataaacggtggagaacgtttaattctgctgctggatctcaagcatgtaattagccgggaagaaaaagaacaaattgaggaggcattagatattgtccaaaattagagttttgatagtcgacgattcagcgttaatgcgcaaatatttgcgggaaatcctggaacaggacccggaaatagaggtaatagctgttgcacggaacggacgggaagcagtggagaaagctttagaattgtctccggatgtcattactatggatatcaacatgccggagatggatggtttaacggctatccaatatattatgcttcaccgtcctactccgattattgttatttcctcattaacgcaaaagggagcattaacaacctttgaagctttggaactgggtgccgtcgattacgtggccaagcccgacggcaccgtttccttaaaaattaaggaagttgccgaagaaatattacaaaaagtaaaggcagtagcaaaatctcgcggcgttgttcgcttaaaagcgcgcaaagagcggccttttgttcaagaggttccaaaaactaggccggttagccccgatactagttttaaaaaattaatcttgattggggtatctaccggtgggcctaaagctttaatggaaataattccaagacttccggggaatttagatgcgtctgtagttattattcagcacatgccggagaaatttaccgcgtcctttgctgcacgcttaaataattattcggaactttacgtgaaagaagcagaagacggagaaagcctagagcggggtaaggttttggtagctcgcggaggaattaatctcaagttagaacgtaaacttggcatcaatgttgtacgggtgcgctatacccctcttccccgggaaacaatttactggccgtcggtggatgttgcctttcgttctgctttaaccgtaattgaaccgcacagaataattgcagttttacttaccggtatgggggatgatggagctcaagctatggtagaaattaaacaaaaaggcggttataccatagctgaaagtgaagagacagcagtagtttggggaatgccccgggaagctattgaacggggtggagcttcagaaatcttgccggtgtatcaaattgctgaccgtatagtagagttggttcggtaaaagaggtggctgcatgaaagttttaatcgttgatgattcctttactgttcgacagtattttaaggaaatttttcaaggatttagttgggaagtagaagaagcggtaaacggtttagaggctctggaaaaagttttaaatggagaatttgatttaatgaccgttgatgtcaatatgcctaaaatggatggttatacttttgtctataaagtccgggaaatgggagtttcgttgccggtaattttaatttccaccgaatcaaaagagcatgataaattgaagggcttacaagcgggggctaccttgtatttggtaaaaccggttttacccgaacaaataataagctatgctatgttattaacggggagttgattggttttgagtgacttaagggaaacctttgtttttgaggcccaggaacttttggagcagttagaacctttaattttagacttagaaattaacagcagcgaagaaaccattaatgctctttttcgtatagctcatactttaaagggttcagcggggatagccggtataaattcggttaaagagtttactcattatcttgaaaccgtcttagaagccctaagaagccatgagatagagatttccagtgatgtggtagaccttttgcttgaagcctttgatcatttaggggaattgattacagctttaactcttggcgaagagcgtccttataataaggacatagcagaaaaattagccgggttaataactgcaactaatgaatcaactttaccagcccaggaaacaaacagcttggcaactgtacctttacttaacaaaagccatcttttaaaattaacggcttcagactgtgctaaacttttaaaggcaaaggctaaaaagcaaaacttgtatcaaatttcacttgacttttcgcctaatttcttttactttgggcaccggttagagtatgtgcttgaagacttaaaggccttaggcaatttagtgggtaaatattatttttggcgggaagtacccaactggactgatttttctccggaaaatctgtatttaaactttgagctgtatctggccacgaaaaaaagccctaaagatattgaagatgtttttcttttcattgcctccgaggaaaatagtgtaagaattgcagaaattactgctactgatttagaagagtttattaaaggagaagtagatagccaaggtttaagaaaaaattatgagaagttaactttagttttacaggaaatagcggagtataatgaccgcgaacaaataaaagaagctttgaaccggcttttagccctatttaaggatagtgctttttccgacaatccctggcttgccgggggattagtggctcttattgaaacaattgctgaactcgtagagagcgactgggaaaaagcgcagtctataaagcagcaggttttagaaatagcttttagtatcctaaacgaagtaacggagcaaaactatgtggaaaccaatctcttaactgtccttaccgatttttatgagtttattggcggtgatgaaggcgaaacggagatagaagtagatgagaaaattcagcaaaaagctgaaaaagtagagatatccttatcttatgtagaggaacttttaaaacagcttttagaaggcctgcggcaggttaaaggtgaaataaaagagccagtttaccaggctgctgccaaggctattaacaatgtggaaaaatatttaggaattgaccagactgaatgggaagggagtttaacttttgaacagttaactgctcggttgcaattccttcttgaattaatttcagtgcctcaagaggaagaaaaaccagcaattgaagaaagcaaagaaaccaaagaaaaagttgcccaagatactaaggagttagagcaggaaaacttagcaaaagccaagagaaaaagccaagcattgaaaatatcccaggaacttgccgataaacttctggctttagccggtgagttgattattgccaaaaatagtttgccgtacctggtaaaaaaattggaaatgcttgggcaaatggaagttgcccgggaattaaaggataaagctctttatattgaccgtttggcccgggattttcaggatagtttaatggaactgcgcctcttaccggtggaaaatatctttaagcgctttccacggtttgtgcgggataccgcaaaacagctaaataaacaggtaaacttagttttaaaaggggaagaaacaaagttagaaaaggatatcttagaagaactctatgaaccgttacttcatttggtgcgaaatagcctggaccacggtctggaggaaattgaagagcggattacgggaggaaagcctgccactggattattggaacttgcggcttacagccagggtaataaggtgataatcgaggttaaagatgatggtaggggaattaatcgggaaaaagttttgaagaaagcaagagaaaatggcttaattactgccgaggaagcttcaaggttaagacccgagcaggtatatgagttaatttttaagccaggatttagcaccaaagatgaagtaaccgacatttcgggacgcggggtaggcatggatgtggtgaagcaaaaagttaatgcccttggcggtcaagtggaagtattttccgaggaaggtaagggaacaaccatacgcttaattttgccaatttccatggcaacaacggaagtattaaagtttactgtaggtggtaagctatttggtattccgctttataccgttcgggaaacggtaaatgtgccggttaaggagattaaatcttttaagcaaaaaccggtagtggttataagaaacaatgttattcctttagttaatttagcaaagaccctgggcttaaaagaaaaggagcaagaagaagttaagattatcattttacattatggatttgccttaattgtggacgatttacaagggaaagaagaagtaataattaagcctttaacgggggaattaagtcacctttcgctgtatgaaggagcatcaattttaggggatgggagcattctgttaatccttgccccgaccggccttatgggtggtgaaatgtagtggcagaaaaggttattgatttgcctcttaccattgaaaatgtagcccgggtaaaagaagaattaggggagttaaattttaaaaaaatagtttttactaccgaccaggtggaccttgctggttggcagcttttaaagtgtttgcaattaaattatcccgatatcacaattgaaattgccaaaagcccggaaatctgggaggagtttttagaattaaactaaaaagttatatgcataattcttcaccggttaaagggccattttttcaagaattttgttgggaactgccaatttgccaatatcatgaagcaggctgactttagccaaacattccatttttcaggacaagttgttctaattttgctgaagcaaaacaacttttttgaaattcttgaagcagcaattctctaaataaaaactcctgcctctataatcgggcaggagtttaactttcctggtggacgcgaagggactcgaaccctcgacctcctgagtgcgaaccaggtgctctcccagctgagctacgcgcccgtctttttagttgtaatttatccgagcatctcatataataaaccgtaaaggaagttttgtcaagaacctgggcttgccggatattgctaaaaaataaattccaaggtataatatggttgaaagaaaataaaagagtcggcgagcccctttaaaaaatccttgacttttagcttttatttttgctaaaatacctctaaagtaaaggctgtgatagggaaaagtaggatttttgcagggccgaaagcgagccggggagggtggaagcccggtggtccggaaaatctgaagttctccctggagctggccgctgaacaaagaagtaggcggacccggagagttccaccgttaaaaggaacggggtatcggaggtttcctgtactcttagggtggtaattaaacctttggttccctaagccaaaggtttttttgtatcctaaggaaatttcccgtacctttaacgagagggcagcaatgccaagaagggtggtaccgcggaagacgacccggtctttcgtcccttggggatgaaggaccgggtttaatttattatacggaggtgttggaatatggggttttaccaaaacttaaagaggactggtggcaagagttaaccagccagaaaaggtttatgatttttgccgggccgtgtgccgtagaaagtcgggaacaactggagaaaacggctcaggtcctaaaaaaatacggtattaacggtctacggggtggtgcttacaaaccccgaacccggcctgaaagctttcagggccttggagaggaaggtttaaaaatattggcggaaattaagcaaaagtatggcttaatagttgtaacggaagttttggatgaagagtctctggaaaaggctttaccagtggcggatatccttcaggtgggcagccgcaacatgcaaaacttttcccttttaaagaaacttggcagggtcaataaaccggttttgttaaaacgcggacttgccgctaccattgaagaatggttaggggcaatggcttatatcgaagaagggggtaaccaccggataattttatgtgaacgggggataagaacctttgaaaaaatgactcgtaatacccttgacatcagtgcggtacctcttttaaaaaggctctgcccttacccggttgtagttgatccaagccatgcggcggggcgggttgatttaattcccgctttggccaaagcggcggttgccgccggtgccgatggattgttaatcgaagttcaccccgagcctcaaaaagctttaagtgatggccaacagtccctggaccttccttcatttattaaacttttggaagagttaaacccctggcttttggcagcaggcaagactttttaagggggatggcgatgcgcaccggttatttagggcctccagggactttttcagaaaaagctttaaaacttttaaaaaataaagttacccagaaagtttggtattcatcgtttaaagatattgctcgggcattaatagatggtgagatagaaggggcattgtttcctttagaaaatagcctttccgggaaagttttggaagtagatgctatactcaaaaccttaaaagaaaagcttatcctgatagaggaagtatttttacccattacccccgggcttttttcctattcggcccaatcgttagaggaaattaacgtagtattgtcaaggccggaactctggcagcagtgccgggaatattttaaaggcagggaccatttaaggtttatcccggctttaagcagcagccaggcagcagagaaagcaaaaaaaattaagggggctgcctttattgctgacctggattaccggaacgaggcaaaagttttggagctttttctaaacggtaaccgcccatccgttacccgctttggtttatttaaaatattgtaacataatttaagaaaaagaaggaatttttagtttaagagagaaataaagtataacataataaaaaaatatactattctaaatggggggattggatgggtaagataacggttaccgtcattaaagcggatgtaggagggttcgttgggcactccagtgtgcatgaagagcttctggccactgcccgggaacagctggcgaaaagccctcttctggtggattttcatgtaacccacgttggtgacgacatcaatttaatcatgacccaccgtcagggggtggattcggaggaaatccacaagttagcctgggatacttttgtagcctgcacggaagtggccaaaaagttaaaactttacggagcaggacaggatctactggcggatgctttttccggtaacgtcaaaggtctgggtccgggaattgcggaaatggagttttttgagcgaaccagcgaaccgattatcgtttttgccgcagacaaaacggaacccggagcctggaacttgccgctgtataaaatgtttgccgacccgtttaacaccattgggcttgtcattgatcccaaaatgcacgaaggctttaaatttgaagttttagacctcctggaaaataaaaagattatcttcaatactccagaagatttatatgaccttctcgtatttatcggtgctcccggccgctattgtgtcaagagtgtttataccaaagccggggaaattgccgctacctccagtacccagcgcttaaacctcatggccggccggtacatcggtaaggacgacccggtgttaatcgtccgctgccaaagcggtttaccggcggtgggcgaagctttagagccctttgcccggccgcacctggtttccggctggatgcgcggttcccattccggaccgttaatgccggtgtcggtggccgatgctactccgtcccgctttgacgggccgccccgggtaattgcccttggcttccagctggccgatggaaaactcattggtcctcaggatttctttgccgataaagcttatgaccgggcgcgggagatggccttaatgattgccgattacatgcgaagcctcggcccctttgaaccccaccggctccatttagaggaaatggagtataccacgttgccgctggtcttggaaaagctaaaagatcgctttgtaaaagcataaaaaatgcataaaaccctttccttgttgggaaactacccaaaggaaagggattttttttgtggtaagtggtaggtggttggtcgtcggtaaaaaaatttctctaccaccaacgacctctcatagaccaccttaaaaaatacacagcaaggaggaaaatattatggatttaaaaaaccgcgacaatgccattgaagaaaaaatgggcagtgccacccactggtatttaaataaccgctcaccctatctaaaagaatgggaaattgctgccgatggctttaccgccaaaggggctccctttagttttgaccttggctttaaagataagtgtgatgaagtgggagtaccctgggaagcttttatcgaccaattaaaagccggtaaaagtgatacggaaatcgccgaggaacttggcatcaccgaaaagctcgccgcaaatcttcgctaccagtttgaaaaatacggtatcaccggcgttactggtcaggattaactataaggctctggtataaatcgtacattaaccgggcggtgtattctttgctaaaattttgggcgtttttacgagcgttttgggaaaatagctttcgtaaagcttcatcccggagtaaaaggatgactttttcagcatattcccggggatttggaccggtaagaaagccgtctactccatcaaataccattgatttggaaccaaaagcccttacccccacagccggaagcccggcagctttggcctcagcaaaaaccagtccctgggtttcggtaaccgaaggaaaaagaaaaaggtcggctccggcgtaaaaaaggggtaccttttccggaggtaccggaccgatgaatttaacggaattgcccaggccgagttcctcggcttttttttggtaatggggtaattccggccccccgccaactatcactaaaaccacatcatttagcgtagaagccacaatccgaaaactttccaggagaaaatcaacgtttttttccggtgccacccttcccacaaataagcacacttttttcccctttaaactcagggttgtttttaaccaggaactgtcagctttgctgaacggttccaaatcaatcccggtgggaattaccgcactccgggtctttaagcctttctggcaaagatagtcccgaatggtttcggtgggacagattaccgcactgcatttattggcaaactgcaaagtgtaccaggaagtaactgctctggcggttttccgggcgaagggaaagtagtggacatattcttcgtataacgtatggtaggtaaaaaccaccgggatatttaattttcgcccggtcttttggcccaaacgccccagaagaaaaggactatgcacatggattaaatcaactttttcctccctcaaagttttcgaaaccttaaacgaaaagggaagggccaaatgaaactctttattggttggcgccggtacagagaaaaaacggtaaaagcccttttcttttttgaaattgccgtaagcggggatgaaaaaaataaattctactccgcgttgagaaagttcttcctgaaataaatcaatggaccggaccacaccgcttacataaggatggtaactatcggaaaagacggctactttcaataacaagcctcccctcctggagatggccttctggcaccacatctaaaagatttagtttggcacagtactccacatcccgggcaaaaccgaggttaatgagcctttggccgtgaaaggaacgggttaaaatttcctccggcgggttactgcgggcaagctcaaagctaacgtaagcctgatcggaaagttcaatctttttttgctccgctaaaagtgatatgatataaccggctccagcaaaatcttccagagaaaattgactgtcggtgccggagggcattaagaccacatcaagattaagttttaaaagataatcggcaaccgctttagcattaacgatacttccggcaataagggttcgggcggatacggcttttttaagggttttggtaccgttagttgaagataagattatggtttttccttttaatccttggtattccaaaggggaattgccaaggtcaaaaccgggaaccttaattccgccccgctctcctccaaggagcgctccggaaattttctttttaagtaagaatgcttccttaatcgaggaaacgggataaattttttcggcaccggctgccagggcggtggcaatagtggtggtagctcttagcacatccaggaccaccacggctttatcttcggcatttttaagcttttcgggataaaataagacatcaatcttcatttaaccttatgctccttttcttttgcttattatatttttagtttttttaacaacacttattatacaacataatgcgggaggtttttatgaaaattttgcttttggccgagcgttttggccatggccacttaaaagctgcctacaatttacaaaaagcttttggggaagtagccccaaatgttgaagttaaggtactaacgatgttaaatttaattggcccaaaaattgaaaagatagcttcggatctttacttaaaaattttaacccataccccggaaatctggggctatgtttatgagcagggacacgataaagaaaaggaccggctaaggttggtggtagcttttttatacaaaaagaaacttaaggaagtaatccgaaagtttaaacccgcggggataatcgtcacccatgctttcccggcggtggctttggattacctgggttaccggaattatgctacggttattaccgattatgattaccatgccttctggttaacgcaaaattcccgtttttactatgtggcggcggaggagattaaagaaaagttagtgggaaaagggtattcccgggataaaatatacgcctttggaccaccgattgatccagtctttgccggggaaatcgatgctaacgcggtcagggaaagatatcaaatccgggaagggactaagattattttaatgatggggggaggtctggggcttggacccctggcggaggcggcaaagacccttacggatattaataaagaatgggtggttatcgtattatgcgggcacaatcaaaaactgtaccgggatttaaaggttttgggaaggcgaaatttaattccggtaccttttacggcagaagtgccggaatatctggctgcagcggacatagtcatcaccaaaccgggtgggctttccaccgctgaggctttagctttaggaaaaccgcttattatcattaatcccttaccggggcaggaacagcgaaatgccgagtttttacaaaaaaaaggtgctgccctgtacctatctgatgttttggaactaaacaaggttttgccagagttatttttcagccaaaacctcttatccctgaggcaaaaggcggcaaagctcggaagaagggatgcttccataaatatttccaagcattttttccaaaatatcggggataatatatccggaggtgattaagatgacggaagttgcctgccaggtggaagaatgccgtttttggagtaataatgtttgcaccgctaagtccattgaggttcgttcttccggaacccgcaaagtcagcaccagcgatgataccgcctgcgaaacctttatgagcaaacagtaacctttaggaacggtttccttaggtggtaggtggttggtggtaggtggtctgtataagactactttaagccgatcacctactacctttttttaattattatcacctatcactgaccacttactgccatttttgagctgtactacttaattattttctactgtttttttactctattattgttgaaaaaccagcaaaaatatgcgaatattatagaaaaaaccaaaaacaggagggtaaagatgaggctgttggacgcttatttaaaagtggcagaaaatctaaaagagcttttaggggatgaagtattgctggcaatttccgataaggaaaattttatctggtataaaccagcggcggacattgatttaaatatttatccggggatgccgatacctccggactcgattgcacgacaggttttagactccaaaaggcgaatagaaacgtatgttacgcaggaaaaaagtgcctttggtaaaccctatatatgtaaagcaatgcccattatcgaagatggggaaattcagggggtcatcgttctggacaccagcaccgaaaagcgggatttagtccaaagggcgattggggaattagaaagcagtatcaaagaaattaacaaggctgcggaagaattatccagctctgccaccaatttttccggcgaatttgcagcccttgcccaacgggctggggtgatcagtaacgatgctaacgaaatccggcagctggtggatttaattaatagcattgccgataaaacccatatcctcgggttaaatgcggccattgaagccgcccgggtgggtaaccagggtaaagggtttgcggtggtggctgaagaaattagaaagcttgcccagcaatccaagtttgcggtcaaagatattgccggaaaaattgaaaaaattttaggagaaatcctcgccctggctcaatcaattgaagaattttccgggctgagcgaagagcaaacggcaatttcggaagaactgcactctactttaagcaatttagaacaaatggcaagggagctttcaagattagccgagaaattttaacgctttcattaaggcataagctttatccagggtttccaaatattctgcggtggggtctgagtccaccgtaatacctccgcctacgccaaagtaggcttttttattttttaccaggatcgttcttataacgatgtttaaatccatgtcgccgtttacatctatatagccgatgcagccggtgtaaattccccgccgtagtccttccaactcctcgataatttccatggcccggattttgggagccccggtaatggagccgccgggaaaagtagcggctaaaaggtcgatagcgtctttaccttcagcgagctcagcggtaacggtggaaaccagatggtaaacggtagcgtactgttcgaggacgtacagttccggtacctttaccgtgcccactttggctactttgcccagatcgtttcgctccaggtctacaatcatggttaactccgcccggtctttttggctgttgtaaagctcatctctgtttgcgaggtcttcggcaatggtctttccccgagggcgggtacctttaatcggccgggtctggactttgccagatttaagctctaaaaaccgctccggcgaagaactgaggacggcgaattccgggtaatggagataggccgcaaaaggagcgggattaatctttcttaaatacttataaagctcccaggggtctcctgtaaagtcagcggtaaagcgctgggagaggtttaccacaaagatatcaccggctttgatgtactcaatagcccgccgaacgatttcctcgtaactttcccgggtgaaattagaataaaactctcccgccggaggataaaacggaggtttaacttctaaattccgggatttttcgatgtattctaagagctcttttaatttatcttcccggtagcttacggcgtagtaccggtcatttatgtggtcgactgctacgaaggtatcgtagtaaccaaggtaaaagtcataaagatttaaatcatcgatggcggtgctgggtaaaacttcgagcatccgacccaggtcataggcaaaataccccacaagcccgcctttaaagggaaacggcaggtttaaagcaggttttttaatttcggctaataaggactttaaaaaagaaaatggatggctatataacttttcttcccggttatcataggacttaattataagatttccccgacttttaacggtaaactccggattaaagcccaggaacgagtaacgaccataggtactgggggaaagggaagaatcgagaaaaaaccactcttttttgggaaaaacttcagctaatgctataagatcaaattttggaacttcaattatctgaaaatatgtcatattattcaccgctttcccaaagattggcggaatttacgggataaccataattatttagccttttttccgggaatttgtcaagcaaaaatccggataacagaaataattttaagaggaatttaccgggaaaagcagaaatagattaaataacaaaatatggtaacggtgaaaaataatgaagtttaacttttaaatggggggaaggaataggatgatctggatagtggtgaataattaccttcatgatttggctaccgggcttttactaacggcggtctttaccctttaccttgcccgccggctctggtgtgactgcatcttaacctttactcaataccggatatttttccgctatttaagccgggttttttttattgcggctatggttgtaatcctggcagggatcccaagggccctttattttcgagatgtagaacttattccgatgattaagaaggacatggtcttactgttatgggtcaaatatggcttacttcttttagcggtaatcggtagtatcgtcatgtggtatcggctaagtagggatttctacgttgcggtggaaaatcggtggttgaatataaagatgtaggttttaaaagatttgattatttgaaatattacgtctttgacgaaaatttacgatatctgtcgaaaactcctgcttttttagtagcaggagtttttggtttttttgtcgaattgttatcttcaatggtgggagggtttttatacttacatattttaattaacatttaggtttaggaggtaatatgaaaaagaaaaaaaccaaaacattggctaataaagaaagtaatgttataagtttttctatttcaatggtttatgagaaagtaattatcattttgattattttagcggctttgatattccgtttatatcaaataaatgaaccttttataggtctccatgactggtcgtcggcggatcttgcccgctgtgcaaagtcgttttttacctttggtttttttaatttaaaaggcattccggtaatgaatgtagtaccacctctggatggtcatcttcagtactattatgactggccctttttaatttactacttatttgcaataagttttaaaatttttggttttggagagtggagtgtaagaatagttgaagttttattttcttccggttcggtttatttaatttatttaattgtaaaagaactctgggattctgaagttgccctaatttctgcatttatctttgctttaatccctttaaatgtctattacggacgggtcggtgtgtttgaaacacccaatgtattctttatgcttttaatgctttatggctatataagatggataaaggaatttaaaagaaaggattatttaatatttttagctggttttcttttaggtgcttttgaagcctggcaaatttacaccgtggcatttgttgtttttttacatgcgctttggttatatttatttaaagggaaaaaaagccgtaagtttttatctttagttttcttgtttgccataattgtgattgtttcaggtttaatgcaactggcctacctatattttgctctgggtatggatgcggttaaaggattgtttgctgcaggtaagaccagaacggcaacggatagtatgggtattacatttaccatttcccagtatttaaacgaagaatttagccggatttttaccagggctggagtatttaactttattttagctttaattggtctggtatttataggcttaaagcagtttaaaaaagaagagaagacaaacttagatatacttatcgtattctttttgagtggaactatctggcttgtggttatgaaaaaccacagttttattcacgaatatactttacttcattttatgccttttttaagtatggcagttgctcttggggtaaaagaactttcaaaaatatttgttactgcttttaaaaactggaaagtaggtttagcggtaattcttttacttcttgccgttgtttccgttgaaaatattcctaaaacttttgaaatatttaatttagatttatacggaaacttgagacttactggccttgcccttaaagaaagtactgaaaataatgctgtttgtattacaccgcaaaatcatccgggtccaccgactatagattactatgctgaaagagtgattttatataataaacaggatttagcaaatattcctccgaatcgtccggtttatcaattttatatctttgaacaagggttagtacaagaatttaaaaattactttgccaaaaataatcctaaaattgtctacttgcaaaatggatatgttgccggaattgtaaaaataagataacaggaggagcggcattgaaattatcagtcattattccttgttataacgaaagggccaccataagggaaataattaaaagagttcaggaagtcccagttaaaaaagaaataattgttgtagatgatggatctacggacggtactcgagaaatattacaggaaattaaaaacgagtttgataatatacaagttattttacaaccacaaaactatggtaagggctatgcttttagaaccggattaaatgtagcttctggcgaggttgtaattatccaggatgcggatttagaatatgatcctaatgattacttaaagattttagagctttttaaaaaccctgaagtaaaagttgtgtatggatcacgtatcttaaatcccgcaaatgaaaaatcgtatttaagtttttatttgggtggacggttggtaacttttattaccaatattctttttggcagtaatttaactgatgaacctacctgttataaagcttttcgcctggattttattaaaagtgttccgatggtaggtacgggttttgaattagagcctgaaattaccgcaaaaattttaaagcggggtgtaaaaatttacgaggtaccaataagttattttcccagaaaagccgaagaaggtaagaagataaaatggaaggatgggcttttagcaatatggacgcttctaaagtacaggataaaagattagcaaggagaatggagatgacaaagtatatcttgttgctgttggcaattacttttattaatgttattggacagtttttcattaaaaaaggtgtaagtgggcaagagctatctttggcttctttagctgggataaagtatttcttaactctatttttacagccatatataatttttggttttcttttctatgcagttagctcgatattgtggatgtttgtcctttcaaaggttgatttgagcttagcttatcctatgttatcttttggatatgtactggttttggtgatatccaaattttttcttcacgaggctgtttcccttcagaggtggattggggttttcttaatttgtgggggaatgattttgctagcatggaataattgatattttggaggatatttatatggatcaaggtgaaatatggaaaaatttatcgaaaaatagtgatatcttcaatatgattaattgttacaaaaatccattaaactttcaacgagaattagctgaaatgatcaaccaacattttctgaataaaacaaaagtgcttgaagtaggttgtggtactgcagcgacaagttatttgctaaataataattttaatattaccgttctagattataatgaagatttaataaataagctaaaaactttgtttacgtattacctcaataaaaatattaatattgttttgggtgatatgtttaatatgccttttgaagataaaacatttgatttagtttttaattcaggggtaatggagcactatagattttctgaacgagtagttttattgaaagaatatgcaagggtgttaaaagatgatggtttgatgattatcgctattccaaatcattatgattttgcatatagattagcttatttagtaagaaaaagattattaagagggagaaattggccatggccggaagaatacaaaatttatgatttaaaaaatgaaataaatgaagctaatttaaggcttgtaaataggataattgttgataaggaaactaattatagctttattgataatatttacattagaaagattatcgagtttgttaataaaaattttaataaaacaaacgaaggatatttaacagtactaacgatatcaaaataaatcaacttacctttgataaatcaataaaacttttgcttgttcaattttgggaataagttttaatataaaaatgttatctttgaattgataagttttatgtaacgcacagttttgggcaatgaatcttaaaaaattttataagtataatttgcttggttagggaaaaattaaaattttaattttaattttacttgacctataaaactaaaaataatattttgtagcgcatttaaggaggaagattatgaaaagtattctttatctttcatctattgcttgggattttttgaagcagaggccgcaagaaattactgaagctttcagtatgttggggcataatgtaatttatattgggaatcgtgagtatttgagggctagtagaattaacttaaaacgaattaaaagattgttttttacagaagaaattaaaataaacgaaaatttgaaagttataaatatgagaatattgtatccggaaaaagtatttaagagcttttttaaaaaaaagaacttaagtaataaaattaaagaatttcaacaaattataaaaaaatactttggtgaacaaaaagataaaaacattatcataatatctaacccgatgtacttggaattatttgatatagaattaataggaaagaatagtattaagatttatgattgtgtagatgatatggaacacttttttaaagaaagggaagatattgagaaatttaaatttcttgaaaaaaaattaattaaagctgtagatgaaatttggtttactggggagaaattatgtgaaatatatttagaaaaatataaaagctacataagtggaaaaaaaacaaaaattgttcctaatgggataagtaaaaacatatttgataacatattttttgaaaaaaaatttaagacatctaataaaataaatattggatttgttggtgctatagctgaatggatagatatagatttaataaaagaaatattaaagaatgataaatatgttcttaatgttgcagggccagattttattaatgttttacctgagcttagaaaatataagaattttaattattatggaataattgaaaaaagtatggtacctacatttaattataatcaggacatatgtttattaccttttaaagttgaaaattctttaagcatttcttctgaaccattaaagttaattgaatatttatacttgaaaaaacctgttataagtactaaaatacctgcaataaaaaaagtggaagatatggtgtatatagttgagtcccttgatgatgttgaaaagataatatatactgctttaaatgagaatgaaaatataaaagatttacggcacagatatgcaaatgaatatatatgggaaaaaatagcgtatgaggcaattaaagatttgtaaaagttaatcagttaaaaataaattaagagatgaaaggaaataaaaaatgcaaaaaaaaatgttgattcctataagttcaccttgggaaaaacatcataggaaacagcttattttaaatcttgctgatgaatttaaaaattttgtagatatttatgttatagatcgaccttatgatattctaacgtattttttaaggaaaacagtcacaaaaaactattatagaaacacaccaggattaaacaaagtgaaagaaaacttatatgtattgggtattagccaagtttttcatgaacacatcagctcattaaatgtaatgtttgattatatcaataaaaattatgtaaaaactgaaattaaaaagtttatttcggatgttgatataatatggatcagtgaaccgaatcatagattttatttcgatatattttataattcgataaaaatatatgaaatttatgacgaatatttattaagaccaaatggtaaactaagaaatgctaagattgtatctaatgatcaacaaatttgtgatgaggctgatattatattttatacgtcgcctaagatattgcaacgaagacaaaaatatagcgagaaaatgttctttattaataatggagttgattacagtctctttaatgcaaataatgaaaatgaaaataaagtaatacttaaaattgataataaaaaaaggaatataatattcgtaggaaatattggcgaatttatagaaattaatgccttttttgaaatattaaatgaagataataatcacctctatataattggaaattatgaattacctatgaaaaattatattttaaaattaaaaagttacaataattgcacttacttaggatatatagaccacaataaattgaaatattatttacaaaaaatggatattggggtaataccctttaaggaaaataacgaatttgtagaagcaataaatccattaaagttttatgaatatcttgcttgtggtttacctgtggtttctttggatttgccaatatacaataatttacctgaaggcttggtttatagatacaaaaaatttagcgaaattaacgatttaataaaaattgcatttgacgaaaaagcaaaatatattgattttaggaaaaaatatgctcaaaaaaacgattggaaaaacatagctaaagctattttaagtatcttcagggagaaaggtataatataatgagtaaaaatataatgagtaaaaaagtaattgtgttatatgcgggctttattcacaagggcgggggggttgtaacccatttaaaaaatctcgaaaaaggattgactcaagctggatacaaggttgatgtatggagcttggataaaacaattttacttggatattttgtagcgggcattgaaaagatttttgataggattttaccgcctagcggtaagcttttgcgttattttgcaacaaaaatcttattttattttcagttaaaaaagcaatatttaaaatatgattacctgatatttgaagatgttttttcctttccacatgcaaaaaatccaaaaaagctttatttttttcatggttatagggctgactttttgggtgatttaacattcaggattaaattttttgagaaaatattattaaactatgaaataaattgtcttaaaaaagtaaaaagccaaacagcttttgtatcgcgtgaacataaagatttaatagcaaaaacttttaatttaaatttggattcagcgccagttatcgaaaattcaactgacttatctttgatagaaagtgttttaaaaaataattaccaaaaagagaatactattttaagtgtggggcttctaataaaacggaaaaaccctgattttattttagaattagcaaaaaaaattaaaacagatggtattggttttaaaattaagttaataggtgatgggcctgagtttgcaaaaataaagaataaaattgaaaaatatcaacttacagatattgtaattctaacgggaaagctcagttataaagagactttagaagaacttgcaaaatcgaaaatttttatcttaccatcctttaaagagtctttttcctttgtcttactggaagcgaaactattagggaattatactattgcaactgaaggtttagcggtaccggatatatttgttgataaatttttacctcttgatgttaatctttggatggaagaaataaaagatccttcaagcaaaaaagaaataaatatagaagaaatgaaagggcgcttttctttagagaggcaaatcaatcaaataattaattacttcgaaaaaaatatttaatttagtcctttaaaaaaacctttaatacttcctgaagactttgttaagagactagtaaataaagctaaaagaaaattacctattattgataagaagtaaaataaaaagtcaaggttatttttatttttcactttataaatttgtcttaaattataaaccttggccgccatgagtttttccagatccggccgggcggatggtgttttatgatgtattccccaggcgttcattacccggtaaaatttatagccttctttggctaattgcacgcttaagtagacgtcttctcctagggcataaccgctaaaacgctgcaaatcttcgttaaagtaataatttggtttttcaagtagtggttttactggaagaaacatgcagcaaccggagagccagccaacttcttttaattcatcggtaagaataagttcatactcgtttaaccaggtattgcctcctgaaggcagtacctttttttcagtgctttcatggggtaaaaaaaagatctttttaaagaaattaaaaaactttgagctaccgagcttttgaatttcagaaccataagaaatagttttaaaatttaattccaggcaggttttgggtggaagggtttttattttttccaataaaatttcaaaggcattatcgtttagctcaaagtcatcatctaaaaacaaggcataatcgatatcttttaagtatttcaaagccaaaagtctctgggtaaccgaaccaagtttagtggtatattcgtaaattaggttttcaatccgggcttgaaatttttcgcaaacctttttggtttcatcgtttttacttccgtcaataattatgactttatccggttttacggtttgctttaaataactattaaacaaccgctcaatgtcttttggtctgtttaaggttgggataacccatgctgttttaaaattcattttaaacctccgtgtagtgaaaaaatgtaccaaatttagtataatgtttgtagtttaaaactgtaaagagaaaggggattaactttggcaaaattcctggttaccggtggagcaggttttattggctcgcacatagtggaaaggttggtacgagacggagctgaggtcgttgtcctggatgatttatcaagcggtaaagaggaaaatctctcggaagttttagataaaattacctttattaaaggagatgtccgggatttagatttgataaaaggaattactaaagatgtggattatattttgcacgaagcggcgatggcgtcggtgccggcttctatcgatgaccctttaaaatgccatgaagtaaacgttaccgggacgattaatgtgcttttatctgctaaagaaaacggagtaaaaagagtggtttacgcggcatcttcggcagtatacgggaataatgaaactttacccaagaaagaagatatgtacccggagccgctttctccctatgcggtttcgaagtatgccggagagttatatcttcaagtttttgcccggatttacggtattgaagcggtgggacttcggtactttaatgtttttgggccaaagcaggatcccaattcccagtacgcagcggtgatacctaagtttatcgatgcattgttaaaaggtatgccgccgacaatttacggggatggaatgcagaccagggattttatttttatcgatgatgtggtggaggcaaatatgctggctttaacggcccggggggcttcagggaaggtatttaatattgcctgcggagagcggattagtttaaataggctttacaaagtgataaaagagattatcggggtggatattgagccggtatatgctgaggcaagggttggagatgtccgggactccctggcggatatatctttggcccggaatattttggggtttgagccaaaggtgagtttggaggagggccttaaaaagacggttgagtggcataaacggaatttggaggtttgaaagtagagggtggatgctggagaattaatatgaagaagaaaataaaacttttacacctcattaccttaagtgaggcgggaggagcccagaaggttctctatcatattgttagtggcctaaatccggaagaatacgatattaccgtgatggctgctcccggaggagagttattttcctggttaaaagattatccgtatataaaactttggccgctgccggagatggagcgggaaatagttttaacgaaagattttaagcttttattaaaattaatagaaatttttaaaaaggaaaagtttgatatcgttcactgccacagcaccaaagcagggatactggggagaatcgcagctttttttggccgggtgccggttaggatttttaccgtgcacggttgggtttttgacttaaatcaaccacttcttaaatttcttttttatgtctgggcggagcgattggcgggcttgtttggcagcatgatggtgacggtatcccgggaagattaccggaaagggcttgaatacaaaattacccggaaagagaagttaacctatattcccaatggcttgccggaaattataacaaaaaagggaaagcttcgaaaggcacttggaattagtgatgaaataaaaatagtaggaactgtacttcgtcttgcacctcccaaggacttagagcttctccttaaaacagcggaattggtaataaaaaactgggacagggttgtttttgtcgtagtaggagatggaccgcaaaaagagtggcttcgggcggaaatattaaaaagggggctttcggaaaaaatccatcttttgggacaccgggaagatgtttacgatttgttgggggattttgatgtttttacgcttttttcccggcacgaaggcttacccgtttcgattctcgaagctatggcggcgggattgccggtggttgccagtaaagtgggaggcataccggagcttgtttatgagggagaaaatgggtttttagtggatgagggagatggtaaaaaggctttccacgccataatttcccttttacaggatgcggagctcaggtttaaaatgggaaagaggagtttttttctttatagcgaaaattataccgttgaaaaaatggtcagttcctatgactgcctgtacaagaaacttttaaaagatacggaggcagtttttgatggataaaaatacaaaactaaaacttttaaccattgcttccgttttaattgacgccgttttcttaaacctcggctttgtagcggcttttttgctgcgctttggttttaagcttcctgaagaaaactttatagcttatcttaccgtttacccgtgggtaactttagcggggcttttactttttaatgtgtatggtttataccagagttataaacgaagccgggcagaagttatcgcctctaccgtttgggctattgtgcttttgctgccggtagccatgggcatggcgttcttcttccggggttttgcctttccgcggacggttttcgtggttgcccttatcctgcagcttataatttttattccctggcggctctggctctggcggctggagaaaaaagtttttggagcaaggcggcttttattaattggcggtcataaagaaatccacattacccgggataagatcaaagataacaagattgacctctttgaggttgcgggaaagctggcagctccgggaacaattgaggaagttaaggaagccatcaataagtaccggccggaagtggtacttatcggtaataaccttccggacaagcttaaaaaagaaatattacttttaactttgtcggaaaatattccggtgtacgttatcccagattattatgatatcgtcctttcccaggccaagcttgagtcgataggcgacttaccggtcttttatttggaagggctttccttgcctgccgggatgcagatggtcaaaagggcgatggatatcttgctggctttaattgccctaattttggcaagcccgataatgcttgtaactgcccttttaattaagcttgattccgaaggaccggtattttacttacaggaaagggttacggaaaacgggcgaaaattttactgttataaattccgcaccatggtgaaagatgcggagaaactcacgggacctactttagctaccgaaaacgatccccggattacccgggtaggaaggtttttacgggcaaccaggattgatgaattgccccagttaataaatgttttaaagggagacatgagcttagttggaccaaggcccgaacgtcctttctttgtcgaaaaatttaccgatgaggtgccggagtacgccttacggctaaaactaaaatccggcctaaccggtcttgcccaggttgaagggaaatacagtacctcttttgaagacaagctaaaatacgacttgctgtacgccaaagcttatacccctctaaaagatttagaaattatcctgcacacgttgaaagttattttaattaaggataaagcatcttgaatggaaaaagatattaaacctcccataaaatgggaggtttttttctgtttttagcgaatattattttattagtaaaaactagtaaaaaaagggagggttaaaagtggaaccagagcgcttaaagcgccggttaattcgggtggacttgtcaaccacggaaggaaggcttaaatttattttagtggtttccgcacttataataattatagctgctggctcggtaggagccatcgctgctaccatgacgccgggattttgtaagacatgccacgaaatgttgccggagtatgtaacctggcaggccagttcccacagccagcttgcctgtaccaagtgtcatatcgaacccggggttttaaacctgttaaaggaaaaagtaggcgctatgaagcagctttaccagcacgttaccaaaacctatgagcgacccatctttttaccggaagaaaaggagattaaatcggaaatttgctttcaatgccattctaacaaccgggaatatactattgccggcgatatcattgttccccacgataaacacattaaacggcatgtagattgcaccaaatgtcactcgggggtagcccatgcgaaaattgccgaacggggtctgaccgctaccggctccttagcggcgtggacactggagcgcggaaagaaggaaatgtcgacaaaatatgttaagccggaaatggataactgcattgcctgccactttagtcggggtgtaactatccgctgtgaaaaatgtcataagaccattaagacgcccgacaaccacgcggctattaactggattaacattcatggaattaaagcgcgggaagacttaaaatactgtgaatcgtgtcataattacggaatgaaaatggtagcactaaacctggataaagaaccggtagtgaagtatgcccgggggaaccagttctgccggagctgccataccaagaaaccaattacccactcagaaccctggatgccgaaacacggaacctgggccaaggagaaaggctttacgaactgctttgtctgccacaataagaaaccgggcgagtctaaagaaggagcagctcagaccttctgcaataagtgccactggtttgaataacaaccacctgccgttcatgcggcaggttttcttcattaatttggatttttcgaggaaatgttgcggtttatgcccccgctattttggcaaaaatttcaggtatgttatggtaagataaatccgaaaaaaaactgcgggggtatcttatgtcaaaacaaaaaaaaaggcggggtctttaccggtggcttttaataaccatctttgttcttttgtttttaaattacctgcaaaaaattaagataactgactttttaccggtggttaccgaaagttcaaaaccccttactccttttttggttattgaagcttactaccaggaaaaattagcaaaaccttgcggagtttttattcgggatgccaaaatttatgttaccgatggggcacgaaaaaaggtttatgtttttgaaaccgatggcactccggtagcatgttttgggcaaaagggggaatttacctatccctggagtgtatatgtagattctgaggggaaaatctatgtttccgatttaatggatggggttatcaaggaaattgaccctgagagtggtataatacgggagctgggggctgagtttttaaaaagtccaatgggtatctggattgaaggggataaaatgtttgtagccgatgctaaccaaagaagcgttatccttatggataaagagggtaggtacctaaaaaccctcacaaaaaatggtgatctggtttcgccttcgtatttacaggtagtgggggatgaactttttgttaccgatgcggcggccaatcgcgtagttaacggaaaaatggaagaaagttttaccagagtttttggggatggctatttactctgtccccggggaattgcggtttttgcggatacgattgtggtggcgaacacccttttaaatcgtatcgatgccttttcggcaaccgggaagtatctttggagttttggagaaaaggggcatgaactaaatcagatgtttttacctacggggattgcttatgcggaagagcttttagcggtagccgatcagggaaacgggcgggtagtggtttataatattgagaaataatttaccgtttcgggattctcaggtttacacccccctccagtccgggaaaactttggctggaggggtttttatttatgtcaaaaagaatctttcttacgttaatttttttaattgccggaatggtggtggggcaggccaatttgcaaaatctttgcccaaggggttaagctttgccataaaaaggggtgcaaaaattaaaaaagcgcacgggagtgcgctctacaaataattcgctctccatgcaaattgttctgcatagaagtcaatcatgtaccggatggattaccagtcccgataagggtttgggataaaagtaggtggatttttgcggcattttattgcctgacaaggctactttggcaacatcttcggcggtgggggccgggactaaaaaggagtagggggccttaccttttacaacttccgtgaggcagtcttgggcgtttcgggtgtatttcaaatattcaccggaaagggtttctttttctccgatgcctgcgggttttaagatgagttcatgaagaaccgtaaccggaagacgagcaataacttccggaagacccggcagaaccctggccgggtcgttttcttttaaataaagaagataagctttatcttttaagcacataccaaaaacgtaccgttcctttagtgttgcaaaacggtttaaaatttcttttaatggtacttcgacgaaagtaaaataggccaggattttttctaatatttcggccggagaactttgagcttttaggactatccggtgggttggcaggaccagcaatcctggatcggtaaaggggattaactgcattaaaacccggtaagcattaacaccttttttctccatttcccgggcataggtaagggctgtgtcgtaacgatgatggccatcggcaataaaaagctttcggtctttaaagtagttttgggcttttaaaagggcttccgggtcaacgactttataaaatttatttaatcttccgctttcatcggtaaattcaaacattaaacttgccttttcccttaaaatattaaaggccaaattttggctgtcatcatataaagccatgatggggctggtgttaacccgggtttcccgcagaagatttaagcggtcttctttggctttgggcagggtattttcgtggggtaaaattacccctttttcgtaaggttctacctggacggaagcaaaaatgctttttcttatataagattgtccttcccaggaaaagatttcttctaaaagatatagagctggagtttcttcctgaaccagaataccctgggaaagccaattgtttaaatagcttttggcccggatataacggttattttcggtggtatcatcggcaaaggttttccccagttccaggcgaataaagttgtattcgtgttcgttataatatttttcctgttcctccggggaaatgatgtcgtatggaggagttaccaggtaaggtaattgggaaaaaagctcgggattatagtaaatcccccgaaaagcaaaaataccggccattattccgtccctccaaaaaaaaataaaataattagcatatagtttacactatccttcttttttcgtccagcggttcaggtctcttttgtaatatttatccatcgtagccttaaaaatttcggaaagatcgtatcccagggagttggcaaagcaggcaatgataaataaaatatcccctaactcttcttcaatggaaccggagagctcttccggttttttctttttttcgccaaaccgatggttaacctcccgggccagctctccgacttcctcggcaagtcttaccaccaaactcatgggcggaaaatagccttctttaaattgactgacccacttgtcggttaattcctggacttcttttaaatccatatttgcctcctaaaactcgtaaggtttaacgattatctttttaattttggtatcaaaaagcttatgggaatgagcgggccgtatcaccactgcggtgtcggcaccttcgccggttccggcaatggcgattacatcttcgccataaggaattagtccggcatctaacgccatgatcgcaatttccgttgctacctttaccccctggcctaagaggcgtaaggattgggcaacaatttcggccgggtaaattccctgaaacttaaacctgaaagcccggtcaataccggcaaaaaggtgggttgtagttagaactttaaagccttcggccagaagcttttgccggttttccggagataattcatccactcctgggccggcaaagcctacgtggtgggtaacggctaccaggttaaattgccccgggtttaagtattttaaaagcttaaaggcggtggcgccgctgcaggtagctactacaatgttatgaatgttttgttcccgggcttcttttgctgcaagttctaaaacaaggtcggtattgtgaggtcctgcggataatttcactttaaccactccttctgattttttctaaggtttattttgacataatttttttatttcaacaatattattggaaaaaagcggttaagggaggggtatgacttggtctttttggtaaacaggaagcttttatatatagcggttacgttaattatctttatttttgggataaagatttattttgctaatgataactatccggatttaataaaaaaggctgttttggaggtggaaaatctttcttcctaccggtacacttccgaagtgcgcatcatggagagggaaaaggtggagtatttaagccgggttgaaggagttaaaaccggggagggtacctgggttaaaggggaaattttagaaacgccggtggagatactgtgtattgataataccacttattttcgtgatagccaaaccgggaggtggttaacttttccgggaatcaaactggaggaagctgaagcgctggttaatgagttaaaccctttaagggttttggcgtttaaccgggtggaaaatgtccggtttcggggtaccgaaaaaattgacggggagaaatgccttgttttggaaggacggccggattatcagcatcccattttaaaacatttgtattacgattatgaaggaaaattttatctggccaaaaaagataaaaaattaaaaagggtagtgttaagagctaaaagtcgctttaacaaaacggtaatcctggcggtgaggataacctttagggaagccggaaaagaagtgaaacttcctgctcccggctaaccttgcaaagagtttttacaagttatttcttgacatttgtaaattatttttggtataatttccgcatcaaagtttggaggaggtattactttgcatcaggatattgcggaaattttaatatccgaagaagaaattagggctaaagttaaagagcttgggcaacaaatttcccgggattacgccgggcaggatttgctgttggttggaattttacgcggtgcaatgctctttatgtccgatttaatgcgggaaattgatattccgataaacatcgattttatggtggtctccagttacggttccggtaccaccaccagcggcgaagtgcgggtgttaaaggaccttgaccgcgggattgaaggaagaaacgttttgttaattgaagatattgttgataccggtcttactctaaattacctcaccaagtaccttgccaaccgccatccgaaatcccttaaagtctgtactttattaaacaagccaagccgcaggcgggttgaagtaaaggtggattataacggttttatcattcccgataaatttgtagtaggttacggcctggattacaacgagtattaccgaaaccttccctacatcggcgtcttaaaaccggagatttaccgggaataattttaattacacctacaacccaccacataccacttaccacttttaaaggaggtttttatggcgtcaaaggtaattgttttggattttggaggacagtacagtcagttaattgcccggcgcatccgggagttaaaagtatactgtgaaatgttaccgtataatacccccctggaaaaaatcgtccaagaaaacccaggggggattgtgttttctggagggccttcgtcggtttacggagaaggggcaccgacggtagatccggaaatataccgtttgaatattcccatcctgggtatctgttacggaatgcagctgatggcccaccagctcgggggcattgtgcggcctgctgaaggcagggaatacggcaaaacgcccctttttatcttaaatcgggacaggctttttgccggacttaatgagaccgaaatttgctggatgagccacggggattttgtggcaaaagcccccgagggatttttggttacggctaaaaccgagtatacgcctattgccgctatggaaaaccgggaaagaaatctttatgcggtgcagtttcatccggaagtggttcatacccctaaaggaaaggaaattcttaaaaatttcctctacgaaatttgcggcttaacacccgactggacgatggaatcttttgcccagaaggccattcgggaaatcaaggaacaggtgggtgaggagaaggtcgtctgtgccctttccggcggggttgacagctccgtggcagcggttttggtgcataaagccatcggtgataatttaacctgcatttttgtggaccacgggttactgcgcaaaggggaggcggaagaagttgtccgcacctttaaagaacagtttcaaatgaacttagtttttgtggatgccaaggagcagtttttggctaaattaaaaggtgttcgtgaccccgaacagaaaagaaaaatcatcggccatgaatttatccgggtttttgaagaagaagcggccaaacttggagatatccgttttctcgtccaggggactttatatccggatgtggtggaaagcggtaccgccaccgctgctaccattaaatcccaccacaatgtgggtggtttaccggaagatatgaagtttcagcttatcgagcctttaaagtggctgtttaaagatgaagtccgggaattaggccttgagctggggcttccggaaagtatagtctggcgccatcctttcccgggaccgggacttgcggtccgggtgttaggggagataaccgaagagaaacttgccatactaagggaggcagattacatttttatagatgaattaaagaaatccggctggtaccggaaaacctggcaggcctttgcggtgctgccgaatctccagtccgtgggggttatgggggacgaaaggacctatgcctataccatagcgttgcgagcggtgaccagcgaagatggcatgactgccgactgggtccggttgccttatgagttgctggaaaaaatctctgcccgcatcgtaggtgaagttaaaggagtaaaccgggtagtgtatgatatcaccagcaaaccccctgctactattgaatgggagtagtaggggtttactttttcataattttataggaggtgtttacaatgcacaaagttgcggtggttatgggaagcgactccgactgggagattgtaaaaaaggcggtagaggttttaaaagagtttggggtggagtatgaagttaaggtggcatcggcccaccgaactccggataaagctttaaattttgcccggacggcccgggaaaaaggttttggcgttataattgccgcggcggggatggcggcccacttgccgggagtgctggcagcggtgaccacgttaccggtgataggtttaccgattaaagcttccatagagggaattgacagcttactatccattgcccagatgccacccggcgttccggtggcaacggtagggataaatgcggctaaaaatgccgggcttttagcggtgcaaattctaagcttaaatgacaaaaaccttgcgggaaaacttcaagcttataaagaaaagctggcccgggaagtggaagaaaaggagcaaaaacttttagaaaaattgttttagttcattttggaggtgtttttgatgatagcccgttatactttaccggaaatgaaaaaactctggtcggatgaaaccaagtaccaaaactggctaaaagttgaaattgcggtagcggaagcgatgggagagcttgggttgataccgcttgaggcggcaaaagttattaaagaaaaggccaactttgatgtagaccggatcctggaaattgaaaaaaccgtgaaacacgatgtgattgcttttctaaccaatgtggcggagtatgtgggagaggaaagtaagtacattcataaaggtttaacctcttccgatgttctggatactgctctggccctgcagttaaaagaagcgggagagctattacttagaaagcttgaaggaatttatcagcgtttgctggagcttgcgaataagcaccgctatacggtgatgattggccggacccacggggttcatgccgaaccgattacctttggtttaaaaatgcttttgtgggcggcggaaatcgaaagagacatggagcggctaaaaacggcaattaaaacggtaagcgtgggcaagatttcgggagcggtgggaacctatgccaatgtgcctccggaagtggaaaaacgggtttgtgaaaaattgggtttaactcccgagaaagtttccacccagattatccagagggaccggcatgccgagtttgtcttaaccctggctttaatcgctaccacttttgataaatttgccaccgaaatccgaacactacagcggaccgaaatcttggagctggaggagccgtttaccgaagggcaaaaaggttcttcggcaatgccccataaaagaaatccggtattatgcgagcggatttccgggcttgcccgggtagtgagaagctatgtggtggcggcgctggaaaatgtcgttctctggcaggagcgggatatcagccactcgtcggcggagcgaatgattttacccgatgcaacttccaccctttactacatgatgcacgtttttcgcgaagttatcgataacctaaatatctatccggaacggatggaaaggaatttaaaccttaccggcggtttgattttttcccagagggtgcttttggctttggtggaaaaaggaatattacgggaaaccgcttataaaattgtgcagcggaatgcgatgaccgcctggaaaacgggcaaaagctttaaggagctgttactttccgatgaagagttaaccaaactgttaacactcgaagagatcgccgagttatttgattataattaccacttaaaatacgtggatgaaatctttaaaagatttggtttataggggaggtatgaaaatggagaaaaagtttctttatgaaggtaaggccaaaattgtttatgccaccgaaaatcccgatgaagtggtagtgtactacaaagatgcggctaccgcctttgacggtaagaaaaaaggagagatagaaaataagggctacttaaatgctcaaatttccgcttatatttttaagtatttagaaaagcagggtattaaaacccattttcttgaattagttggggagcgggaacagcgggtcaaaaggctttccattattccggtggaagtggtcgttcgcaatattgctgcgggctccctttccaaacggctggggcttccggaagggactgatttaccttttccggtggtggagctttactacaaaaacgatgaattaggagacccgatgatcaaccattatcacgtgcaggcgttaaatctggctaccccggaggaaataaaatatatggaagataccgctttaaaggtcaattctttattaaaggaattttttgactcgcttaatattttgttagttgattttaagctggaatttggaaggtttaaaaaggaaattcttttaggtgacgaaatatcgccggatacgtgccggttctgggataaagatacccgggaaaagctcgataaagaccggtttagaagggatttagggggagtaaccgaagcctatgcggaaattttaaagcgaattaaggagaaagcggaataggagggaaatcatggcgatagcccgtgtaatcgtggaattaaagcccggggttttggaccctcagggggaagcgattaaaaattccttacatgctctcgggtatgaggaagtaaaaaaggtaagggttggcaagtttattaccttagaagttgagggaaatgacttaaaggaaatagaagaaagagttaaggaaatggccgataagcttttagccaatgtggttattgaaaaatttacggtgcaggtggagggttaagatgaagttcggggtggtggtttttccgggctccaattgtgatgccgattgttttcacgtcttaaaaaacgtctttggccgggagacggtgtatatctggcataaagaggataattttgatgttgactgcattgttctgcccggtggcttttcctacggcgattatttgcgggccggggcgattgcccgttttagcccggtgatgaaaaaagtggtagagtttgctaatgccggaggtctggttatcggtatctgtaacggttttcaaatccttttagaagcggggcttttacccggtgccatgcttagaaataaaagcataaatttccggtgccatgatgtttacctgcgggtagaaaacaacaatactccctttaccagtaaagcgcatgagggacaggtgctgaaaattcccattgcccacggggaggggaattactactgcgagccggataccttaaaaaagcttattgccaacggacaggtggtgtttcggtactgtaattcccggggggaagtgaccgaggatgccaatcccaatggttccctttacaatattgcgggaatcattaacgagaaaggtaacgtcctcggtatgatgccccatccggagcgctgctcggagaatatcctgggaggagaggatggcagggtaatctgggaatcgattatcgcgtacttggaaaggggggctaaccgtggctaagtggcgggagatgggcttaaccgacgaagaataccggcgaattgtcgagtatctgggccgcgaaccaaatgaagtggaactgggcatgtgtgcggtgatgtggtcggagcactgcagctataaaagttccaagattcatttaaaaaagcttcccaccaggggtccggcggtggtgcaggggcccggggaaaatgccggagtggtcgatatcggagacggactgggaattgcctttaaaattgaaagccataaccacccgtcagccatcgagccctaccagggagcggcaacgggagtcggggggataatccgggacatctttgccatgggagcgcggccgatagcccttttggattcccttcgctttggcaaacttcactcacccagggttcgccacctttttaccggcgtggtggccgggattgcgggttacggtaactgcatcgggattcctacggtggcgggggatgtttattttcaggaatcgtatgaagaaaatcctctggtaaatgcgatgtgtgtgggcatcgtggagctttccaaactgaaaaaaggtgtagccacgggggtaggcaatcctgttcttttggtaggagcgactaccgggcgcgacgggattcacggagccacctttgcttccgaagagctgtcccaggacggggaggataaacggccttcggtgcaggtgggagacccctttatggaaaagcttttactggaagcatgtctggaagctctggaatacggtcacatcgttggcatgcaggatctgggcgccgccggacttaccagttcttcatcggaaatggccgcccgggggaaatcgggtatccggctctacctggacagggtgcccctccgggaagaggggatgaccccttacgaaattatgctttccgaatcccaggaacggatgcttttagtggtggaaaaagggtatgaggatgaaatcatcaaaatctttaaaaagtgggatttaaatgcggtggtggtgggagaaattaccgatggcgaggaaatcgaggtattttttgacggggaatgcgttgcaaaacttccctaccgcttgctaaccgaggaggctcccgtttacgaccggccttaccggattccggagattaaaaacctgcaaagcataaacccggctggggtggattgcggagaggctctgcgccggcttttacaaagccccaatattgccaggaaaagttatgtgtacgaacagtacgaccaccaggtaggggttaatacggtagtgaaacccggttactccgatgccgcagttttaagaatcaagggtacgaaaaagggcattgccgtaaaaaccgacggcaacggccgctatgtttaccataatccccgggaaggggccaaacgggcggtactggagacggctttaaatttggcggttaccggggcaaaacctctgggtcttaccaactgcttgaactttggcaacccggaaaagccggaaattatggggcagtttgtggaagtaattgcggggatgaaggaagcgtgtgaaattttaaatattcccgtaaccggcggcaacgttagcttttacaacgaaaccggtgaaaaagctatttaccctacaccggttatcgggatggtgggtttaattgacgatttggaaacgggacttattcccatggcttttcagaccgagggagatttaatttacctcctgggtgaacccaccggggagctcgggcaaagcgagtttttaaaggagttttttggggacgttctggttccggtaccaccggtggaccttcaggaagggagaaggataatcgagcttttacccttgttaaaaaagcaaggactcattaactctgctcatgatgttagcgatggcggtttggcggtttccctttgtgaggcagcctttgccggggagctgggggtaaacatcgattttaccacttcccttctgccgcaggagtttcttttttcggaaaaagttggcctggtaatagtatcggtatctccggaaaaagaagaggagtttataaagtcagtaaaaaatgccggggtttttgttttaaagcttggccgggtgaacgggaaggatgagatagaaatttgcctaaacggtcagagggtcatccaagaaaagctatcggagttaaaagccttgtatgaggggggcctaagttgggctttgaaataagagaagagtgcggggtgtttggaatttatgccccggggcatgatgtggcccggcttacctactggggactttttgccctgcagcaccgggggcaggaaagcgcgggaattgcggtaggcgatggcagggatataaaccttcacaagggcatggggctggtggcggaagtttttagcgaggagaaattagacgggttaaaaggatttgtggccgccggacatgtacgctattcgaccaccggggccagcgtgcccataaatgcccagccgttggtatttcattataagttgggaaaaattgctttaggacataacggcaatctcgccaacgttttggagttaaagaaaaatcttctgtcccggggggcaatttttcagaccactaccgacagcgaagtgattttaaatgttattgcccagtacgcccagacggatttggtggaaggtattttaaaggcgatggtggatttaaagggagcgtattctttggtgattatgaccgagaaccaattaataggggtgcgcgatccctggggttttaggcctttggttttggggagattttacaacggttatgttttagcttccgagtcggcagcccttgataccattggcgctgagcttattcgggatgtggagccgggggaaattatcgtaattgacgaaaacggccttaaaagttataaattcctgcagggcatgaagcattccttttgcatttttgaattcatctattttgcccgaccggacagcattattaatggctatcatgtaaacaccgttcgccggaaaatgggacaggttttggccaaggaatacccggtaaaggcggatttggtggtgccggtgccggattcgggtaccgccgcagcccgggggtatgcggaggcatcggggatacctctggaagaggggttaatgaaaaatcgttatgccggccgcacttttatccggccgagccaaagagaacgggaaattggcgtgaagttaaagctaaaccctatccgggaggttttaaaggacaaaaagattgtggttattgatgattcgattgtccgggggacgaccagcaagcagattatcgagcttttaagagatgccggggccagggaaattcatttattgttaagttcgccgccgtttatacgctcctgttactacggtattgatatttcccgtgacgatgaattaattgcggcaaaatattcggttgaggaaataaaaaactatcttggggccgacggactttattatttgtctttagaaggcttacttgggatttttaaggaacgggatttttgtcttgcttgctttaccggggattacccggtaccgataaattaatggtgggggtaagaccatggaggagttaacgtataaagctgccggggtcgatatcgatgccggcatggatgtggtccggcgcattaaatcggaagtggagaaaactttaaacccaaatgttctggccggcattggcggtttttccgccctttattgtttggatgttacgggatataacgagccggttttagtttcatcgaccgatggggtgggaacaaagcttaagatagctcaggcactgggaaaatacgacaccataggcattgatttggtagcgatggtggttaacgatttactcactgtgggagctaaaccgctgtttttcctggattacgttgcggtgggcaagctaaatccggaacaggtggccgacttggtgaagggaatggcggaaggctgccttgaggcagactgcgccctggttgggggagaaacggcggaaatgcccggggtttaccatcccggagattttgatattgccggctttggtgtgggggttgtggaaaaaagcaagataatcgatggaagttccgttaaagccggtgatgttataattggcgttgcttcctcggggatccacagtaacggtttaagtcttgcccgaaaggctctcttggagtacggtaactatcatcttaccgcttatgtcgaggagtttgggaaaaccctgggggaagaacttttaactcctacccggatttatgtaaagccagtacttgatttaatgcaaaaggtggagataaaaggtatggcccatattaccggcggcgggattgtagataatcttccccggattttaccggaaaaggtagaggcgcggataaccgtgaactgggaaataccaaaaatttttaagttaattgaaaaggccgggaatgtgccgcgaagggaaatgtggcggacatttaacatgggcattggttttattttaatcgtggaggaggcaaaggttcaggaagcaattaaaacgttagagagttttaattataaggcatgggtaattggagaaattaccgcgggggaacgcagggtgattattaatgaatagggaggaagaaaatgttaaacttaggggttttggcttcgggacgggggagtaactttcaggcgattattgatgcgattgcgtggggagttttgccggcaaaaattaaagtgctggtgaccgataatcctgaagcttacgctatcgaacgggccaggcgggcaggtataccctggcattactttgacccgaaaggttttaaaaataaagaggaatacgaaaaggagatagtgaaaaccttactttcctatgaagttgatacggtgtgtcttgcgggctacatgcgcttaattggcaaacctttactttcttcttttcccatgaggattattaatatccatccggcgctgctaccggcgttccccgggcttcatgcccaaaagcaggctcttgattacggggtgaaaattgccggctgtaccgtgcattttgtcgatgaggggatggataccggccccattattttgcaggcagcggttccggtgtacgatgacgacagtgaggaaagcttaagtgagcggatcttagaacaggaacaccgaattttggtagaggcgcttaggcttttaagtgaaaaccgcttattggtagaaggacggcgggtaagaatcttgccggacgggggtgaaggacatgggaagtaagcgggctttaatttccgtttacgataaaaagggtatagtggaatttgccgggaaattagtagatttaggctttgaaataatttctaccgggggaagttataaagttttaaaagaggccggtatcccggttacgtatataagtgatattaccggttttccggaaattttagaaggacgggtaaagactttgcatccggcaattcacgggggtatcctggccaaaagaacggaggagcatttaaaggaaatttcagcccagggtataaagcctattgatttggtgatagtaaacctgtatccattccgggaaacggtagcgcggggagctgatcgtgacgaaatcattgaaaatattgacataggtggccccactttaatccgggcagcagccaaaaaccaccggtacgttacggtggtggtcgatccggaagattatgcggaagtggccgaacatctgaaaaagggagaggtgccgcctgaggtcagggaaaggttagctttaaaagcgttccgccatactgccagttacgacattgctattgccaattattttgcgggaaggttagaggatggtggttttcggaaaaaattatatattgaagcggaacaggtggaaatgctgcggtacggagaaaatccccaccagcggggagcggtttaccgggtggaggggacttttggactggttgatgcggaaattttaaacggtaaagccatgagctttaataattaccttgatgccgatgcagcgtaccggttaatctgggagtttcgtgagccggcggcagccataatcaagcacaccgtaccctgcggtgtggctaccggggaaaatttaaaggaagcttacgaaaaagcgtatgccggtgatccggtgtcggcttacgggggaattgttgcttttaacggtgcggttgatgaaaaggtggctgagcttttggttcagcatttttacgaggtaataattgctccggacttttccgatgaagccttaaaaatcttgcgggaaaagaagaatttacgggttataaaggcaaaaccgcttgctttagaggaacttaatttaaggcaaattagcggaggactgttgcttcaggaaaatgatgggaagctttatgaagaattaaaggtggtagcgggtaatgatttaaccgaagggcaaagggaagatatagtttttggtttaaaagtagtgaaatacgttaaatccaatgccatagctgtggtaaaggacgggatgcttttaggagctggcggtgggcagaccagccggattgatgcggtaaaaattgcattaaataaagccggggaaagagcccggggagcggtggtggtttccgatgccttcttcccctttgccgattccatcgaggaactggccaaagcgggggtttcggtggtagtagagccgggaggagcggtgcgcgaccgggaagtaatcgaagaagcggcaaaaagaaatgtaactctcgtttttacgggagtaaggcatttcttacattaggagggttagtggatgaaggttctggtagtgggaagtggcggccgggagcatgctatagtaaaaaaacttaaggaaagtccaaaagttacggaggtattggccgctccgggtaatgccggcattgcccgggaggctcgggtggtgccggtggaagtggataacctgtccgggcttttggaaattgccctgcgggagaaagtggatttaacggtggtgggacccgagcttcccttaaccctggggattgtcgattattttaacgaacatggtcttttagtctttggcccaggccgggatgcggcccaaattgagggcagtaaaagttttgccaaggaactgatgcgggaaaacggtattcctacggctttttatgaaacttttaccgattataacgaagccagggagtacgtttaccggaaaggggtgccgatagtcattaaagccgacggcctggcggcgggtaaaggggtttacgtttgccaggagttggaggaagcgataaaagctttaaacgatattttcgttaagcggatttttggggctgcgggaaataaagtggtcattgaagaatatctcgaggggcaagaggttagcgtcctcgcttttaccgatggggaaacggtggtgcaaatggtgccggcacaggaccataaaagggtgtttaacaacgaccagggacccaataccgggggaatgggagcctatgccccggctcccgtatatactccggaaattgccgaaagggtccagcgggaaatcctgctgcccacattaaaggggcttaaagggaaaggaataacctaccggggagttttgtatgcggggcttatcttaacccgggaggggccaaaagttttggagtttaatgcccgctttggtgatcccgaaacccaggttatcctgcccctgttaaaaaccgatttggtagagattatgctggcggtggtggaaaaaaggctttccgagataaacatcgaatttctgcccaaggcctgtgccacggtagtattggcctccggcgggtatcccggaaaatacgaaaccggcaaagttatccatggtcttgaccggttaccgccgggggtggtggcgtatcatgccggaaccgctttcaatggggatgatattgttaccgccggtggccgggtattaaatataacggcggtaggggataccctcaaggcggccgtagaacttgcctatgaaggagttaaggccgtatcctttgaagggatgcactaccgcaccgatattggccaaaaagctttgaaattacaatagggctgttattcaattcgataagtacttacttcttccgaagccataggtataacctctatggcttctttatttttcggattatttatcctgtaaaaagttacagtaactttctgctccttggggcaatcggcatagcgggcggttatccgggctgctgttttaagcgctacataggaaatatcatttccggttaacactgccaggggacccttaaaattttgcacccgcattaaaatgtcactatctttagccgatgcttttaaagcttcgttttcctcgtggttgcggccgactatgagttttgctccgtgacttagcctaaactggcggccgatatttagccttttgatttctcttaaatcgtactgaccgtggttgattaaatccttcagcttttttccgtattccacctgggttaaaaggcaacccccggctggggaaggataattttggattcccagttctctggctaaagccatctggggcttgcggttacggccggaaaaatccaaaagtttttcccggtcgattatccccaagcgttccggcaaagtggggggaaggtttttggcggtaagcggccgtaccaagatatcttctactcccgcttctcttgcggtttgttgcatcgagtggcgcatctgggattttggcctttgacccagcacttcaccgcttattaaaaaagaagcgttgtatttgggcaaaagttctttggctttttttaacatgaaggcccggcagtcaatgcacgggttcatcgcttttccgtaaccgtattttggttttaaaattatttccaaataatcgtcgcccagcggttctaaaattagcggtactcccaattctttggctttctctttgatatattcggtttttacttctgaaacgaaaggatttataaaatgaagagcggtaacatcggcaccggctctttgggaaacttttatagccagaatactgtcaagaccgccggaaaagagagctaaggctcgattgttcatggtcaaagcctcctttaaaaacttcatttaataatataccgtagtttttcttgaaaaaaaagagcggcttaatttaaagtagagccgctctttttaaggacgccttcttttgtcaaaaacaatccggtaattagctaattcctggtcagtagcttttaaaacattaacccgttttactacggaatcgttccaaatccttaccgaaactgaggcctcaggagtatcggcatagcgggcggtgactttggctgcaaggtaaaaatcgtcttccgttggattgccttgaattaaagtagttggtccggtaaaaccttctaccttggcgaggaattctccgggttttttaaaatacgaaatcaattcgttttcctgggcatttcttcccacgataattttggcggtgggggaaaggcgaaaatgacgcccaaattttaaacgatcaatatcttctaccgttagcttaccgttgtaacgaattaaatcctgcactttgccggcaaattcttttttggttaaaaggcatcctcccgaggggcagggataatcgtttatcccaaaacttgcggcaagttccatctgggttttccgggagcgaccggaaatagctaaaagtttatcccgggaaacgtatccttcttgctcggcaatcgttgggggaaagtgcagggccgaaaggggccggagaaccaaacccttaattcccgcttcccggtcgattaaatttatcgcatcccgtcgctgcgaattaggccgctgccctaaaacctcgccggtaatcataaatttggcgccgatttcttccataagtttctttgcttttttaaatttgaagatccggcagtcaatgcaaggatttaaagcgctgccgtagccgtggggtgggttttccacgattcttaaatattcttcaccgcagttttgcacatgaagctttatacctaaatcggctgcgagtttagcggtggaagcacatccctggcctttagctaaacaacggcaaaaagggctggtaaaattaaccgcttctacttctacaccttgttccagaataagctttatggctaaagtgctgtcaaggcctcccgaaaagagtgccagagccttcaccattttattcacctccctaaacgcttcctttagggacggttctgtccgagtgctattattacgtataataggaatagcacgttctaagaaccgtccctctaaggtgtgttgattactgactgtagtacaagaaaagtataacgaaaaagttaacagaagacaaccgaaaattgttgacaagaatattttagtatattaaagtattaaaataagaaaagttgcgggggggttctatgtttaagtatgagggaaaattacgggacccggcgtttgacagtttgtttgaggcaatacttgccctgaaaaatattgatgaatgttatgctttttttgaagatatctgcactattgcggaattaaaagctttggcccagcgctgggaagtggcgaaaatgctggatgagggaagaacctatcaggaaattgtccaaaaaaccggagcaagtaccgctaccattagccgggttaaaagatatttaaattacggcgcttccggttaccggctgatgcttaaacgcttaaaggaagaagggaaattatgagggaaaactttaaggaactaccaatgggagtaagagattatctacccggggaagcagcgttacggagatacctggaaaacttgtttgtagagctggtggccaaggaaggctttcaagaggttataactccttcctttgagtattatgaaactttgcgggaatcatcggagaccgatttaattaaatttgtggaccgtacgggagagcttttggccctcaggggagatatgaccacccccattgcccgggtggtttctaccaaaatgaagcatcgggagttaccccttaaaattttttatgcggcaacggttttttccgggaatttttccggaagaaacaaacttagagagtttaaacaactggggattgaagtgtttggggatattacttcaaaattagaatcagacttaataaaactaatggctgtgtatttgcgtaaagccaaggtgaaaaacctggaaatttctctgggacatgtggatattttaacggggcttattgaagaatacgaactttttaaccatttttcggaaataaaaaatgctttaaatcaaaaagattacgtagctttggagggaatttttgagagggcgggaaaaagtcaaagggtccgggaaagtctggtggattttttacagcagcggggaggtaaagcaatcctaagaaaggcaaagaaaatgttaagccatccgaaagccaaaaaagccttagaagaactggaggaggttaccgaatacctaatttctgagggagtaagggaattaaagctggatttttctttggtcagggatttaaactattacaccggtttggtgtttgaagcttacaccccttatttaggctatcctttggggggtggagggcgttacgatacccttttaaaaaaatttggctgggatacaccggcttttggttttgccctggggttggaaagaattgttgaaagtattgccaatagtattgacaaataatttttttaaccttatgattttagtatattaataatttaacactttaacaaaataaagtgaggctataaaaatgaaaaatggtttaacttttgccctgcctaaagggacattatttcccgatacggtgcgccttctctataaagcgggttttttaaaaaaggaagaggtccttttggaaagtcgaaaactcgtaattaaagatggcccatatacttttattatctgccggccgaccgatatccccacttttgtggagcatggagcggccgacctgggtattgtgggtaaggatgtaattgaagagcagcgacgggaaatttttgaacttttggatttaaaatacggaaaatgccattttgccgtggcggcacccagggataaccctaaagtgcacgatttgggaaagcttacggaagtcagggcggccagcaaatttcccgaagtaacccgacggttttttaaaggtcttggggtgcgggcggaggttatcaaaatgcacgggaatgtagagctggctccgctggtgggtcttgctgatgtaattgtggacctggtttctaccggaagaactttaagggaaaataacttaattgaaataacgaagataatggatataaccgcaaggttggttgccaaccgggtagccgccagggtttatgaccgggaaataaaagcaattgtaaaaaagttcaagaatttagttgggggcgaaaaaaatgaagttaatcttaaataaagaagaacttttagataaatattcccggcgcaaagcagtggaggaagatatagagcaacaggtacgaaaaattcttaatgaagtggcaagttcgggggatgaagcgttaatcgagtacgcccgggagtttgatggttttaagggggatttaagcaatcttaaagtaagcgaagaggaaatagataaagcttacagggaagtggacgatgggtttttaaatagtcttcgcaaagcaattcaaagggtttttgattttcaccaaaagcaacttccccggagctggtttaccacggaagaaaacggaaatatcctgggacaaatttatactcccgtggaggttgccgggatttacgtaccgggcggtactgcagcctatccttcgtcggtggtgatgaatgccgtaccggcaaaagttgccggggtaaaaagaattgtgatggtttcgccccaaaaaggcgagcggatgaatccttatgttttggttgccgcccgggaagccggggtgacggaaatttaccgggttggcggagcgcacgccatagctgccctggcttttggcaccaaaaccatccccagggtagatgtaattaccggaccgggcaatatttatgtgaccatcgccaaaaagctcgtttacggcacggtcaatatcgatatgctggcaggccccagtgaggtggtggttatcgccgatagctcggcaaagcccgagtatcttgccgcggatatgttatcccaggcggaacatgattccctggcttcgggggtggttattacctgggatggggagctggcccgaaagacagcgcaaaaagtggaggagtatttaaagctcctaccccgccgggagataattttaaaagctttggaaaattgcggaggaattgtggtggtggacgatgaagaggaagctttacagcttgccaaccagctggctccggagcatttggagttaatgctccccaatcctttcggctatttagctaaagtaaaaaatgccggagcggtttttttgggacagtttagtcctgaacccatgggggattatttggccggacccaatcacgttttgcccacttccggaactagccgcttttattcgcccctgtcggtggataatttcttaaagaaaagtagcgtaatttattattcccaagaaggttttttggccgatgccagggatgttattaaacttgccgaaacggaagggctatttgcccacgccctttcggtgaaagtgaggatttccaatgaataagccgagatattttaaagaagcctttgcccagctaaagccctacgaacctcatctggtttcctatgaaattaaacttgatgccaatgaaaacccgtatctttttccaaaaagtttactggaagaaatcttctccaaaattgggacaagggattttcccctttatcccgatcccttggctgggaggcttcgtattagactctcggaaaagcttggggttttgccggaaaatatagttttaggaaatggttccgatgagttgattctttgcctttatttagcctttgggggatacgggaggattgccttaagtttttctccttcctttgtgatgtatcgacaccatgcttttgtaacccaaacggaatttttcgaagtttcgtaccgggatgattttagccttgatctggatgaaacgaaaaaagccattgaaaagtatcaaccccatttagtgtttctggccaatcccaataacccgacgggaaccctggtggatatagaaacgattaaaaagcttttagcttacgaccatttgctggtagtggatgaggcgtacgtggaattttcgggagtttcggcgatagatttattaaaaaaatatcaaaaccttgttattttgcggaccttttccaaagcccgggctctggccggcttaaggttgggatatttagttgccagcgttgatgtggtaaaggaaattatcaaggtaaaaaatccctataatgtaaatgttttttcccagattgccggggaagtggttttggccaacgaagaagtttttcaaggggaaattaaagaaatcgtagccgaaagggaaaggctttataaccagttagcttctttgggtttaaagccggtgaaaagccacgctaattttatactggtggaattcggggaaaaggcaaaaaagattcaccaggagttaattaaccacggaattttagtgcggtacttgggaggagcccttgctaattatttacggataaccgttggtacaccggaagaaaaccggcaacttttaaagaaactgggggaaatcttatgaggcgggccgaggtacaacgaacaacattagaaaccatgattaatgtggagtttacaatggacggaaacggggagttttccggaacttcaggccttgggttttttgaccacatgctcaccctgttttgtaaatttggcgggtttaatttaaatctttcctgccagggagacctggaggtagatgaccaccacacggtggaagatattggtctggttttgggggaagcgttttctaaagctttaggggataaaaagggaattgcccgctttgcctcgggtttttatccgatggatgaagcattaatgctgatagcggttgatatttccggacggccgtatcttgcctttgaagctgactttccgccggttttggcaggaaagtttaactaccagatggtagaagagtttttacgcgggtttgtgcaaaaagccgggattacgttgcatgtccgggaaatttcgggcaaaaacttacaccataaagccgaggcaatttttaaaggcttgggacgtaccttaaaagttgcggtttccgtccagggggatgaattaccctcaaccaaaggagtgatttagaaagtgacggttgtggtagattacgaaatgggtaatcttttaagtgtgaccaaggctttagaagaactgggatataaaccttccgttacttcggatcccaggaaaattttggaggaggatttggtggttttacccggggttggggcgttcagggatgcggtgaggaatttaaaggaaaaggggctttttttggctttaaaagaacgggcttccttaaaccggccaatcctggggatttgtctggggatgcagcttttttttacgaaaagctatgaagatggcgagtatgagggtttggaccttattcccggggaagtggttcgttttcaaaaagctcccaaaattccccacatggggtggaataacttggtaccggtagacacgacccatgaactttttaagaatttaccggattattatgtttattttgtccactcctactatgcccagaccgactccaggtatgttttagcttataccgaatacggggaaaagtttccggcggcggtaaggcggggcagtattattggctttcagtttcatccggaaaaaagcggaccggtgggaaggcagatacttaagaatttgagggagatgctatgattttaataccagcaatagatttaatggggaaaaaagtggtgcggcttacgcagggggaaaaagagcggaaaaccgaatacccgatttcgcccgtggagctggccttaaagtatcaggaagcgggagccaggctaattcatgtcgtggatttggatcgtgcttttaccggggaaagtgaaaattttgaagtcattgccgaaattattaaaaatgtttccataccggtacaggtcggtggaggcataagagatattgaaagttttcgggagttaatagacttaggagtttcccgggttattgtagggacgatagcggtaaccaatccggagcttttagaggagatgcttacccttgaccgggataaggttgcggtcgggattgatgccaaaaacggctgggtagcaattaaaggctgggtggaaagttccaattaccgggctttggacctggcctataaggttaaggaaatgggagttaccacaataatttataccgacattgcccgggacgggagtttaaccgggcccaattttaatgaaactttaaagcttgccattgataccggtttaaaggtaatagcctcgggtggtatttctggtttagaggatttaagacgctggcgggaactcggggaaaacaaaatctacggggttattgccggaaaagcaatattagaaggtaaaattgatttaaaagaagggattaggatactggaaggggagtcttaatgttaacggtgcggataattccctgcctggatgtgaataaagggcgggtggtaaaaggggtaaatttcttaaaccttgtggatgccggagacccggttgagcttgccgctttttacgaccgggaaggtgccgatgaggtggtatttttggatattactgcttcctttgaggggcgacaaaccatggtggaagtggccaagcggacggctacaaccctttccatcccctttaccattggcggaggtataagaaatattgatgatatccgagcccttttggcttccggggcggataaagtatcgattaattcggcggcggtaaaaaatcccgaacttgtccgggaagcggctttaaagtttggcagccagtgtattgtggtggctatcgatgccaaaagaaaaaaagatggtggctttgaagtttatatccacggtgggcgtactcccaccggaatagatgcggtagaatgggctaaggaagtggagagactcggggccggagaaatcttacttaccagtatggatagagatggaacgaaagatggctatgacctcgaacttacccgggaaattgccgatgcggtgaaaattccggtaattgcctcggggggtgtgggagagctttcccatttttacgaaggagtggttttggggcacgcttcggctcttttggcagcttcggtgtttcactttggtaaatttaccattaaagaagtaaagaggtacttaaaagagcgggggataccggtccgattgggggataccgaaaatggaacttaagtttgacgaaaaaggcttgattccggcggtggtacaggatattgataccagagaagttttaatggtagcttacatgaatgaagaaagcgtaaaaaaatccctggagaccggtcaaacctggttttacagccgctcccgtaacgctttatggcataaaggggagacgtccggcaatacccaggaaattgtggagatccggtatgattgtgatgccgactgcttattaataaaagtaaggcaaaagggggtagcgtgtcataccggaaattacagctgtttttaccgaaccctctgggaaggaaaaggcgagagagaagatttaaacgaggttttggccaaactctggcagattatccttgaccggaaacaaaagctgccggaaggttcttatacggcaaaattatttcaaaaaggaatagataaaattgcccagaaggtgggcgaagaagcggtagaaacggttatagcctctaaaaatgatgataaaggagaattaatttacgaagccgctgatttggtttatcatctactggtattactggcggcaaaggacgttgctctcggcgatattgcggaggaactaaaaaaacgttttaaataagtatttaaatttgatggcgcactccggtgcgcttttaaatttttaccgaccacctaacacctacgacctaccacttttttattgacaggaaaatttgtcctatgttaaactactttcaagatatatttaaatatttaaatataaatttggagggagtttattggagaagcttgttaatattttaaaagctttagctgacgctcatcgacttaggctttttttggagttaaccaaacgagaaatgggggtgtgtgaggcaatttctcttttgggtttatcccaaccagcggtttcgcaccatttaaaagttttaaagcaagccgggcttattaaaaacgaaaaacaggggaaaattattttttattatgctactcctgaggcggtgcaacttttggaaaaggaactgggaggatttttggggaagattcgaaaattactggaaactccggtaaaaccttcaccccttcgggaacaaccggatttatgcgaatttttaggatttaaaaaagaagtctgtgaggaaggagaggagttatgagccaaacttctgctaaattatcgtttgtagaccggtatttaaccgtctggattttactggcaatggttttgggtgttgccattggttatttctttcccgggattgctgggcttttagaccgcttgagcattgataccacttccatacccattgctattggccttatctggatgatgtatccgccgctggccaaagtgcggtatgaagaagttaataaaattttccggggtggcagcaaaattttcctattttccatcctgcaaaactggattatcgggccggttttaatgtttattttggcctatattttcttaagaaactatcccgagtatttcatgggattagttttaatcggccttgcccggtgtatcgccatggttattctctggaatgctctggccaaaggagacgctgagtatgcagcagcacttgttgcgctaaattccctctttcaggtatttttctactcaacttatgcttatttctttatcaaagtggttccgggctggcttggttatgataccaagggggttgtccttgacatttccatggcggaaatcgctaagagtgtttttatctaccttggtattccttttttagccggagtaattacccggttttctcttttgaaatccaaagggcgggaatggtatgaaacaaagtttatccccaaattaagtcctaccgctttatatgcgttactttttaccattgtcgtgatgttttctttaaagggtcagtacattgtgaaacttccgttggatgtggttagggtagctattcctttaattgcttactttgtattaatgttctttatttccttttacatttcggccaaggctggttttggttatgcccggaccgctacattatcgttcactgctgccagtaacaattttgagctggcgatagcggtggctgtggctacctttgggttaaattccgggcaggcgtttgcggcggttatcggtcccctcattgaagtgccggttatgctctggctggttaacatggccttaaaattaaaagataaatattttggcgaaggtgaacagtattatgagtggttttaaagtcctgcggttgagggggagattgttctccgtttaccgggggttctaataaactccagtacgacgaaggaaggaaccataaccaatgattcttttattgatggttattgaatttacctgtggttctttgatgttttcctactggttaggagttatggttggcaaaaaattagaagatgttagggatggaaatccgggagcttttaatctttggtatgccgctggatttaaagtgggtattttgggtgctattttggattttttgaagggatattttccccttgtttattttattaaaaaagaatatcttataaatggaatagctctgatttttgtggcaatagcacctgttttaggccatgctttttctccctttttaagatttaaaggagggaaagctatggccgttacttttggtgtatggagcgcagttacggactttaaggcttcatttttttacgcagttgtactggggattttaaaagctcttgaaagaatttatttttggggtagcccatctttacctgaaagggacgcaatgcttgatatcgttggttttaccattttaatgttttttttaattggaaatggttttgaaaaattgcttttactctgggtatttaattttcttgttttactttataaaagacgaagggatttcaagattttgctgaaaaaaaggggaaatttcctgtttaaataaacaagtgaaaaattttagtcacagaaaaaataaaatatggtataattaaaaaaagtaaattaattaaatcaataggcggggtggagatggaaaagaaaagtactattgctttaattgtggtatttgtcattgcccttttagcctttggagtgtattacgctactaaccgggaattaggctcgccggctaatagcggcaatgtaattgatcagtacaatgaggctttaaaaaaccatgaaccttttttattagagttttccggggcaacctgacctacctgtgcgcaaatggcaccggtggtgcaggaattaaagaaagaatacgaaggacggatgcgggtaattgtagcggaagttagtcgtcaggatagccaacagttagcagcaaaatttggtatccagtacgtcccaacgtttattgtagttgatcaaaacgggaatattgtcccctggactgatgcccagggcaatcaaatgccgatgtttgttggcgggcttactaaggaagagttaaaagcccagatggataaagtggctttaaaggaaaaaaaaacccctgaattaaatgattcggggaagaaaaaatcttttgcccaaacgcttgcggataagcttccagggttactgggggattcaaagcttttagcgctttttgttgtttttcttggggggattgctaccagttttaccccttgtatcttaggtatgattccgcttattatcggttacaccggtggttatgccgggcggtcaccggccaaaggatttatttactcgctattttttgtcctgggtcttgctacgactcttacccttttgggagttggaattggggttttaggaacttttatcaaaagccggttatttgcttttaattttattctggggatagtggccattttaatgggatttgcggtgatgggcttttatacgataaatcttcctggcttaaaaaggatgccggttaagggcaccggacttttttcttcgtatttaatgggcttgttctttggcttatccgccagcccctgtgccacgccggttttaattgttattgtaacttatgcgctggctaaagcatcgcctttatttggcggagcgctcctgttttcctacagttttggccatggcctacccttaatcttagccggtaccttttctgcctttttgggtaagattacttccttaggacggtacggggaaataattaattatatttttggcgggatacttgtgttgtatgggttgtaccttttgtttggaagattattatagcaaaataagttcaaaaaggccggaatggaaatccggccttttatgttttaggggtaggaaaacttattggttggcgtgctctaaaataattttttccagttctgctttggaggggacccttccggataaaacgactttttcgttaatgaccaggcccggcgtggacattactccgtatttcatgatttcgggaatgtcctggactttttgaacattggcatcaatgtttaattcggctaaagcattaaaaaccattctttctaacttttcgcagttagcacagcccatacctaaaactttaatatccataaaaatgcctccttttggtaaattttaattaaaaaatagcattaaataagtagccggttaataaaatcccaaaaccaacaattcctacaaaggttgccaggagcttaggctttaaaactttgcgtaaaataatcatttccggaagacttagtgccgttaccgacatcataaaggctaaaactgtacctaaggcaactcctttttcaaaaaggacttttacaatagggattaccccggcggcgttggaataaagggggataccaagtactactgcaaagggtactgcccaaagctgaccacgacctgcgtatttaacaaaaaagtcggtaggtacatatccgtgcataaagccgccaatggcaatggcaatcaaaacatacggccagacttttttaagaatgtctttggtagcaaatttggcaaactccactctttgggcaaaattcataccctgagtagatgcagcctgctcacccattttaatctggtaaacgtaatcttccacccagtgttctaacttaagttttccaatgattatacctgaaattatggcaattactaagccggaagcaacgtaaattaatgccactttaactccaaacattcctaaaagcatgaccaaagctacttcattgaccattggggctgaaacaagataggaaaaggtaactcctaaaggtacacctgcttcgacaaaaccgataaacaggggaacggcggagcaggagcaaaaaggcgtaacggtaccaaacaaggcagcaagaatattacccaaaaaaccaaacctgccgcttaagactttccgtgttttttccggggtgatgtacgagcgaaggtaggaaacgacgaaaataattacagcaagtaaaagaaaaatctttatggtatcgtaaataaaaaagtgtactgcttcgcccagcgcgcttcctttttcaagaccaaaaagccggtaggttacaagatcagcaaaggaattaagcattaaaatcctctccctttaaaaggttttcgctttcttttttggtttcttcaatgacgatatcttttaataaatccaccagttcgacaaatttggggttggtaagacggtaatgaacgtttaatcctacccggcgggagctaacgattcccgctcgctttaaaaccgccaagtgctgggaaatattggactgctctaaggaaaattcttcaataaattcgcagacgcagcgctcgcggtcttttaggtaataaataacctttaatcgggtaggatgggccagagctttaaaaatttcggcaagttccgccagcaaaaagtccatatttaacctcctattcactatattagaattttctaatataataataaactaaaaaacatgcgaaatcaagtacaaacttttagtttttgctgaagggattaccggcagtggcgttgaatggtataatgggatgggaaaaatatcgagtagatggaggatatcgatggagaagctgttagctactttaaacccagctcaaagagaagcggttacccatacccatgggccacttttagttttggccggagcgggaacgggaaaaaccagagttttaaccttccgtatcgctcacttgctttatcggaaaatggcctacccccatgaaattttagccataacttttaccaataaagcggcccgcgaaatgaaagaacgggtagaaaggttaatctcgggaagtgcccgggaaatctggatttctacttttcattcttttgcgttaagaatattacggaatgatattgaaaaacttggttttagccgggattttaccgtttatgatgaggaagaccaattgcaggtaataaaagagtgtttaaaagagctaaatattgacgataaacggtttgctcccaaagctattgcctaccatatttcctcggccaaggacaagcttatttctccccggcagtatagagacgatgccgatgacttatttaaagaaaaagtggcgataatttataatatgtaccaggaaaagcttaataaaaataatgcccttgactttgatgatttactttattatgcggtaagactatttgaaaattatcctcgcgttcttgaatactaccagcggcgatttaaatatattctggtggatgagtatcaggatacaagccatgcccagtaccggctggtaaatcttttagcgcaaaaacaccgcaatctctgtgtggtgggagatcccgaccagagcatttactcttggcggggagcggatattaccaatatcttaaattttgaacgggactatccggaagcaaaagtggtgatcttaaaagaaaattaccgctccacccagaaaatcctcgatgcggctaatgcggtaattgccaaaaaccggatgcgcaaggaaaaagagcttttttctaccaaagaatccggtcatccggtttacttttatcctgcagtggatgaaaaggacgaagcggcgtttgtggctttaaccatcgaatctttggtgaaaagcggcgagtataatttcaatgacatagctcttttgtatcgaacccatgctttatcccggaactttgaagaagcgtttatgcaaagaggcattccgtacgtgatttttggtagcagacgcttttatgatcgcaaggagataaaagacattattgcttatttacggatagtagccaatccttatgataaagtggctttaaaaagaatcattaatgaacccaagcgaggaatcggtgaggcgagttttgccaaagttgaagcttatgccgacgaaactggactacccatagggttattgcttttaagggatgaagctttggctttggtttccggaaaaaccaggaaagctttaaaggaatttggcgaaatgctcctctggtttcgggaattaaaggacagggtaagtgttaccaaacttaccgaagaaattttggagcgttccgggtatctaccggcgttaaaagcggaagataccatggaagcaagggcgagaattgaaaacttaaacgagtttttgactgtaacccaggcttttgaacgggagagcgaagataagtctttagaggcgtttttaggtaccatatccctgttaaccgatgcggatactgaagaaggtggcgaaaaccgggtgcggatgatgaccctccatgccgccaaaggtctggagtttccggtggtttttctggtgggtttagaggaagggatatttcctcacagccgggccattttcagtattgacccccaggaattagaagaagaaagaaggctttgctatgtaggcattacccgggcgcaaaagaggctttatcttacccgggcctggcggcggacggtttacggacggaccgactttaacgagccttcccgctttttagatgaaatacctgaagaattaattgaaagtttattagaaacagtttccggaggtaatccagttgacaaaactctttctccggggggagaaaagcaaaagggggctttttctccgggagatagggtaagccataaaaagtttggagtgggaacggtgctggaagttaaacccaaagagggagatgtaattataaaagtgagatttgaaggtggtgaagtaaaagaacttctgggaagttttgctcctctggtaaaagtctaaggaggtggatgaatggataaggaagctgtcaaaaagcgtatcgaagaacttagggcccttcttcattatcacaactaccggtattatgttttggaccagccggaaataagcgatgccgaatatgaccggatgctccgggagttaatttctttggagcagcagtatcccgagtttatcactcccgattctccatcccagcgggtgggaggggaagttgccaaagaatttcgggaagtggctcatttaaaaccgatgtacagtcttgataacgcctttggaccggaggatttaaaggaatttgaccggagggtccggtcactgttacccgggcaggaggtagagtatgaggtagagttaaaaatcgacggtctggctatatctttggtgtatgaaaacggagttttggtgcgaggagccacccggggtaacggtaccacgggggaagatattacggctaacgttaaaaccattaaagctatacctctaaaattacgaaaccccataccccttttagaagttcggggcgaagcgtacatgcccaaggaatcttttgcccgcttaaatgagcagcgggaagagcggggggagcccttatttgccaatccccggaatgcagcagcagggtcgttacggcagcttgaccccaaagttaccgctgaacgggacttaagtgcttttatgtatgctattggggaagttcagggatacgagcccaaaacccaggcggaattaatggagtggctttcggagcttgggtttaaagtaaatccttaccgggaagtatttaacaatattgatgacgttattaattactgccagagctggcacgaaaagaggttttccctgccctatgttattgatggtttggtaattaaagtaaatagtcttgcccagcaggaagctttggggtttaccgcaaagtctccccggtgggcgattgcttataagtttccagcggaaattgccgagacccggttaaaagatattatcgtacgggttggccgtaccggggttttaacaccgacggctatttttgaaccggtaagcctggctggcactaccgtgacgcgagcatcgctccataacgaagattacatccgggaaaaggatattcggattggcgatatcattagggtgcaaaaagctggcgaaataattccggaagtagtggaagtagtgaaggaaaagaggaccggtgctgagaaggagtttgtcatgcctgatacttgtccggtctgccaggggaaagcggtaagacttcccggggaagcagcctggcggtgtaccaatgcttcctgtcctgctcagttaaaagaaggcatcgtgcattttgcgtcaagaggagctatgaatattgaaggcctgggaccggcggtggccgagctcttattggaagctggcttaattcataattatgccgacctttactacttatctgccgaagaggttgccaggcttccgcggatggggaaaaaatcggccgaaaacctgattaatgctattgaaaaaagtaagcaaaacagtttagaacggcttatttacggccttggaattcggcttgtaggggaaaaagctgcgcgggatttggcagttcattttaaggagcttgacaagttaattgccgccggggaagaggagatcatggcgattccttctgtggggcccaaaatggcggcttcaattaaggcgttttttgcccaaaaggaaaatttagaacttatcgaaaagttaaaagcagcaggagtaaacactaagtacctggccgaggtgcgggataaccgcttagaaggattaacttttgtcttaaccggaaccctttcatccttcacccgcaaagaagcggagcaactcattttaagtctcggcggaaaagtaagttcttccgtttcgaaaaaaaccagttatgtagtggttggcgaagacccgggcagtaaattaaccaaagccaaagagctgggtattccaattttaaccgaagaggagtttcgccagatggtgatgagctaagattttcactattttcttgccaatgtttgttaaatttttgtataatggcaaaaggatattttttaaagggggaactgttatgacaatttccttaaaagatgttgaacatgtggcaatgcttgcccggttaaaattaagtgacgaagaaaaggaaatgtatacaaaacagttgaatgatattttaaaatatgccgagcagttgcaggagcttgataccgaaaacgttaaacccaccgcccacgtgctgcccatcaaaaatgtttttcgggaagataaagttcatcagcatttagatcccgaaaaagccctggccaatgctccggaacgggaagaaaacttctttaaggtgccgaaaattatttaaaggagggtacggttttggaactatattacttaagtgcaaaagaaataacagaaaaaataaaggctaaagagatatcggcggtagaggtggcaaaagctacatttgaccggatagaagcggtagagcccaaaattcaagcttatgtgacggtaacccgggagctgggacttaaaatggcccgggaagtcgatgaaaaaattgcccggggagaagacccggggccgctggcgggggtaccggtggccatcaaagataacatgtctaccgccgggattagaactacttgttcgtccaaaatcctggaaaactacataccgccgtatgacgccactgtggtggaaaagttaaaggaagctggggcggtgtttaccggtaaaaccaatttggacgagtttgccatgggttcctctaccgaaaattcccgctttttccccaccagaaatccctgggacttagaacgggtgcccggtggttcttccggtgggtcggcggcgagtgtggctgctggagaagcggtagtggctctgggttccgataccgggggttccatccgccagcctgctgctttttgcggaatagtgggcttgaaacctacatacggggcggtaagccggtatggtttggtggcttttgccagctccttggatcaaatcggaccttttgcccggacggtggaagatgcggcccttttattaaatgtgattgccggtcacgacccgaaagattcaacctctgccgatattgaatatcctgattacttaagctttttaaatcaggacattaagggcctgaaaattgggctgccgaaggaatattttattgacggtattgatgctggagtgaaaaaggcgattgacgatgcgataaaggttttggaaagtttaggagcagtctttgaagaggtatcgttacctcataccaaatattctcttccggtgtactatctgattgctccggcggaagcttcttccaacctagcccggtatgacggagtccgttacggctaccgggattttgaagccgaagatgtggtagaaatgttctcccggacccgggcggaaggttttggggctgaggtaaaaagacggatcatgcttggtacctatgctttaagtgcaggttattatgatgcttattacctaaaggcgctgaaagtaaggacccttattaaagaagattttgaccgggcttttaccaaagtagatctccttttaaccccaaccactccaaccccggcgtttaagtttggagaaaaaacgtccgacccggtttcgatgtatctttcggacatcttcaccatggccgtaaacttggccggccttcccgggatttcggttccggctggttttgacggtcatctgccggtatcgttccagttaattggcaagccttttgatgaaggaaccttactgaaagttgcccatgcctttgagcaaaataccgaatttcataaggcacggcccaagctttaggaggtgtattatgcgcgaatacgaagcggttattgggttagaagttcatgtggagttaaaaaccaatactaaaatcttttgcaattgttctaccgagtttggcggcgatccgaactcgcacgtttgtccggtgtgcttggggcttcccggggttttgcccgttttaaataaaaaagtggtggattacgcgattaaagcagcgctggcgttaaactgcgaagtggccgaatactgcaaatttgaccggaaaaattactactaccccgacttacccaagaattatcagatatcccagtacgatttgccgttagcgaaaaacggttatttagaaattgaggtcgatgggcaggtaaaaagaattggcattacccggattcacatggaagaagatgcgggaaaactggtacaccagggaaaccttgcggtaacaccttactctttagttgactacaatcgaaccggagtgccgctgattgaaatagtttcggcgccggatatccgtactcccgaggaagcaagactttacttggaaaaacttaaagcaattatccagtataccggaatttccgactgccggatggaggaaggaagtctcaggtgtgatgcgaacgtttccgttcgtcccaaaggccagaaagagttcggaaccaaaacggaaataaaaaatatgaactcttttaaagctctgcaaaaagctttggaatacgaaattgcccggcaaattgagattttagaggaaggcgggcgaatcatccaggaaacccggatgtgggatgagagccgtcaggtaaccctttccatgcgcagcaaagaggaagcccacgattaccgttatttccccgagccggatttaccgccggtggtcattgaccgggagtggttagaagagataagggctacattgccggaacttccagatgctcgcaagaaacggtttgtggaacagtatggcttaactccctacgatgcccatgtcctgaccttaacccgggaactggcggattactacgaggaagcggcgaagggttacagtaatccaaaagcagtagctaactgggtcataaatgagcttttacgtttactaaatgctgcaggaaaagaaattaccgaatgtcccataaaacctgaacaaattaccaagatgctggaacttttagataagggcacaatttccggtaaaattgccaaaacggtgtttgaagagatgttttcatccggtaaagacccggaggtaatcgtcaaagaaaaaggactggtgcaaattaccgatttgggtgaattggaagcggtggtggataaagtaattgcagcaaatcccaaagcggtggaagattacaagaacggaaaggaaaaggcattaggcttcttagttggtcagattatgaaagaaacccgcggacgggctaatcctgaagcggtaaaccagctcttacgggacaaattagcaaagctataatataaagaccgctgtcttaccggcagcggcttttttttgattttctactgaccacggaccacctaccacttaccactgtttaagtatacagtataaaaactttgaaaatcttttaacaattttgggggtatgttatcattaaaaaatagattaagctacaaagtgggagggtgaaataacgtgaaattaaaagataaaccaatttatatcgttgatacgaccctaagagatggagaacaaaccgcaggagtagtttttgcaaataaggaaaaaattcgaattgcccagatgctggatgaacttggtgttgaccagattgaggccggtattcccacgatgggtggcgatgaaaaagaggcaattaccgccatctgtaaacttggactaaaagccagtatcatgggctggaaccgtccggtaattaaagatattgaagagtcgctgcgctgcggggtagatgcggttgctatatctatttctacctcggatatccatattgaacataaactccgggcctcccgggaatgggttattgaaaatatggttaaagcctgcgagtttgctaaaaaagaaggtttgtacgtttcggtgaacgctgaggatgccagccgctccgacatggaatttttagtgcagtttggtttggcggcgaaacaagcgggagccgaccgtttaagatattgcgataccgtgggtatccttgatccctttactacttatgaaagggtcaaggaattgcgggaaagagtaggtattgaaattgaaatgcatacccacaacgactttggcatggccacggccaatgctttagccggggttaaagccggagctaagtttgtaggggttacggttattggccttggagagcgggccggaaacgctgctttagaagaagtggtaatggccttaaaacatatttacggtatcgatcttggctttaagaccgagcttttccgggaagttgctctttatgtttccaaggcttccggccgggaacttcccgcctggaaagctattgtgggttccaacatgtttgcccacgaatcgggaatccatgccgatggagcgttaaagaatcctaaaacctacgaggctttccagcccgaagaagtgggtctggagcgacaaattgttatcggtaagcactccggttcggcagcgttaaaagcgaaatttgccgagtacggaattcacttaaccgatgaacaggcagcagagcttctaccccatgtccgggcccatgcggtggaattaaaacggtctttgtttgataaagagcttgttttaatctacgaagaacatttcggaaagcggggaatgtagctttgggaaaaacaatcattgaaaaaatcctttcgcaaaaaagcggcgttgatgcttatgcgggccaaattgtggtggccgatgtggattacgttatggggcaggacggaacggctcccctggcaataaaatcctttaaagaaatgggcgggaaaaaagtttttgatccggaaaaagtggtttttgtgatagaccacagcgctcccagccccaatgaaggggtttcgcggcttcacaaattgatgcgggagtttcgggacgagcacggaattgatttccacgatattggcgatggagtctgccaccaggtagtgccggaaagcggtaaagtaggtcccggctctctggtagtaggtgccgattcccatacctgcacttacggggcgttaaatgcctttgctaccggtgtaggatctaccgatctggcagcggcgattatttccgggaagctctggtttaaagttcccgaaacgataaaatttgtgttaaagggtaaacttcccaaaggagtatttgccaaggatttaattttgtatttaatcggggatgtaaccgccgatggagcaacctatatggccgcggaatacaccggggaagctatttcggacctttccatggatggtcgctttaccattgccaatatggctattgaaatgggagcaaaagccggattgatggaagccgatgaaaaaacttttgcttttgtaaaagaacacggcggtaaggattttacaccggtctttgccgatccggatgcggtttatgctaaagttttggaatatgacgtatcggagttggaaccgatggtggccaagccgcataccgttgataacaccgccagagttaccgaggtggccggtactccgattcaccaggcggtactgggaacctgtacaaacggacggcttgaagatttacggattgcagccaaaatccttgagggcagaaaaatccatcccagaacccgcctgattgtggcgccggcttcccgcaaaattttcctaaaagccatggaagaaggacttattaaaatttttgtggaagccggggctgccgtagttacaccgggctgtggtccttgtgtgggtacccataacggtataccttcagacggagaaaatgttatttcaactgccaaccggaatttcaaaggccggatgggtaacagtaatgcctttatctatttagcttcaccggccacagttgctgcttcggctattgccggtgagattgcggacccgagaccttatttttaaggatggtggagtaaaaaatgattttaaggggtaaatgccataaatttggcaatgacgtcaataccgattatataatttccggtaaatataagtttaaaacactggatatgaacgagctggccagacacgtgatggaagatttagacccggatttttacaacaaaataacccccggtgattttatcgttgccggcagtaactttggctgcggttcatcccgggaacaagcaccgctggccattaaatacgctaaaattggtgctgtgattgctaagtcctttgcccggattttttaccgaaatgcaattaataccggtcttccggtaattgagtgtgataccgataaaataaatgccggcgatgaactggaagtagatttgtctaaagggattattagaaacctgactaccggcgaggatataccgattaagccattgccggaggtaatgatcaagattttaaatgacggcgggttaattgaacattttaaaaaatacggcacatttaacttttaaggaggttcatgatggcgcatagagttacattgattcccggagacggaattggtccagaaattgttgaagcagcccggcgggtaattgatgccagcggagcgaatattgaatgggaagtggtggaagccggagaaaaggtaatggccgagtacggtactccgttgcccgagtatgttttggaatctatcaaaaaaaataaagttgctttaaaaggcccgatgaccacacctatcggcacgggatttcgcagcgttaatgttgccttaagaaaagccctggatttatatgccaatgtccggccggcaaaatctttaccgggtgtggttacccgttatgaaaatattgatttaattacggtccgggaaaataccgaagacttatatgccggagttgagcatatggtaggtgatgatgcggcggaaagcatcaaaattattacccggaaagcttcccaaaggattgtccggtttgctttcgaactggcccgcaaagaggggcgaaaaaaggttaccgccgttcataaagccaatatcatgaagtataccgatggcttatttttagcggtggcccgggaagtggccgcggagtatcccgatattgagtttgaggatatgattgttgacgctatggccatgaagttggttcaaactccggaaaaatttgatgtgatggtgatgcccaatctttacggtgatattttgtcggacctctgcgcgggtttggtaggtggccttggagtggcaccgggagccaatatcggtgacgaatatgcagtttttgagccggtgcacggaagtgccccaaagcatgccggccaaaaccgggtaaaccccctggcggagattttatcgggggtgatgatgttaaaacacctgggagaaatggatgctgccgccaaaatcgagcgggctttaaccaaggttcttcccaataaggacatggttacctatgatttaggcgggactgcaaaaacttcagaaatggccgattatattataaaacatttataaaagcctccagttttggaggtttttatttttttcaccagcgggaaatgctaaaatagagatgaaaaacaggaggggtttgatgctggaaattcgctggaagttaaaacatgtggttttaatattaatattaactttagttttggtaaatgggatgaatttactgttgggagcgcttcctcttcccggccttaaaagttttggggccaaggttatctttttgactttttttcaggatatactgctattggctttggtgttgtgggtggtggaaaaaaaccgaggtcacctatctgacctggggcttacggtaaaaaattggggtaaagcctttaaatggggagtgtttggaggttttttaattttaattgccgtggtggtggtgggagcctttagttttaaaattttaaaggttaatcctccaccgcagacctttgaaaaactcttaaccctggctaaaactcccacggagaaaaacctgctggtattcttgggagtttttcttggcccttttgccgaagaacttttttttcgcggttttagctatcctgtcttaaaaaaatacatgggtgtggttggagggatagcagtatcttccttactttttggagcgatgcattttgatccttaccggtttttaccactttctttggggggagcaatactggcgtatctttacgaaaagaccggcacgatattaagcccctttgtggctcatgccacctggaatggaattatgacctggtttgtaatggggaaaatgttttttttctaagaaaaaatttaagactcacggtaaaaagtcaaggaccaagaaatggaaattagaaaagtaggggctaaaaaaggcaataataaccctctccaactatatggtaatagttggaaaatagcagagaagagaaaaggttttattcaagaactatttcatcaccgtccctttgtagatttggcctttgctcagcagggcaaagaccagccttactaatttgcgggcagttagaaccagcgctcgcttatgttgatgcttggtaacttcgtgatacttgctctggtagtaggccttatactcctcgttgtgcacccgcaacgagttggcggcctggaccaggtagtaacgcaggtaccggttgccactttttgtcaggcggcgttcttcggcgtcaaaatcacctgattggtagcgggtccaggtaaggccggcatattgagccagagcggcttgatctttgaaacgtttgatatcgccaatttcggctataataccagcagccgagatgggaccgaggccttttacgctggtcagagtttgaggtatggcttctaactcccggcaaatgactttatccagttgtttaagctgccttttgaggtggtcaatattctgcagagtaagagaaagagccacctcacaagctgcgagcattttaggattaaggcggtaggcgcggcgggcagcctgtttgagggccttagccatattctcaggtgaggctaatttgttgttaccatgggactggatgaactctgccagctcttccaatggcatttctataagttcatctggtgtaaattcctgtaataccgccagggaggccttaccgaaagtttgactaaaaggcttgtcctggtgataattagaaaacttaaggaagaggagatttaaggctcggttctgctcggccgtcaccatttccacgaggtgtaggcgcaggcgggtgagctggcgcaaaggttcagtcactatagtttcccggctacaaggggtaagatggccgaagcgcacccgttctgcgataacgtaagcatcgagggcatctgttttagggcgcttggtaccgaaggccttcttaaaactggccaccatgacggggtttatttcatagaccttggtggagtatggcttaagctttggggagtccaggaggaactgacggagatggacgctgtagatagaggtggcctccaaccctatatgaagttgctggatgttaaacttatgggcgagaccatccagcacctcaaccatagcagaagcgccttcgaggctgttaggaaaagacttaactggggcgagctgttgcccttgctcatcgagacacaccaagtcgcatttaagagcgctgacatcaatgcctgcaaaaacgacccgggccaaagggtatccctccttgggctggcccaaattaggggcgtgccctgcgggtacgtcgcgtaacaacctcgcggggcgatgagagcgtggcaggacagccgggggtgcacctctggcctgctgaatccagaagccggctggcctgttggctcagctcacgcgtaagaaacatgcgccgcaccgcaagggtctcactcttacatgagtagtcaccgggtttactcgggctacaggaggtatttaagagtgaccccggaccaacctattttaatcttcgcaaaggcacgccaagttatcaagaacccttaacctaatttttcggctcgggttctatggtaatttaaattatacgagggaggttaaatagtgaatagcgaacggttaatggagaaatttaatgaatataagaaggctgttgtaagacttaaagaagcgttggaagaagatttaacaaatcctttagtttatgatggcgtaattcagcgttttgagtttacctatgaactggcttggaagttgatgaaggcctatcttgagtatgaggggtatgcaactgtaaactcgccgcgagcagcctttaaagaagcttttgcctatggacttatttttgatggggatgtctggattgatatgatcgatgctcgaaatcttactgtgcactcttatgacgagcaaatggccaaagaaatctatgataaagttaaaaaaaggtattatgacgcttttgcagcatttgctaagaagatggcggaggtgcttaaatgaatttcggtttacctgaacatattttaaacgctttaatcaaagagttgcaaaaaagggaaaatgtaattagagcggtcatttttggatcccgcgcccggggggattataagtataattctgatatagaccttgcggtttactgcgagggcaggatgccatcggggttatggtcagacttagatgaggcagcgggtatttacaagattgatgttatagatatgaatagcccgttagatgaaaagtttcggcagaggattgaggagcagggtatagagatttaccggagagaatagaaagtttaattcaggaggatttatggaagaaattttagaaataattgaccttaccgaagaaggactgggtgttgggaaaaaagaaaagcgggtttactttgtttcgggggatgtcaccgttggtgatgtggtcaaagtaaaagttaccagcgaaaaaagaggcgttattctgggagaggctctggaaattttaactaattctccttaccgggatgttcccaggtgtccccattttggttactgcggaggttgcagtttacaaaaccttgattacgagcagcagttagtacttaaaaaaacaaaagtttataatattatgaaaaaaataggccggatagatgctcctatcaactccgttctacctaattttgctttttaccgctaccgtcaaaaagtgcatttcacttttggaagtagccagaataaactggctataggttattttgaccgaaaaaataactggtttcctgtaaccgattgtctgattgccgataaaagcttagttgaggtggctcattatgttactgaaatattagatgcttttaagcttaaagcttactttaacgatgctggagtgctacggcatttggtggttcgtaagtcatcaactaccggtgaaatccaggtagtgataacagccgtaaaattaaattttaacgtaaaagaaattgctgcgaaaattcttttaaaccctgaaatccagtcgctaacttttcatgaaaaccccaaaaaaaccagggaagtctttggtaaagggacagccgttacttttggtacccggtatattaccgaagaactattagggattagctataggctaactcctctttccttttttcaaataaatccggtgcaggcggaaaagatataccgcattgccttagattatcttgatttgggaaaaaccgatatggtttttgacggctattcgggagtgggatccctgaccttaccggctgcccgaattgccgcaagcgttgtaggagtggaagaaattagggatgcggtagaggtggccaagaccaatgctaaactaaacggtatagcgaatgttaatttttttgccggaaaagtggaagaaaaacttccctggcttttaaagaaagggtatcgttttaataaaattatcctggatcctccccgggagggagtaaaaaaagaggttttagaggagataataaagctcaatccggaacggattgtttatgtttcatgcaatcctgcaacccaggcccgggatttaaagattctggcggaaaccggctattacccggtggaaataacaccggtggacatgttttcccagacgatgcacgtggagaacgtggtattgctcaagaaaaaataacccctaaggccttgccgagcaaggccttaggggtcttacttttcaaaagctgccaaagaagtgactagggttgagtttgctttggtgaagtaagtaatccttaagacttcgttgatctgctcatcggttacacccatttgtctcaaggtgttggcaatagcctttaccccatcctttgcgccaacagcggcatccacggccagggaaatcatccacttggtttttgcgtccaggctgctttccccgtacaccaggtcctgtaggtctttcatcagtttgtaaaatttttcgtctcttgccttgatggcttcgataaacggcagtgtattcataatcacccccctttctaaaagctgcctcggttggcccggatgatattactggccatttgctgtaacagccttttaattattgccttttctttcggggacatgccctccaggagaatttcctgcacctctttcacaatagcctccagctgtggccttatggctttccccttctttgtaagaaaaatcctgaaggaacgtttgtcctgctcatccggtcttctttccacataaccggcagtttccagctttttaatagcccggacagtggctgccttatccaccaacaaccggtcgcttaaagcctgctgggactggccatccttaaagtataaggaaaaaaggtaggcatactggccggcgccgatgtgcagtggctccattttcttagccatataggaaatcatgttgcgccaggtaaatgatatatacttgccgacgttatcatttaaatcaatcatgtacttcaccccggcctaattttacattatagtcttttactacatagaggataaaatacgccaagggcacgaaaagaatgattgtgctaataaaatacatggttgcgatggaagtccggttagccagccaacccaaaaggatagaccctatgccgattcccaggtccaccgccgaaaaataggtcgaattagctactccgcggcgctggggtttgaccatgttgataaccatagtctgaatgctgggccagaccatcccgttgcctgccccgattattactgcggatgtcaaaaaaccggttaatcctttacttaaggaaagaaggagaaatccggctgcggtgcataagaagcctacggttattacgggagctggcccccggcggtccaatagctttccggaggtaggtctaaccagacttaaagcggcagcgtaggcgagaaaaaaggtaccgccgtttttgatgccgatttctttactgaaaagggtgataaaggatactatcccgccgtacaccaaggccgaaaaaaacatcaccatcgaaaccggtaaaacctttttttcaataaaggcatccaaggatatagggcgttttgtcaagggcagttttgggtaacggataaaattagcgataatcaaagccaaaacaaccaggcccgaagctgtaaaaaacagtcgaccgtattgatttgcttcccccatcaattgcagaccgatgagcgggccaacggccatggccagggtcatggttagtccgaagtagccgatcccttcgccccggcgctgcggtggcaggatatcagccgcgatggtactcccaccgacggtggtcaccccccagcaaaaaccgtgaagcagtcggagcattaagagaaaaaagagattggttgcaaaataatagcttcccataaagagggcgaaaagtgccaatgcccaaaggaagaccttcctccggcccacggagtccagggcatatccgcccaaaggccttatcgccacggcagataatgtatacactcccgtaactaaacctacctgactttcattggctcctataacttttgtcgcatagaccggcatagtgggaagtagaaaataaaagcctgcagccataaggaagtttactatccatagcagcgtaaaatcctttgaccagattgtttcctggtgttctgccatgttcttagtccccttttaatttagttgacttatcaactaattatataataaaacatatcggattaaatgtcaatagcggatttaaattgacccattttcagcggttttaaattgacccaccctggctttttttaaaattaagctttgacatgtggattaccgtagagaccggtttttaacctgtcttttaggcggtagctgttgccccttatgttgattatatgggcatggtgtaatagcctatccaacactgcagtggcaagcaccgggtctcccatgagctccccccattccccaaagcttttgttgctggtgaggatgatgctccccttttcataccgggcactaattagctggaaaaagaggtttgagccaaggccatctaaagggagatagcccacttcgtcgataataaggagcttgggcctaaggtagatcctcattcgcctttccaaccggctttctttatgggctgtttttaggtcttcaatgagcctggaaaggctcgtaaagtaaactgatatgccctgggatagggcttctatagcaagggctacggcaaggtgcgtcttccctactccaggcggcccaaggaatattacgttttctgcccggtggacaaaggccattgtggcaagctctcttatcagtttttcatcgatactgggctggaaggtaaagtcaaattccttcagggtctttttatacggaagccgggcaagttttgaccttacctcgacatttcgcctttgcctttcggcaagttcagtttcaagcagatcatttaagaaatcaagatatgtgcggttttcccgctgggccctttccaggagggcgtcaagaaaagctgctgcgcttaaaagcccaagttcttcaaggtgggaccgagctttttcaaggtctatcatactgtgcctacctccaggaggctttcgtaaacccccagaggacgcttctcaacttccagggaagataacttgatcgccttcggcctgggataaaacatgccctccgcttcttttagacccttatactggtctttgagaaaaacggtgctccttgaacggtaatgcttttcgtggacagctatcaccttcccatcatagaggatttcgattttaccgtttttgtcccttacaaccacctcttttccgctatactgccagggaacgccatatcttacgccgtcgaaactcaaaaagccgtctttgtgaactttccttgcttcttccaggaatttttggtatttatcaagggcaggcaggggtttgaggttttccttcttcagacggtcaataggcctttccccggtagtaccgtgtattctcctgtttttcttttcgcaccacactattgcctggcggtttaaatcaccgtagtctacgaacttcctacccggcaggaagttgtttttgacaaaatctatgccgctttctaccttgccttttgtttgggggcgccgtgccctgcacactttagaaataaatccaagggtcgccgcaaggtcttcaaaggtagggttccatatgggctttttgttttcaccggtgcccagtattacggttttcattctatcggtaagaactatatcggttactccgccgaagtattcaaacccgtggatcaagcagcggatgaaggtacggacgtcgcagcggtttgtgaattccacgtatatggctctggagtagcccagcaccatgacgaagacgtaaagcttacgtatttcaccggtttcctcgtcaatgtaggtgtattcgccccagtcgacctgggcttgctggccaggcttggtttcatagcggcatacggcagggacctgttttggaggtctaaattgtcttacatagtcccttaaaatagtgcgacctccggtgtagccttcttccttgattctttcataaatgacttcgcaattgaatatccccagattcatgagctcttgaatagtatctttgtaggggtcaagctttgaacctcttttgggacggggcttcctttcaggaatgccctctgctctgaggtattttcttaccgtatttctggaatgccctgtttctcgtgcgattgcacgaatactcttgcctcttgcttgtaattcatgtaacatgataatagatccactccctagcatttatttccctccgatcctttgcagtggtatcagagggatatttcgccagggggtgggtcatttccttttcgttgttcctgggtcaattatataccggcggtgacagattaaatatcaacttaacttttgcagttcgattttggaaataaagccttaacataaaacatggttgtggtgcaggaaagaactgagctcaatataaattttaggctttaagtgttataatatttttatgataaaagatgcacatcaagaggagtggagatgatggaatatcgaaaaattggtaaaagcggacttaaagtcagccgtcttggttttggagggattcctattcaaagggtggaacttcgggatgtacggccggttttggatgtcttaaaagaggggggagttaattttattgactctgcccgggcttatacggtaagtgaaggttttatcggtgaggcgataaagcacgaccgcaaagattggatagtggcaacgaagtcaatggccagaacttattccgaaatggccagggatattgatatttcgcttgctgaacttcaaaccgattatattgatatttatcagcttcataatatcaaaagtgaggaagagatggacaaggttttagcacccggtggggctttggaagctttggtggaggccaaaaaagcgggaaaaattcgggctattggggttaccacccataataaagatttattaaaaaagcttttagcggcttttaagtttgaaacgatgatgttaccgttaaatttggtggaaaccgataaagaagatgcgtttattcatgcgcaagaattaggggttggcaccattgctatgaagcctttagccgggggcttttttggtgaaaaccgggagtttccggcggatgtggctctttattatttaaaaaacttttctgccgttgatgttgttctggttgggatggcggatgtaaacgaagcccggcaaaaccttgacatatttaattcggaagtggatttagcggcgaagatggaagctttaaaagaaaaagcttcctttgctgcccgggagttttgtcgccgctgtggctactgccagccctgtccggtggggattggcattcctacaatttttgtgttagaaacttattacgaccgctacggccttcctggctgggcaaaggaacgctacaaaaatctaacggttaaagccgatgcctgtcaggagtgtggcctttgcgaagcacgctgtccttatggacttcctattagacggaaacttaaagaagttcaccggaagctttctttaaagtaattagggcttctttaaaatctcgaggaagaggagcgtataaactaatcgttttctttgttatggggtgcgggaaggaaatatagtaaaggtgcaatgcctggcgctcaataaggtccattttgcccccatataaatcgtctcctgctaacgggtgacctattgcagcaaaatgagcccggatttggtgggttcttccggttaaaagttctacttttaaaagggtgtgggtagggaaagcctttactgtttgatatttggtacaggcgggctggccaccgggaactacagcccttttaataatgcttccttctaaaagccccaggggaaggttaatgattccacttttatcggccagggggccttcaattaaagccagataaatcttgttaatttgcctttttcgtaaggaattgtttaacatttcggcgatgagactaaacttggcaattaacattggaccggaagtattccggtccaggcgatagattggataaaagccctcaaaaatcctacctttatcccgataataagaaagggtaagctcctgcattgagggtgcaaaatgattttttaccggatgggctaaaacccctgccggtttatcaattacaataaggtaatcgtcttcatatagaacttttaccggtgcgttttggctttgaaccgcagggggtaaggtgtggggaagttttattacaacttctccgggagtggtaagatgagaatttaacgggaccggtctgttattaaaaaatactgcattttgaagttttaactttcgtaactgccgtttacttaaaccgtggctttttaaaaactgaaaaactgtttttccaatatactcctggtttaccggcaagcttatttccataacaacccctcgttgaagcataatttttctttttatttttccggctgaaaatttagttgtcaagcttgaaagttaacaaatagatgttgtagaataaagtaagctttaaatttacatactatctttgaatttgcagaaaggggtgtaatgaatgcgcgtaactgtcgaccaagatttgtgtgtaagctgtggtttttgcgttgacaactgtccggaagtattttcctggaatgatgagggtaaatcccaggcgattgctggcgaagttccggaagatgttgaggaagcaacccgggaatgcatagaaggttgcccgaccgaagcaattaaagaaatttaaaagaatcaggcgaaagccaccccggcgggggtggttttttattttaactttttttgataagataaagatgatacgggggtgagggttttgaaaataattgtttgtgaccggtgtaaaaccacccatacggagggccttgtttgtaaacattgcgatacggcctattgttatgattgtttggatttgtttcctaacggcataaagttttgtcaaacctgcggtgaatttatttgcgatgaatgttatgagggaatggtggagtgtgaccggaaaaaaagcacataaaattgctgcagagttagaaaaactttttcccgtggcaaaaacggagttaaatttccaaaatatttttcagctgcttgtggcagtggtgttatcggcgcaaagtaccgaccggcaggtaaataaagtaacggaaaaactttttttatttgtaaaggagcccagggatttattagatatgggagaagaggagttatcccggcaaattcgttctttgggtttgtaccggaataaagcgagaaatttaattaaaattgctgaaatcctggacagggagtatcatggtcaagtacctgatagttttgctgaacttcttaaacttccgggggttggaccgaaaactgcggaggttattgtgggagttggttttaataaaccttcctttccggtggatacccatgtttttagggtagcccggcgtcttgggttatcgaaagccagaacgccggaaggcgtatcttttgatttgaaaaaaatttttcctccaaatagctggatagacttacaccatcgcttaatttttttcggaagaagaatatgtaaggcccaaaagccaagctgcaatatctgtccttttccggaattttgccaaaaggaggagtccgatgtttaacattgttttggtggaaccggaaataccttataataccggaaatattgctcgcacctgtgctgctaccggttcaaccctccatctggttaaacccctgggtttttccactgaagataaatacttaaaaagagcagggctggattactgggacaaagtaagggtaatttaccacgaaaactttcaggaactgagggaaaaatacccggagggtcgttttttctacctttcgactaaaggcaaacgttattaccatgaggtaagctataagcctggggattttttagtgtttgggaaagagacacagggactgccgcaggagcttttagaagccaataaagaatttacctttcgtataccaatgttgccccaaataaggtcgttaaatttatcaaataccgttgccattgtggtttacgaagctttgcgtcaattgcagtttccagattttgtttaaggtgaattttatggtgaaaaaagctaaaatgcgcctttggctgatgttgggcttaactttttgggtattggcctcctggtttattttaaatatcatccattttaaaagtttgagcagcaccgggggattttccagtcttccaagaccgataggacgggaaccggtactggtaaccaccatagggcagggtatcgatggtctgttggtgagtgagtattttcgtgatttgcatgcctttaccacctttcgacagaaggccgatgtggacgatctacgtgatatgcatactcttgttttggttgttggtaccgaattttcaacctatcaaggggtgtataaacaatttcaagaagagttagcccgagaacagaggttaatagctaaagccaaacagcttaaaattccgattgtattggtctgtttaagaaattaccataatcaaaaccgttatgatcgggctttatttgctaaagctcttttggcaagcgattatgtgcttttagttgggaaccgggcaatggatgggcttgttaatggatacaacggatattacaccagggtattacgctttcgcgatttgaaagtaccattaaatagtattttaaggtaacggtgggaaaatgaagcaaaaaattataaaaaaaatatttttagtaactttgatcgttgctgccattcttttaccccatgaagccaccactttggcacggttaaccgaccgttttatcatcgatagtgtttgggaaggacagagctcaaaagtatttcaagcggtgttaataggtacgggttattatttaatgcgggatataggagctttaattttcattttttatttttttgaaacggtaaataagctaaaaccaatcttaaaaacctttttatctttcttacttttaatttccttttacggttatttatactataaatttcaaataggcgattttgtttttggtattttaattggatgcgttctgttttttttattttccggtttaaaaaccccggaaaatattttttggagcaaaagctttttagtcctgcaagttcttctggctttttcctggttgaaatactccccgtttataaataaatttttctatagctttggcactccggcggaagaggtaagcttggttgcccagttttacggagccgatacggcgttaaattggataacggtgattatgttttttataattatgatgacggctttaatttctacgtttttaatatccatctactccacccaaatggaaatcatatctcgccagaaagaaaatgaactggaagtagaaaggtaccggctccaggtccaagaagcccgggtttttcaggaacttcacagtttagttcatgacttaaaaacacccttaatgacgattcaggggttaagttcattaattggcttaatggtagattctccaaaattacaagaatatgtccaaaaaattgaacaggcagtggaaaatgtcaataaaatgatttcggaaatcctctacgatgatgttcggaagacgattaccgttgaagaattaattaattacgtgcgtgcccatgtttttcccaagtataccgggcagggtatcttttttgagcttttggaccaaaaggaaaaattattgataaaccacattcgggttgcccggtccctgattaacgttatcgaaaatgcctttgccgccactgccaataaacccgatggaagggttaccataaaaacatataaagaggggaattacatctgctttgaaattgccgataatggggtcggaatacctccggaaatacaagaggaaatttggacctggggatttagtttaaaggaaaaaaagtcgggactgggattgccctttgttaaaagagtggtggaaaaccataacggttatattcagcttcactcggaagtaaataaaggaactacggtaaaaatatttttacctttggggggatatggtgagagtactcataattgatgacgatgaaggcattcgctacactgtgggggaaattattgcctttatgggctgggaagcgattaaagcggaaaacggagcaataggcattgaaaaatttgtgcgggaaaagccggatatggtgctggtggattatcacatgccagcgttagatgggttggatacggtggaaaggattcgggaaattgatcaaggggttccgataattgttctgacagtagatgaacgtcaacaaattgccgataaatttttggaagtgggagcttctgactttgctttaaaaccaattaaggcaccggatttaattgcaaggctaaaagtacatgcgcgcatgattgagataaatcgctcgcaggagaaaaaagatcaggatggatttttggccaagggaattaataaaaaaaccttcaatttaattgtagagtatcttaaagagcaaaaggaaccgcaaaccatagaggaaattactgaaggagtgggccttgcctacccaacagtacaccggtatttactgtatatggtaaatgaaggtatagtgagtatcgagtgtgactacggtcgcattggccgtcccaagaataaatataaattagtataaatttcgggacagtccctaaaattatacttaaagtataaaaaaggggactgtccctttttgtatacaatgagaaatatgagaaaaaatagaaaattatttaataatgtgaaataatattaaaaaaataaatcggagcgagggctatggaaaagattttggaagtaaaagatttaaaaacttatttttacagttcagggaaagaaattcgggcagttgatggtgttagttttaccctgaaccggggagaaattttgggaattgttggtgaatcaggttcaggaaaatcggttacttccctttctattatgcggcttgttccttcacctcccgggaagatagttggaggagaaattatttttgccggtgaggatcttttaaaattaagcgaaaaagaaatgcgcaaaattcgcggtgaaaaaatatccatgatctttcaagatccgatgacttcgctaaatcccgtttttaccatagaggagcaacttttagaggtgtttcgggtacataaaaagttaagtaaaaaggaagcccgggaaaaagctgtggaactattaaaaaaagttggaattccggaagcagaaagacgccttaaaagttatcctcatcagtttagcggtgggatgcgccaaagggttatgattgccatggccctagccttaaatccggccctattaattgccgatgaaccaaccactgccctggacgtcaccattcaagcccagattttagctttaatgaaggaactgcagaaagagtacgggacatccatcataatgattacccatgatcttggggttgtggcggaaatgtgccacaaggtgctggtgatgtatgcgggaagaccggtagagtttgccgatgtcaagactctttttgccaaccccaagcatccgtataccctcgggcttttaaactcaattcccaggcttaaagagcaaaagacccgtttaaccccaattgaaggttcaccaccggatttggggaatttgcccaggggatgtgctttttatccccgttgcagttttaaacaagaagtatgcagtcaagttaaaccggatttcctggaattaccggaccgcaaaattgcctgtcatttataccagggggttttggatgatgcagccgcttcttgaagtaagaaacctcaaaaaatattttccggtagggaagggcttcggtccgtttaaagaaaaaagatggttaaaagcagttgatgacgtgtcttttacgttatataaaggggaaactttggggttagtgggggaatcgggatgcggtaaatcgacgaccggtcgtgcaattctgcgcttaattgagccgacttccggagaggttatctttgagggagagaacattttaacattaactcaaaaagagatgcgaaaaaaaagaagagaaatgcaaattatttttcaggacccttttgcttcattggacccgcggatgaccgttgcggaaattattgctgaaccgttacggatttttaaatacaaagaaaacattaaaaaaagggtggaagaattaatcgagaaggttggtttgagccgttcgcatttggaccgttatccccatgagttttccggaggccagcgccaaagaattggcattgcccgggctttggccctaaatcccaaattaattgtctgcgatgagccggtttctgctttggatgtttccgttcaggctcaggttatcaatcttttggaagatttacaaaaagaatacggactaacttatatctttatcgctcacgatttaagtgttgtcaaacatattagccagcgagtcgcggtaatgtatttaggaaaaatagtggaatcaggaccggtggagctaatttttaatcaacccaaacatccgtacactatcgcgttactctcggcgattccggtaccggagcccggggccaaaaaagaaagaataattttagaaggagatgttccaagtcccataaaccctccagcgggctgtagttttcatccccgctgtcctgacaaaaaaccgatttgtactgaagttatgcctgaacctgtggaactggaaaatgggcacgtggtgaggtgccatttgtatagcggggaggtgaaaaaggggatatagaatatttttatagagttttagcaaatgcataagaaaataagcaaaatggaggagggaaaagttttgcggaaaattaaggtagtatcctttttggttctcttagcttttgtatttactttaactgcttgcgggggaaatacggctaaaaatgaaactaaagaaacaaaagaaaaagtatttgtttttgccaaatccggtgatccggtaggcctggatccagcaaacgttaccgatggggagtcaatttatgtaacccagcaaatatttgaaaccctggtgaaatataaggatgacaataccgaagtggttcccgggcttgccgagtcctgggaaacttctaaagacgggcttacctggacttttcatctccggaaaggcgtaaagttccacgatggcacaccgtttaatgcggaagcggtgaaatttaattttgaccgctggatgaataaaaacaatccttaccatcacggagagtttgagtattacggttacatgtttggtggttatcctggagtgattaaggaggttaaggtggttgatgaatataccgtccaaattactttaaaaactcctttagctcccttcttatccaacctggcaatgcccagttttgctatttccagtcctgaagctattaaaaaatatgggcaggattactttaaacatccggtgggtaccggtccatttaaatttgtcgaatggaaaaaagatgaccgggtggttttagagcggtttgatgaatactggggaggaaaagccaactttgccaaggttattttccgtacaattcccgacaattcggcccgactcatggaattaaagtcgggtaatgtggatgcaataactgacataaatcctgatgatgtggaggcggttaaaaatgaccccaacctgcagttactgttacgaccttctatgaacgttgggtaccttgcgatgaacactgaaaagaaaccttttgataatgttaaagttagacaggcaattaactatgctattaataaaaaagcgttagtggatgctttttacggcggtcttgccaagcccgccaagaaccccttgccaccgtccctttggggttataacgatgaaattcaagactacgaatatgatccggccaaggccaaagctctgttagcggaagcgggatatcccaatggctttaccaccaccttatgggcaatgccggtggcaagaccttacatgccgcaaccgaaacaaatagcagaagcaattcaaaaagacttagaggcggttggaattaaagcaaaaattgtaacttatgactgggctacttacttaaagaaaggtgaaaatggggagcatgacttatatctcctgggttggaccggcgacaacggcgaccccgataacttcctttatgtattgctggataaagacaatgccaagaaaggttctgcttccaacgttgctttctataaaaatgataaagttcatgaattattaataaaggcccagcaggaaagtgaccagaccaagcgtgccgagtactacaaagaagctcaagtaattattcataatgatgctccttgggttcccctggttcactcaacgccaccggtggcagccaggaaatcggttaaaaactggatacctcatcccaccggtagtgaatgtttctttaaagttgataaagaagagtaacacgggttataaagaagggggtaaataacccccttcttttaaaaatggaggtatactgtgtatggccaactatatagtgagaagattattacaactgattccggtactcttcgggataacctttctttcttttatgctcatacattttattcccggcgatccggtgacggttattcttggagaacatgcttcaccggaaagggcagcggaactacgagagcaattgggtttaaacgaccctttatataagcagtatttaaagtttttgaataacttactccatggagacctgggacgttcgattataacccatgaaaaagtcctaaaagaattggcaaccttttttccggcaacggtcgagttaacgcttgctgccatgtttattgctaccattatcggaattgcagcaggaattgtggcagcggttaagcagtattcgtggtttgataatttaagtatgattggagctttaacgggggtttccatgccgattttttggctgggtttgatgcttatatacctttttgcccaagttttagggtggcttcctccgtccgcccgtttaagcattgaatattcggttccaactgttaccaatttatacttgattgatactttattggcgggcaactgggcggcgtttaaggatgctttagcccacctaatcttaccggctttagctttaggaacaattccaatgtcgattattgcccgcatgacccggagttcgatgctggaggttttacgccaggactacatccgtactgcccgggccaaaggtcttggagaagcaacggtaattttaaaacacgctttaaaaaatgcttttttaccggtagtaaccgttattggtttgcagtttgggtaccttttaggcggggcggtcatgaccgaaacggtgttttcctggccgggggtaggacggtatatttatcaagccattatggccagggattttcccgtggttcagggtagtatcacaattatcgccttaatttttgttttaattaatttaattgtcgatattttatatacggtaatagacccccgaatccggtatcagtagcaggaggatagcgatgggtaaattttgggaaaaagactggataaaacgccttttgcagaataaagcggcggtggtaggtttaattattgtcttactattactctttgctgcaatttttgctcccgtgcttgctccctatgacccgataaaagatggaagtttacaaaataggttaaaacctccttcttcggagcatttgcttggtaccgataagctgggtagggatattttaagccgcataatttttggagcacgaatttcggtagaaattggcgtgatttctgtaggtttggcgttaatcgttggtacgttaatgggtttaattgccggttattatggtggcttacttgactcttttcttatgcggattgttgatattattttagcttttcccagcattcttttggctattgccattacttcggttttggggcccagtttaaataacgcgatgattgctgtgggaattgtaatggtaccaagttttgcccgggtagtacggtctacggtgttaagtttaaaagaaatggagtttgtggaagcagcccgggcgattggggccactgattttaccatattgtttcgccatattttaccaaactccatggcgccgataattgttcagggtaccatgaatattggtactgcaatattggatgccgcggggcttagctttttggggcttggtgcccagccgccaacccctgagtggggtgcgatgctggttgatgcccgggaacttttagtaaaagccccttgggttgccttcttcccgggattagcgattatgttaaacgttctgggctttaatcttttaggagatggtttaagagatgctctggatccccgattaaaacaataggtttttaagctgcaattcctgcagctttttttgtgctataattaattgaaaacagggaagttaaggagggaaatttttggaaaattatcaaaaccttctacaaaaaatggaagaagcggggtatttaacctctccggagattgccattccagttttcttagctttaaaattaaacaagccaattttagttgaaggacctcccggagttggtaaaacggagctggcaaaggtgctggctaaagtgttaaatacagaactaattcgccttcagtgttatgaaggtttggatgaagctaaagctttatacgaatggaactatcataaacagttaattgccattcaaagcagtaaaaataacgacgataagacttttgttttttccgaggagtaccttttggaaagacctttactgaaagctcttcgggcgcaaaaaaagccagtgctattaatcgatgaaattgataaagtggatgaagaatttgaagcatttttatttgagcttctttcggattttcaggtaacaataccggagcttggaacaattaaggccagggagattcctttggtggtgctaacgagcaacggaagtcgcgaattatccgatggtttaaaacggcgagccgtttatttatatattgattttcccgatataaagttagagacaaagataattcttaaaaaagtaaaagaaattcatcaagaattagcggaaaaagtggcaacggccgttcactttctccgccgggagatggatctttataaacctcccgctatttccgagacgttggactgggcaaaaactcttgctttattgggggatgagcgcttaactaaagagtttatcgaaaacaccattgggtttgttttaaaaaataaagaggatattgagacgttttatgaaaaagggggggcaaatcgcttgctccaatatatagatgaaaatacttaaatgagggagtaaaatgttaaaaaatgtcctgttttttgtggatttattaaggattcagggattttccatttccaccggggaaattgaagatttgttaaaagccctggcgttagtcaatccccagaataatagcgagttaaaagcggtttttcaggcaacattactaaaaagtagcggtcttaaagatagttttggtgaaatttttgatttttattttaccgatgattttttaaaaccagtccaccacccaaggcaaaaatgggaggataaagcccacaaggttaatcaagctttgaaacaggtcggtatttaccgggaaattgaatttaataataaggaaaaggaagttttaaacagtcttccgccggaagttttccaaaagctatacgaaaaaattaagcaattttaccccaatcaaattgtagatagctttcctctgttagaaaaaaccataaagggagtcttaaaatattatcaagaacggatggttttaccggaggcgggagttggtggtcggagaaaagacctttttactgctaatttaaaagatttaagcgaacgggattacgaaagggtggaaaaattaattaaacgttatgcgggaagattaaatgccaaagcttcgaggcgcttgaaagaaaccaggagaaaaaagtatataaacttacgaaaaaccattcgcgccaatttatcccacgggggagtgttatttaacttaaaataccgggagaagaaaaaaaataagccccaaattacccttttaattgatgtttcggcgtcgatggcgatttacgctaaatttgccctttcttttttatttgctgtggcgcgaagcttaaaaaaaattgaactctacctttttgccgaagatttagaagtgttaccgcttaaaaattataacaagtctcttttggatttaaagcggctaattgaagatagccagcagtggggacgcggaacaaatctcaatcaagccttaaaaagttacctaaatattgccaaaaccaggagaagttttcgacagacgcttttaatcttttccgatggaaaaacggtgcagtttgctgaaacgttagaagagcttaagaaaatttgccggcaataccaggatgtaaaatttttaaatccggtaccggccaaaaaatggcaggaagatactttacttaaaaaattagcccaagaagtttccatgattgaaacaaacagcgtagaacatttgcaggctgtattcagtaaaattttgagttaaggaggaaaaataaatggaaaaggttgattttttagcttttggagcccaccctgatgatattgaatgcggcattggtggaacgattgccaaattaacccggcttggttataaagtgggactggtggatttaaccctgggtgaaatggctaccaacggtactatcgaacaacgtcaggatgaagcgtataaggcaatggaaattttaggagcaagctttcggataaatttagaaattcctgatcggggtattaatttaacgccggaaaatatcgaaaaagtagtcgagattttacgcaaagcacagccgaaggtgattgctgccccctactgggtggacaggcatccggatcacgaaagggctggaagcttagttaaagaaggtttctttagtgcaggactgaacaaagtgttaccggaaataaagccaattaaaagaccggagaagtatttaagatattttttaacgatttcagctacaccgagctttgtggttgatgtaaccgaatattattccattaaaaaaagggctgtattagcccatgtttcgcagtttgcgcaccgtccggaattcagtcagacatttttaaatgaaggacagtttctgggcaggatagaaagccgggacctcttttttggagcgcaaataggaaaaaggtacggagaaggttttgtcttacaggaattactggagttagaacaccccctggtattgattaagtaggtgatcctgtgaaaatcggtattgtttgttatcccggttatggcggaagtggggttgtagctgcggaactgggaaaagctttaggacaaaaagggattgaagtccatttcatctgccttgaacgcccttttcgtttggaaggaattctccccgggatttattaccacgaggtagagccggtcgattatccgctttttaagtttccgttatactacttacccctggccggaaaaattattgaagttgttcgaacttaccatatagacttaattcatacccactatgctatcccccatacggtggcagccttgatggcgaaggaaattttaagtagcgaaggtaaagagctcaaagttattactaccctccatggcactgatgttaccttagttggccagcggcgagaactttttgatgtaacccgctggtccatactaaaatccgatggtgttacagcggtttccgagtatttaaaaaatgtaacctgtgagatatttgccataagtcccaggaccattgaggttatctacaattttgttgatcttgacgagtatcggccgaaaacggatgaaagtttaaaagaaaaattgggagttccggaaaagcaaaaagtaatcatacatatttccaattttcggccagtaaaacgggccttagatgttttagaaattttttctaaagtgcaaaccgaggttgatagtgtcttagtgtacgtaggtgagggaccggataccggaaaagttctcaatgaagtgcagaagaaaaatcttacaaataaggtgaagtttttagggaaaatgcccaaagtcagtgacgtgttaagtatttccgatgtactgttaattacttccgaaaccgagagttttggtttggtagctttggaagcgatggctatggaagttccggtggttgcttaccgggttggaggtttgccggaggtagttgttgatgggcagaccggttacctggtggattatttggatctcgaaaaggcggcagaggcggtggtaaaattacttaaggagccttggcttaaaagggattttggaagatgggggcgaattagagcaaaagaacgttttagtaaagaaaaacaagtaataaactatttaaactactatgaaaaaattttaaagggattataatagtaaataagaactattatcataatttttcttgaggtgaaaccaatggcagcaaccacaagaatgacccgacaaaagaaagttattattgacattttaaaaaataccaaaaatcatccaaccgccgattggatttacgaacaggcgcgaagaataattcccgatataagccttggtaccgtttaccggaatttgagacaattaacccaatccggggaaattttagaactgaattatggcagttcttacagccgttttgacggaaatccggtgcctcattaccattttgtatgtgaaaattgtggcagggtttacgatgtagatatgcccgtcttagagaagattgaaaaagaagtggaaaaaaagatggggttttctgtaaaaaatcatcgtttagaattttacggagtatgcagtgattgccagcaaaaagttagggtggattaaatgagtaataccaaacatgcaaaattattggcttatattcgcaatttaccttccggtagcaaagtgtcggtaagattgttagccaaagaattaaaggttagtgaaggtaccgcttacagggcaattaaagaagcggaagcggaaggtttggtaaaaactgttcctaaagtaggaacgattcgcataacaaatatcgaaaaaaaagaattaaaagatttaacattaaatgaaattataaaaataaccgagtcccatttgctggtgggggaagatttgttaaattaccgttttgcaaattttttaattggggcaatggctgttgaagctatcgaaagatttttggtagagggttgcttatttatcgtaggcaaccgggaagatgcccagttaaaagctttacaaagcggtgcccacctgctgataaccggaggttttccggtaaagacggaacttttagaactggcaagggaaaataatttagcgatattatcatcaccgtacgatacttttacggtaacgtcgcttttgcatcaagctttatatgagcgcttaaaagaaaaagaagttataaccgcaagagatattatggtaaaaaaagtatttaccctttctttagggcaaagggtgagggattggcgccaattatttctcaataccggccacagccgttttccggtggtggataaggaaaatcgggtttgcggcataatcactgctaccgatgttgccggtgccggggaagacgagttagtggaaaatttaatgtcaaaagatgttatttccgccagtcccgaaacgcctattggtcatatagccagggttatgacctgggacaggattgatttggttccggttgtggatgagtcttttaagttattaggcattattagccgccaaaatattattgatgctttacagcggctggaaagacaaccgcattttggcgaaactttagaagatcttattataaaaaatttccatgttggtgaggacgaaaacgggatatttttagaaggaaaaataaatgattttttaataaatgaactgagtatgttaagttccactgttcttttatccctttccattttttatgccaatctgatggtgcgaaaaaaagttaaagctccggtagtggttaataatttttctttatctctgttaactcccctaacttatggagaaacccttgtagttcggggtaagttgttgtacctggaaaaaagaaatgcaaaattagagatagatttttataggcaaagtaacctgaatgccaaagctttaattgaggttcgtttaattgaaaaataaggcacccgtcggaggtgtcttttggtttattataggaggatatgtgtatgagttttgtacatttgcatacccatagctgttacagtttattggatggagcagggaaaattaaagacctggtaggaagggcagtggaattaaagatgcctgccctggctttgaccgatcacggaaacttgtttggggttattgaattttataaagaggcaaaggcccagggcataaagcctattcttggcgtagaggtctacgtggcaccccggactcgctttgacaaaactcctaaaattgatgaccaattaacgcacttggttttacttgccaaagaccgcaccggttatcaaaatcttttgcgccttgtctcgcgttcgtatacggaaggctattattataaaccacgggtggataaacagcttttagcggaaaacagccagggtttaattgccttatcttcgtgcttggccggtgaaattcccgagttgattttatccgggcaaagggaaaaggcgcgggaagttgcgggcatctaccgtgatatttttggaaaggaaaatttttacttagagcttcagtaccacggcataagcgaacaaaaagtggtgaatcgggaattaattgctctttccaaacaattaaatattccgctggtagctaccaatgacgttcattacattttaaaagagcatgccaaaactcatgatgtgcttttagcaatccaaactggaaagtcgattaacgaccctggtaggatgaaatttccaacggaggagttttatttaaaaaccccctatgagatggagcttatttttggcgagctgccagatgctttaaaaaacaccttaaatatagccgaacaatgcaatttagagttcgagtttggtagataccttttgcctgatttcccggtacctgaggggaaaactcctgcgcaatacctaaaagagctttgttttcagggactttacaaaaggtacccaaacccgggggaagaagtaaaaacgcgcttgttgcatgaattaaagattattgagcaaatgggattttctggatattttttgattgtttgggattttatccgttatgccagggaaaaaggaattatggtgggaccgggaaggggttctgctgcggggagcttggtagcctatacccttgaaattaccgatatcgacccgcttaaatatggcctcttgtttgagcgctttttaaatccagaaagagttagtatgccggatattgatgtggatttttgttttgaacggaggcaggaggtaatcgattatctgtaccaaaagtacggggaagaccgggtagcccaaattatcacctttggaacgatggctgccaaagctgcagttagggatgtagggagggccctggattggccctacagtgaagtagataagatagccaaacttattcccaacgtcctggggataaccttggaagaagctatcgaaaccactccggaacttaaaacattatatcaaaacaaccccaaagtccgtgagttattggatttagcaaggcaaattgaaggtatgccaagacatgcttcggttcatgcggcgggtttggtaattgcgccggaagaaattgataaacatataccgctgtttaaaacttctgaaggggtggttaccacccagtttgaaaaagatacggtcgaggagttaggtcttttaaaaattgacctgctgggcttaagaacgctaaccgtaattgaaaaagctttggatttcattaaaaagcaaacggggaaggagattaatttaaaagacattcccttggacgatgaaaaaacttataaacttttaggagagggtgacaccgttggtgttttccagttagaaagtcaggggatgaggcaaatccttaaagagctaaaaccaaccagtatcgaggatttaattgccttggtggcgttataccggcctgggccgctgggcagcggaatggtggaggattttatcaatcgtcgtcacggaagggtaccggtggaatatcctcatccggacttggagccgatcttaagagaaacttacggggttatagtttatcaagaacaggtgatgttaattgccagtgtgctggccgggttttccctcggggaggcggatttactccgccgggctatgggtaagaagaagcccgaaatcattgctgccttaaaaaacgattttattgagcggtcggtggcacggggttatccccgggaaaaggcggaggaaattttcaatcttattgaatattttgccggttacggttttaataagtcccatagtgcggcttatgcttttgtggcgtattataccgcctggttaaaggcaaattttccggttgcctttttggctgctttgttaatcagtgtaaaagataatcttgataaagtaacagtatatgcagaagattgccagagaagaggtataaaggttttaccacccgatataaatttaagtgaagtcgactttaccatttcgggccaggaaattcgctttggtttagctgctgtaaaaaatgttggggaggctgcggcggcaaaaatcattgaagaacgccagaaaggcccttttcgtgattttaatgatttcttacaccgaatagacaaaaaaacggttaataaacgggtaattgaaagtttaattaaagctggggcttttgcgagttttggctttaatcgcaaaaccctgttaaataacttggatgatgctttagaattttacagcaagaaatcaaatggcgttcagttaacccttggggattttttaccggaggccgaccgctacaatctgcgtttggaagaagaattttcaaaattggaactgctgcggatggaaaaagagagcctggggttgtatttaaccggtcatcccttggctgggcttaggagctttatccaaaagcattgtaacctaaaagaaaacaaagaaaaaatatactatccggctattttggcggagataaaacggactgtaacccgcagaggagaaccaatggcttttgccctgctggaaggattgaatcagaccgttgaagcagtaatattccctgactgctggttaacctaccgtgacctgctgcaggaggaaaatatcttatggttttacggtgccgttgaagaagatgaggaaggtttaaagatgattgtcgaaagagtttacgagttagatatgagcaatgccttggaagtttatctaaaagtttctcccggaaatattccattggtccaggggattttacggaagtacccgggaccagcaccggtttacctgtatccgggagggaagaaacttataaaactttcgcaggaatactggattgatttaaaaagtcctgtcctctgggagattaaaaagcttttgggggatgaaaacgttaagacaaaaaccgtttcttgacagtatttggcccctattgtaagctaaaagcggagtggtggtatgagcctgattattttagttttaaccttctatttattgattttgattatggaaattgccgcaataattttaaaatcaacaggaatggaaatcggtaaagcccgctttcaggctttatcagccttaacttccgttggctttaccacccgggaatcggaattaatcgtccagcatcccttaagacgcagggtaatttccgttttaatggtaataagttacctggggatggccacggtggttggttcggtgtttggttcgtggacgaaaaagattacacctcatcaggtattaattgccggttcaatttttgtgggaggttttttactattttccaaccgctatttaataaatatttttgagagaggtttggaaaagcaaataaaaaagtctttccttcatcaccaaactttttgggaggttttaaagctttctgatgattatggggtggcggagtttattctccatccggacgcacctctggttggtcaaagcatagctgggagtaagataagggacaaaggaatatttatcatggccatttagaggggtagcagttttattcactctccccggggaaatgaagtactggaagcgggggataaattaattgtttacggcaaaaccgaaagtataaaaaattgcctgttacagcaatcaatttttcgagaaggagagtgattggtggtgtgtgataattttgcttttagctcggcaataaatgccgaatatattgtcgtgaaagctttagaaaatggggtaacaattatgggcttgacccgcggaaaagataccaaatttcaccatacagaaaaattagataagggtgaagttatggtggcccagtttaccgagcatacttcggcaattaaaattagaggaaaagcggaaatttataccaagcatggtgtgataaaaaacgaataaagagccggagggaattgtatgtggactgtggtttatattgcgccaaataaaaaagatgccttaagggttcaggaggctttagcgaaagaaggatttttggtgaagattaaaccaatagggatcgaaggagacaattccacctatgaagttatggtacccgaagcagaagtggaagaagcgatggaaattttaaatgaaatgtaaaggagttttgctatgtttgacttttttcgcaaatcgaagtatgtaactgtaaagccggaaactaaacaaaaagagattcccgatggtttgtggcagaaatgtccccggtgtggggaaattatttttaacaaggaattggagaaaaattttaaagtttgtccaaaatgcgggtatcattttaaaattagtgcctgggaaagaattaaactcttatgcgatgaaaatagttttgtagaatttggccgggaaattagtgggggcaatcctttaaattttccaggatatgaagagaagttagcggaagcccgggaaaaaaccggcttaaaagaagcggtagttaccggattgggaaaaattaatggtagagaagtagttttggcaataatggacccgaattttattatggccagtatgggcacggctgtaggggaaaaaatatgtttagcgatggaaaaagctctggagaaaaagctaccgcttgtagtctttactgcatccggaggagctcggatgcaggagggaattttttctttaatgcagatggccaaaacggttcaactggtaaatcgtttaaatgcagaaaaaattttttatttggtagttatgaccgatcctactaccggcggtgtttcggcaagttttgcagccttgggtgatataatattggctgaaccgggggctttaataggatttgccggaccccgggttattgagcaaactatccggcaaaagcttcccgaaggttttcaacgagcagaatttctggagcagcacggttttatcgatgctgtggtttccagagagcagcaaaaagaagttattacaaaactcttggcttggcacagccaaaagtaaattgggggcagcgtatggcaaattttttatttgagtttgaaaaacctttggttgaattagaaaataaaatatctgacttaaaaaagtttgctgaagagaaaaacattgatgtttcccgcgagttagaattgctttcggccaaggcccagcaattggcaaaggaaatataccagaacctaactccttggcagagggttttattggcccgacatcccgagcggcccaatacgcgggattatataaattacctctgcgatgattttattgaattgaaaggtgaccggcgctttggtgatgatccggcgatgattggaggtatagggataatagaaaatatcccggttactatcgtcggaaatttaaaggggaaagataccaaggaaaatatcatgagaaattttggcatggctcatcccgaaggatatcgcaaggccattcgtttatttaaacaggcagagaagtttggacggccggttttaacgtttatcgatacaccgggggctttttgcggaattggagcggaagaaagagggcagtttcaggctattgccgaagcaattgccacacttattagcttaaaaactccggttttagccgttattacgggggaaggcggaagcggcggagctttagcgctggcagcaggtgataagttattaatgttagaaaatgcggttttttcggttattgctccggaaagctttgcggcaattctctggaaagactcatcccgcgcccaggaagcttccgaacttttaaaacttacttccgagcatttattggagtttgggttaatagatggcattatccccgagccgttgggaggagcacaccggaatccagcggaaacattaaaggcggttaaagaagaagttgttaaaaatctgcaaatcttaaaagaaactcccgtagaggagctgttaagaagacggtatcagcggtatcgctatatagggagcggcattgtagagggaggcgtaagctaatgaactccattggggttttaaccagcggtggcgatgcgccaggaatgaacgcagcggttcgggcggtagttagaaaagccctttttcacgggataaaagtttacggaattgaacgaggttatgccggcttaattaataatgagataaaagaaatgagtttgggcagtgttggtgacatcatccaaaggggcggaacggtcttaaaaactgcccgctctttagaatttaaaacttatgaaggcaggttaagagcttttcaaaatttaaaaaaccatggcatcgaaggtttggtggttattggaggagatggctccttccagggagccttaaaactttatgaggaatttggggtaaaggtggtcggtatacccgcaactattgacaatgacatttatggtaccgattattcaattggttttgatacgacggtaaatacggtggtagatgctattaataaaatacgggatactgccttttcccatgaacgtaccttcattgttgaggttatgggaagaaacgccgggtttatagctttagaagcaggaattgctggaggagctgaatcgataattatcccggaaataccttactctatcgaggaaatttgccaaaagttaattaagagccatcagcggggaaaattacatagcataattatcattgctgagggcgcgggaagcggcattaagctgggagaagtaattaaggaaaagaccggttttgagacccgggtaacgattttaggccacatccagcggggtggaagcccttcggcttttgaccgaattttagcaagccggatgggtgctatggcggttgatgccttaagagaggggatttcccaaggggtgatggttgcctttgagaagggcgaatatgttttaaagcccctggaaactgctttttcggggaaaaagcaaattgaccttgaatattatcgtttagccgatattttatcgatttaataccggggtgagaattaaaatgaaacgcaccaagattgtttgtacaattgggccggcttcaaacgacgtaggtatcttaaaagaaatgattatatccggaatgaatgtggccagaattaattttgctcatggcagtcacgaggagcaccgggagagaattgaaaaggttagacgggcgtctttagaagtaggaatcccggtggcaattttaattgatacaaaaggtccggaaattcgcattggtaaagttgaaaacggaaaaattgtcttaaaagaaggggacttagtggtatttgatccggatatagcagagggtcaaggtttgagagttccagtaaattatccgggattagcccgggatgttaatgtcggaggaactattcttttagatgatgggttaatagaattgaaaatcgaagatattcagggtaataaagttattgcccgggttataaccggtggtgagttatccaataacaaaggagtaaatttaccgggagttaaagttaatcttccggcgttaaccgaaaaggaccggaaggatattgattttggtattgaaattggagcggactttattgcccactcttttgtccgaaaagcagcggatgtgttagctttacggcgttacctggaagaaaaaggggcggatatggaaataattgctaaaatcgaaaaccaagaaggggtcgaaaacatcgatgaaatcatcaaagttgcggatgggataatggttgcccggggggatctgggagtagaaattccaacggaagatgtgcctttggtgcaaaaggaaataattgaaaagtgtaataaaaatggtaaaccggtaatcaccgccacccagatgttagattcaatgattagaaataaacgtccgacccgggccgaagctaccgatgtggctaatgctatttttgacggcaccgatgcggtaatgctgtcgggagaaacggctgccgggaaatatccggtagaagcggttaaaacaatggcccggattgcggaaaaagcggaagaaaaattactcacgttacgaaaactaaataaacccaccacaaaatcttttaaaactgtaaccgatgccataagccacgccagtgttaccaccgctgaagaattggatgcgggggcaattatcacgcctacttcttcgggctatacggcgcgaatggtttcccggtaccgcccggcggttcctattattgctgccacaccggatatgaaggtacttagaaagttgacgctggtttggggggtatttccccttttggttaaaacctccgattctaccgatgaaatgttaagtaaagcaatagaagcctctttagaaagtgggcttttaaaacctggcgatttggtggtgcttaccgccggagttccggtgggcgtaaaagggacaaccaaccttttaaaagtccatgtagcgggaaatgttttggccaaaggtgtgggcattggaacaaggcctataaccggaacggctcgggtctgtcgaaccgccagggaagcaatcgagcggattcagccgggagatattttggtaaccgaagcaaccgacagagattttgtttcggctattgaaaaggccgcgggactggtagttgaagcgggaggacttacgtcgcatgcggctattgcggggttagagtttgggatacctgtaatagttggggtcgatggtgctacttcgataattaaagatggggaaaagttaactctagatccccagaggggtctggtataccacggttctgctaaagttttataaaaaatgtttatagggggagaaggtaatgccggtattgcgtaattataccgaagaagtggtggatgaaatacttcaggaaattttgcccacccaagacgtttgtaagtgtgagcgctgtcttttagacattaaggctattgctttaaaccaactgccgcccaaatatgttgttaccgataaaggtgaagttattacccgtttaaattttaccaaaattgcggaccgcaccgaggttcttacggcagttttaagggcaatagataaagtcaagaaaaacccgtcccattaagacgggttttgttctttttaccccttcccggtcgtaaaattatggtaaaaagaggggagggtgggcatgcgaatctatattttgaaaaaagctttagccctgagctttttaattttaacctttatgctttgcttctattttgaacggaccgtggtggttagcggctacatgaatcccctataccagggaaacccggaaaaaaaacaggtagcctttttatgtaatgtttactggggtgaggaaataattcctgaaatgctgaaaattttagaagaagaacaggtaaagttttccttttttcttggcgggatttgggccaaaaaacatccggaagttgtaaggcaaataaaaaatgccggccatgaaattggcaatcacggctatttacacaaacatccggacctactttcggttaaggaaaatgaggaagaaattctgaaaaccgaaagagttattgaagaaatttgcggttataaaacctatctttttactccgccttacggggagaggggaaaaaatgttttacaagccgctaccaatctcaaatataggacggttatgtggagcattgataccattgattggcaaaaaccggggccgggtacaattattaaccgggttttgccaaatttaaataacggagcaattattttaattcatcccatgccgcaaaccttggaggtactgcccattttaataaaaaaaataaaagctaaaggttaccggatagttaccgttggggaaatcatagattaatattttacgcttatttggcaacaatacaattggtgataatagatgaagagatatttgattccattgcttttatgtttgttaacgttaccggtaaaagtccatggggaaataaaggcaaaagcttattacttttttataccaactactaatcaaatcattgaggccaaaaatcaagactttcccctaccaccggcaagtaccaccaaaattgctaccgctttaacagcattggacctttatccgaggaattttaccttaacggtaaaaccagaagcggtgcgggtaacgggtaccaaaatttaccttaaacccaacgaaaaaatcgctgtaattgaccttgtttacggattaatgttggaatcgggaaatgatgcggctaacgccctggcgtgggttgtaggaaaggaaaattttatgttaatattaaattattatttaaaacaaatgggtttaacctcggtttcttttaaaaacccctccggcctttctgccccgggtcacaaaatttcggcgaaagacctatgcgttttgaccttttacgcattattaaaagatgaatttgccgatatatgtaaaacaaaacaatatgaggcgcaaagtggctttaagccaagggtatttcacaatactaaccgcttgttagctgtcgattcccgggtaataggggttaaaaccggtacaaccaatgaagcgggtaaatgtttagtaggggcctggcggggaaacagtttcttaattggtaccgttttaaattgtcccgataggtttacagccgtgtataaaacttttaaaacaaccgatgaaaagctaagagaaaaagttatctggtccaaaggccaaaaaatgtattttaaaaaaaataactggtggactttaacaaaagacgttaaaatattttctgtgggtaatgaacataagcttgttaaagtagttattgaagacagtgattcctttgttcgggcattattttttttaaatggtgcatttttggccgagcaaaatttacaaaaagtaagatgatggaggtttagtatgatccatgttaccaccttacctaacaaaataaccgttctggtagaagagattccctacattcgttccgcggccattggcttgtggtttaaagttggttcccgtcatgaacgtagggacgaaagcggaatttctcatttcattgaacacatgatgtttaagggcactgttaatcgtaccgcaaaagaaatagctgaatctctggaccaggtaggcggacagttaaacgcctttactaccaaggagtatacctgttactatgcccgggttttagacgagcatacccttttggccttagaaattcttcacgatatggtttttaattccaaatttgccgaggaagacattgaaaaagaaaaaaacgtggtaattgaagaaattagaatgtatgaagatgcgcccgacgagctaattcacgatctcctgaccgaagtaatgtggaacaaccatcctttagggcgccctattttgggtgaaattcaggatatagagagtttaacccgggaaaaagtagtaaattattataaaagatactatactccggataatttaattattgcggtggccggaagggtaaattaccaacagcttttggataaaataatggagttatttgggagtatccagggggaacaaaaaggtgataaaataacgattcccgagtttaatttacatagctttagccgtcgtaaagattccgaacaggttcatttatgtttgggaacgaaaggctatgccattaatgatgatcggatttatggcctaaacatcctcagcacaattttagggggagggattagttcaaggcttttccaagagttacgggaacgacacggtttggtttattccgtttattcttataccacagcttatcaagatgcaggtttatttggaatttatgccggtctcggcccgaataaagtaaatgaagctttagaacttatccaaaagcagttgaaggagttaaaaaccggtgacatttcagcagaggaagtagagcgggcccggcagcaaattaagggtaacctcttactgagcttagaaagtgttaccacgcggatgtcccgtctggctaaatcgtttttatatcatggtaagatcatttctcctgaagaaattgttgaaaaggtttttaatgtttccctggaagatataaaggctatggctgaggaaatttcggatttaaacaattttaccaaagtttcaataggtccgtgggaaggcttttaatttaggttctaaggcttttggggcaggcataaaataaaaccggaaggggacctttatgcttgcctttttacttattttaattatttttttattttttttaaggcagtataaacgaggtataaggagtgaatttagattaggaagttccgtaaaacagcttttaaccggtgcgggggcgatatatttaagtcttgatgcaaccctaaaatttctggggataaaaattcccgaaaaaattgtcataggtgatgttgccttaaaaccccttcctgctgtttctttgcttcttgctttattagaaccggttggggagggaattgtaaatgcgcttagaagagcttgccggcaaagaaataattaacgttaaaaccggaagccgccttggagtagtggagggagtggattttcatattataccagaaaccggtgaaattgttagtgttatcatgccggggaaaggggggattttttccttttttaaagaaaatataccaaaagaaattccctggcatgcggttaaattaattggtagcgaagtaattttaattgaattagataatacatattaaaccgggaagaccggtttttttcttgacagaaagggcatttaaatagaaaataattaaaaatgtgtttttatacaaattaaggaggatttttatggcgcgaatagttatgcttggggcttgtggtaaaatgggaagagaaataagtaaaaaccttctaatgcattccgaacatgagttagttggatttgttgacgtggtaaatgtggggcaggatttcggtgaaattttgggtatttcccggttgggtaaaacggtggaggataacctaaaagaggtaattttaaaaacgaaccccgagattgttttggatttttcgcgggcttccggagcatttactaacattttaatagcgttagaaaacaaggtaagagtggtctcgggtactaccggtttttcccaggagcagattaaaaaaattgaggatgtgagtaatgcaaataacctgggttgtatcatagctcccaatttttctattggtgccttattattgatgaagttggcgcaaatggcagcaaaatatttttcccatgtagaaataattgaataccaccataatttaaaagttgatgctccatccggaactgccataaaaactgcagaactccttagctctatccgggaaaatcagcccagcgcaattcaagaagaagaaaaaattcccgggagccgtggcggagactacaggggtataaaaatacatagtgttcgtcttcccgggttagttgcccaccaggaggtaatatttgggggcagaggccagagtctaacgttgaggcatgatgtttacagccgggaaagctatttggatggaatcttatttgctcttaaaaaggttttggaattggataggtttgtgtttggtctggatgaattattgttttaaactttaggacaagcaccgcccaactcccatgttcatatactgctattagcttttaaccactgggggttggagcgatgaaacaggtcttgctgggaattaatcttacaattttaggaggggatctccgaaacgtttatttgattgacgagttagaaaaacttggagcatttattaaagtcttaggtttaccggttgcccgccgttcgaaggtcgttttatgtcattccttagaggaagcgctcaaagatactgatgtagttgtattacccatgccgggggtaaatcaccaggggaagctgtttgcgcctctttgtgaggaaagttattaccttactccagaactcaaggacagcattaaaggagaggttttatttgtcgttggctttgccaacagctatttaaaacaattggcggcggatttgggtgtagagcttgttgaaattgccgaaatggaccatgtggcaatttataactccattccctcggccgaaggggctatccaaatggccatggaaatgattcccataaccatccatggaagcaatgcttttgttataggatttggccgtaccggtcaaactttagcccggatgttagctggaattggggcacgggtatttgtggcagcccggaaacctaaggatttggccaggatttatgagcaatgctatattcccgttacctttaaggagttagaagtaaaaattgtcgaggcggatattgtctttaataccgttcctgctctggttttaccggcaaatttactgcaaaaacttaagaaagatgcggttataattgaccttgcctccaatcccggtggagttgattttgaagcggcaaaatcccttggtatccaggcggttttagcaccgggacttcccggtaaagtggctcccaaaactgctggaaaacttttagccaaggttttacctgaattaatccttaagcactgtaaggtgcgggattggagggatttgggatgattaaagttggttttgcttttactggatctcactgtacattacccggtttactcggggttttggaaaaattggccggaaaatttgatattactccgattttttcggaaagtgtacaaaataccatttcgcgttttggtgacgggaaagaattcatgcaaaaagtagaaagcattaccgggaaaaagggtataacaaccctaacggaagcggagcctatcggtccgcaaaaactttttgatgtattggtgattgctccctgcaccggtaatactatggcaaagctggccaacgggataaccgattcggttgtgttaatggctgctaaagcccacttaagaaaccaaaagcctttaattttagcaatatccaccaacgatgctttgggtatgaatgccaagaatttagggttattattaaatgcaaaaaatatattttttgtaccgtttgggcaggataatcccaaagataagccgaattctttaattgcaaacttaaattacttagaagacactataaatgaagcgttaaagggaagacaaattcaaccaatgcttattacctattcttaataacaaatttggaggtgttatttttgagctataatgtggtagtaattggagctaccggtgcggtaggaggagaaattctaaaaattttagaggaaagaaactttcccgtaaaagaacttcgactgggggcaacttcccgttctgccggtaaagaagtggtttttcggggagaaacgtataaggtgttagaaacaacaccggaaatatttgatggtatggatattgccttatttgccgggggttctgccagtaaagaatttgcccgcattgctgcagcaaaaggggtaacggtaattgataatagcagtgcttttcgtttagagccggacgtaccattggtggttcctgaagtaaatcccgaggatgttaaatggcacaaaggtataattgccaatcccaattgttcgacaatccagatggttgtggcgttaaagcctttgcatgattatggaaaaattaaacgggtggttgtttcgacctatcaagcagtttccggtgctggcattgaagccatagaagaattaaagcagcaggttaaggcgtatttaaacggtgaagaggcggtacccaacgtctttccgtatcctattgcttttaatttaattcctcacatcgatgtattccaggatatgtattatacaaaagaagaatggaaaatggttttagagacgcaaaagataatgcatgatccggaaattaaagtaaccgccacaactgtaagggtaccggtctttagaagtcactcggaaagcattaacattgaaacggaaattaaaattacccgggagaaagctattgagcttttgaaaaaggctccgggggtaaaagtaattgacaatcctgaagaaaagctgtacccaatgcccttgtatgcctcggaccaggatgaggtttttgtgggaagaatccgggaagataatacaatttccaatggcttaaatctttgggttgttgcggaccaattacggaagggtgcagctacaaatgctgttcagattgctgaactactaataaagtacgggtgtgtgaagcaaaatggctaaaaagtttatcattttaaagtttggcggaacaagtttaaagacggcggaactccgggaaaaggtagcccaaaaaataattaatacttttgaatctggctatcaaccggtggtggtggtatcggctattggccggaagggcgacccttatgctaccgatactttgttaaactttgcctacgaggtaaatcgggatttgccacctcgggaagcggatttattaatggcgtgcggggaaataattagcggtgtaattatggttaataccctggccaaaatggggtataaagcaaaactgtttaccggtgctcaggctggaattatcactgatgataactttacctcggcatcgattttaaaagttaaagccgataagattttaaaagcggtggatgaaggttttatccctgtggtttgcggatttcagggagtaacggaagacggcgaggttaccactctgggacggggcggaagcgatactaccgctgcggctttgggagttgctttgaaggccgagtttattgatatttacaccgatgtggaaggaatcaaaacggccgatccgcgaatagttgaggatgctaaaaccttagaggtggtgacttataacgaaatttcccagctggcgcatgaaggggctaaagttattcatccccgggcggtggaaattgcgatgcaaaaaaatatccctctgcgcattaaatcaaccctgaccgacggtgaaggaacacttgtcacctcccacgctgaagtttacggcgaagtaattgaagtaattcgggaccggattataaccggtattgcccatattcccggggtaacccagataaaaattttaagggaagataccccggaaattgtgaatttagcccaaaaggtgtttaaaggcttagctttggcggaaataagcgtggattttattaatataagtcccgagggcttggcgtttaccgttaaaggggaagtgacggaaaaagcggtggatgttttagaaaatatgggttttaccccgagaatacgccgaaattgtgctaagatagctgcggtgggggccgggatgaccggtgtgccgggggttatggctaaaattgtggaagccttaacgcgggaacaaattgaaattctccaatccaccgactcgtacactaccatctgggtactggtggatggggaaaatatggaaaaagctgttagggctattcacaaagcttttaaactaaacgaataaaaaattaaaagaaggtgaaaagatggcagtgtttggacgattgttaaccgctatggtaaccccttttgatcgggatgggaaggttaacctggagcaggcacaaaaattagccagtttcttggtggaaaacggttctgatggtattgtggtggcggggactaccggtgaatcaccaactttatcctttgaagaaaaagtagacctttttaaagctgttgtcgaagcggtaggtggaaaagcagcagttattgccggaacgggatccaatgcaacggaagcttcgattaaacttactaaagctgcggaaaaggtcggagtagatggggttatgctggtagctccgtactataacaaaccttcccaaaaggggcttgtcgaacattttcaggcgattgccagagccaccagcttaccggttatgatttataacattcccggtcgcacaggggttaatatcttacccaagacgatggctaaaattgccgaactggaaaatgttgtagcaattaaagaagctgcgggaagtgttgatcaggcaaccgaactaataagaattttaccggaaagggtaaaggtattttccggagatgacagcttgaccctgcccattttagcggtgggaggttacggagttgttagtgtggcaagtcaccttgttggtctaaaaataaaagaaatgatcgatcagtttcttttaggaaatgtggcggtggcagctcgcctccaccaggagctttatcctttaattaaagcattatttataacaactaatccggtaccagtaaaaactgcgctgaatttaatgggacataaagttggtggttttagacttccgctggtggatatgaccgaggaggaaaaggaggaactggtacgggaattgaaaaaccttaatttgttgtaaattaaaaaatctttggggaaggctattttcacttgtccttcctttttttattttttataattacaatagattgtaaaaagctaacaaatgggcggtttaatataaatcaaaaattaagcaggaggtgtattgccaattaaagatggaagacttcaaattataccattaggcggccttggagaaatcgggaaaaacatgatggtcatcaaatataacgatgccattatagtgatcgatgccggactgatgtttcccgaagaagaactgttaggtattgacatggttattcccgacatgtcttatctcatagaaaacaaagaaaaagttaaagcggtgcttttaacccatggtcacgaggaccacattggtgggatgccttattttttgaaacaatttgatgttccggtttacggaacaaggctgactttggggcttttaagtgccaagcttaaagaagcggggattcccagagccagcttaaatgttgtggctccgcgggatgttttaaatattgggccgtttaagattgaatttatcaaagtttctcacagtataccggatactgtaggaattgcggtacatactcctgtggggacagtagtccacaccggcgattttaaactggatcctactccagttgatgggaaggttacggatttttataagttagcggaacttggagaaaaaggcgttttagttttaatgtcggacagcaccaatgccgaaaggcccggctttaccttgtcggaaaaaaccgtgggtaatacctttgaagaaacgttcagggtggcggaaggtagaattatcattgcaacttttgcctcaaatgttcatcgtttgcagcaagcaatttataccgcccataaatttaaaagaaaagtggccattgttggccgaagcatgttgaatgtggtagaaattgccaacgagctgggctatctggatattcccgatggactgttaattgatgtggatgaaataaaccgctaccctcataaacaagtcgttatactaactacgggaagccagggagaaccaatgtcagcgcttacccgcatggccatgtctgagcaccgtcaggtggaaattgtagcaggagatacggttatcatttctgcaatgccgattccgggaaatgagaagttggtctccagaattattgaccagttatttaaattgggtgccaaagttatttacgaggcggtttcagggattcatgtctctggacaccccagccaggaagaattaaaattaatgatcaaccttttaaaaccaaaatactttgttcccattcacggagaataccgccatttaattaagcatgcggaaattgcgcgggagttaggcataaaaccccaaaacatctttgtggtggagaacggtcaggttttggaattcacgaaaaaatccggacgtcttgccggaaaagtaccggccggccgggtattggttgatggactcggagtgggggatgtcgggaatattgtgttaagggaccgtaaacaactggcccaggatggtattattattgtcgtgcttactttaaaccgggagtccggagagattgttgccggtccagacattgtaacccggggatttgtctacgtccgggagtcggaacagttaatcgatgaggccaaacagaaggttaccgaagctttaaataaatgttttaatcacggcttgttagagtggtctgccataaaaagtcaggttagagatgcgttaggaaaatatctatttgaaaagacccgccgtcgtccaatgattttaccgattataatggaaatttagaaagggagaggacattgaactcatttcaagctttaattttaggacttgttcagggtttaaccgagtatttacccgtttccagttccgggcatttagttttattgcaaaaaatctttggcttaaaggaaaatgtcttgctctttgatattttggtccatttaggaactcttgttccccttttaattatttttcgcgatgaaattttggcgattatcaaaaaaccctgggggcgattacctcttcttataattgccggtaccgttcctacagctttaattggccttggatttaaggacttctttgaacggctttttgtctcaggttctactttaggaattgaatttattattaccggactaatcctgtggctggccgaacggcagaaaagcggtcgaaaaaatctcgaaaaaacaacttttttggatgcaatttttgtaggtgtagctcagggattggccattttgccggcaatttcccggtcggggttaaccatttccggggctttaataagaggtttaaaccgcgaatgggctgcaaaattttcctttttactatctattcctgccatcttgggagctgcagttttggatttaaaaagttttgtcgagcaaaacgcaaatttagcggggattgatttgatgccgtttattgttgggttttttgcagcaatgctttcaggatactttgcggtaaaatttatgttagagatcttgcgtaaaggaaagttaacctggttttcctattacgtctggattttgggagtaacaattttggtgttacaggcggcaggtaaattttaacctgccgctttttggagggattgaatggcaaaatacaagaataccaagcagaaaaataaaaaaagttttaccggtgaattgttgggaatttttttaatgctcttgggaatgattggagtcgtcagtattttctcggataaaaccggctcgataggattgtttttccggcactggtttaccgtttttgccggtcaggggagttttcttttaccattaattatttttgctattggttttaaactttcttttggtcatactattaaacactttggtaaaaaagaagcgggtttacttgtcctcgtggcagcatttttgatttttttaacgataaaactaccgttaagcgtaatgtttaccatggcctggcagggtgacgggggaggagtaattggggcgctcctaacttatggtgccttaaaatctctgggattagtaggcacctaccttttgctcctaacccttattttaattggatttttactaattttggatttatcttttaaagaatttatgcaaaatctcattggcggtctgaataaaataaaggcttttgtggtggaaagcatctttccgttgtttattgaggaagaagaactcaagcccaaaaagcaaagaaaagagcccgtaattattgagatgccgccaccgcctgaacctgtttttaattttcaatcggaaagctttccggtccatgtagaggcagaagaaagggctgcccaaaaggagaaagaaaataagaaaaccataaaggaaaacgacgaaaatataacttcctttgaacagctaagtcttaaagattttgaaaagtaccaactgccaccaatatctctgttaaatcggcctaaatcatcccgcaatcaaatgaatcgggatatttccgagaatatcaaaatcctggaagaaacccttgaaagttttggggttcaagccactgttaaggaagtttcctgcggaccggcgataacccgctatgaattggaacctgccccaggggttaaggttagtaagatagtaagcttagctgacgatattgctttaaaattagcggcagcggatgtcagaattgaagcgccaattccaggaaaagccgcggttggaattgaagttcccaacaaagaaataaatatggtggtattaagagaaattatcgaaactcctgaatttcagaatcaagcttcaccccttgcttttgccctgggcaaggatattgccggtaaaccaattgtggccgatctccaaaaaatgcctcatttactcattgctggagcaacaggatcggggaaaagtgtttgtttaaataccctgatttccagcattttattccgggcaactccacaggaagtaaagtttctgatgatcgacccgaaaatggtcgagctggttacttttaacggcattccccatttaattagcccggtagttaccaatgccaaaaaagcagccatttctctccgctgggctgtgagagaaatggagcggcgctatgaactttttgccaagtacggagttcgggatataacgcgctttaacagcttagttttaactaaaggtggcgaggatttaagttatttgccttacatcgttattattattgatgagctggccgatttaatgatggtttctccagcagaagtggaggattctatctgccggttagcacaaatggcgcgagctgccgggatgcatttggttgtagcaactcaacgtccttcggtggacgtaataaccggtttaataaaagccaatattccttcacggatatcgttcgcggtttcctcgcagaccgattcccgtactatcttggacatggctggtgcggaaaaacttttaggaaaaggagatatgctgttttttccggttggcgcctccaaacccattcgcgttcaaggagcttacatgtccgataaagaagtggaagcggtggtggagttttggaaaaaacagggggaccccgaattttcgtccgagttcgagcaggaactggatgtcgaagaagattcacagttggaagaagacgagttattgccgcaggcggtgaaaattgtcatggatgccgggcatgcctcgatttcccttctccaaagacgtcttagaattggatatgcccgggcagctcgtttaattgaccaaatggaaagaaaaggaattgttgggggctatgaaggaagtaaaccgcggtctgtgttaatttcatacgaacaatataaagaaatgtttaaggacctttaaaggaaaaaacctttaaaggtcctttttttgtataaacttaccgtaaaataagaaaactatgattacaggtggtgagaaaatgacaaaaactaaaacaaaactaaaacttatagcggtagtagccctggtaattttctgggcgggtagcgtaacttactattacaatcaggttttggccgccaagccgaaagcgtacacttattcgggaattagcgatctttatcttttagcccggattattcgggcggaagcggaaggggaaccgtatgcaggaaaggttgccatagctgcggttattttaaaccgggtacggcaccccggatttcccaacaccattgccggggtaatttttcagcctggtgcttttgaatcggttgccaacgggcgtttttggtcgctactgccgaaccgggaaagtattaaagctgcctatgatgctctgcgcggttgggatccaacatatggtgctctatttttctggaatccggccaaaaaggtttcccggtggatttggaccagaaaaatcatagcaaggattggcaaacatgttttcgggagatgatggaatgaaaaggactattgccgttatcctgggcagtttattgttagtaggtttatttatctggggttacgatcaaagtcaaaaaaagaatcggctttactgggaattaaatagtcagtaccgtagggcttttgaagaattatacggacacagtaaaaccttggaagcccaggtgggaaaaacattggtttccatgtcactgcagcaaaatttaaagcaggcggccaaggggtggcggcaggcttatgctgttgtggaagatttgggacaactgccggtaactactttttccctggaaaaaacaaaagcattttacaatcagcttggagactttacctataccgttgccattaaagataccgaaggtaaatcgttgagccctgaagaaagaaaaaccctggcaacctactataatgagctgaaaaaaattaacaataaactggaaaaagcggtagatatcttaaaaaatcaaccgattatgataactaaagaaaccaaactatattccctccgggaagatttgatgccggaagcgatagttaatgccttgcgagatgtggaaaacaatgttttagatctgagaaataaaaaggttgcttacgaaggtgattttgtcaacattaatccctaccctttaggaataaaaggtaaaccggtttccatgattgaggcgaaaacaataattaaagatttcttggggcaggaagctgctggcaggatgattttgccggttaccagggtcaatggtttaattccgacgtatttgtacgaagtgatcgaccgtcaagctaaaacgaaaatttattataatgtttccgttaacgggggcaaaattcttagctttttgactacaaggccaacctcttctccttctttaacggttaatgaatgcgttcaaaaagcaaaaaaatatcttcttaagttcggttttggaaacatagagcccacggagatagataaaatagataacgaattaagtattacctttgttagtaaagtaggtgatatattatattaccccaaagttattaaggtaaaagtgggaatggataaaggagatgttacggcttttgaaggaacccagtattacatgtacgataggccacgaccgcttaataaactccttttaactgaagctaaagctaaaaaaaatattaacccgcatttaaagattttacgaacccgcaaagccgtaattttaaatgacagaaaccaggagatcttaacgtacgagtttttaggtgaattgctgggggaaaaatatttaatttacgtaaataccgaaacgggtaaggaagaaaagattgtgaggttaaaggaatttaaaataactccggcaaaggatgcggaaacggtttttaactacgaataattcaccgggcggatgcccggtttttattattgaccggaaaaattgccggtgttatacttaatcgagactctttcattagcttacgggtgatactccatgaaaagcgtaactttttccgacgtaaaaaatttaaaaaatccggtgtttgttgatgtccgttctcctaaagagtttattgaggatcacattcccggcgccctgaatttaccgctttttagtgattgggaaagggaagttataggtaaaatatataaatttcaaggcgtaagccaggcaaaattagcaggattaaattttttatctccaaagcttccccgcatggtgaatgaaatccttaaatataaagaacagggagatgtcgtaatttattgctggcggggaggtttaagaagttttgttttggcagaaattctgaggatggttgatatctatgtttaccgtttagaagggggctataaaagttaccgcagagaagtagttaaattctttgaaacagttgaaaatttgcatcctattgttctctacggaatgaccggggttgggaaaacaaaaattttagaaaacttacaacggcaaggattaccggttttaaacttagaaaaacttgccaatcaccggggttcggtttttggacatttggggcttgagccccagccctcccaaaaattttttgaatctaaattatacgaagttttaaaggatttgcagggaatcccctttttaacggaaggagaaagccaaaagatcggaaaactttttattcccagaggattgtttaaaaagatgcagaaagcaccggtggtattgttagaattgccggaagaaaagcgtattgaaaacctcatgtttgaatataaagcggaaaaaattgatattgaattgtttataaaagctttgcaaagtattacaccctatttgggcagagcaaaggtggaaaagcttatagaagatttaagaatgcgaagattttatgattttactaagactctgcttcttgactattatgaccctctttataaaaaatccacggcctatttacaaaatataaaaaaggttatttccggaaaagatattgatgaactaaccgcaaaagtaggggaattttggagggaagtggcaggagggaaacaaaaatgattggggaaaaattaagaaaacgccgggaacaattaggtttaaccataaaacaagtggaagaagagattaagatccgtagtaagtatctacaagctttggaagaggaaaggtttgatgaacttcctgggaaagcttatataaaaccttttttacaaagctatgcccgctttttaggtgtaacgatcgagcccgaagatttgccaacaatcgtggtaaatacagagcaatctatctcggagcagacaaaacaagttaaggcttttaaagaagaaaaaaaattttttctaccattaaaaactgtctttattacgttgttctttcttattataaccagtgccttggtttatacttttataagcggcagaataaccaaagaacccagtaaggccatcaaacctcctgttcccggtaaagtttatcaaaaacaaagccaaagggtactgccggtgaaaagctttgaaaaaacgattattgttagggccgtttacgggccttgctggttagaagttaaagaagaagataaggttgtctttacgggtaaaatcaatcctcctgccgaaaaacaatttatttcgaccaaacccgttaatataaaatttggcaatgccggagcggtagtggtaactgtaaatggagtgacctacggaaccccaggaaagatgggccaggtggttaaaataacatattaagggtaagaggtgaaagtagttgaaatattttatcctttccttgggctgtaccaaaaatcaagcggatagtgaagtaataatgggaatcctggaaagtaaagggtatgtgcgctctttaaatccggaagaaagcgatttattaattgtaaatacctgtggttttattgctgcggccattgaagaaagtattgaggaaattttaaatcttgttcacctgaaaaaacccggacaaaaaatcctggttgccggttgtttggtccaaagggagggtaaagagttagcaaaacatttaccggaggttgacctattttttactccccgggaaataaataaccttgataaacttttagctgatttaggagaaaataataagttagttttaagcgagccgggatttttaaacttggaaaaaaaaccgcgagctaaaagcaatgaggtctatcgttatatcaagattgccgatggctgtgataaccgttgtacctattgtactataccggcaattcggggtaaatacaccagcaggccgcttgatgatattttagaagaaattaaagataccctaaaacagggaattaaagaaatcattttggtagctcaggataccaccgcgtacggtattgatctttatggggagtttaaattggttgaacttttaagaaaaattggcagcattaaaggaaatttttgggtaaggttgatgtatctttatcccgataaaattactcccgaattaattaacgagattaaagaaaatcccaaggtaattaagtacgtcgatgtaccgttacagcatattcatcccgaaattttaaagaaaatgggaaggaagggaagtagtgaagaaattatatcaaccttagaaaggctccgaaaagaaataccggatataactataaggactacctttatagttggatttccgggagagacggaagaacagtttaactatcttttagattttgttaaaaagtttaaatttaatcgcctcggggcttttccctattatcgcgaaaaaggtactcccgcagcaaaaatgaagggccaaataccgaaaaaagttaaggagcaacgttatgagaaattaatggaggtgcagcaagagatttcccttaacttaaacaaagctttggtaggcaaaaagattcccgtcattgttgaaaaaaagataagaggagaaaacctttaccttgggcgaacctatatggatgcccccgaaattgacggaataattgaaattaaagcggaaaaaagattgaaaaagggtcaaattattaatgttttaataaccgattatgatatatacgatttaaaaggagagtttataaatgattgataatactttattttctttggcccaagaagtgcagcggttgtttattgctaagaatttaactttggcaacggctgaatcgtgcaccggcggacttttaggagcggtaattactgctgttcccggaagttctcaatattattttggaggggcagtagtttatgccaatgaagccaaagaaatcttaaccgacgtggataaagaccttttacttaaaaaaggtgcggtaagccccgaagttgctcaaggcttagcgttgggaataaaaaataagcttaaaacaacggtaggagtgggtatcacgggaattgccggaccttctgggggtacaccggataaacccgttggcttggtatatatcggtattgcgaatgttcaggatgttaaagcttttaaatatcaatttaacggtgataggcaggaaattagaacgcaaacggtaaaggaggcattaaaacttttaattcaaaattgttttgacaattaaaccggcgaaaagttataataaacacgaacaaatgttttatggagggagcttttatgaatgataaactaaaagccttagagcttaccatttcccaaattgaaaagcagtttgggaaaggctcaattatgcgcctgggtgaaaacaccggaaaatttcaggtggaagtaattcctactggttctctggctctggatttagccttaggggtaggtggagttcccagaggccgggtggttgaaatttttggccccgaatcttccggaaaaactaccgtggctttgcatattatagcggaagcgcaaaaaatgggtggtatcgcagcatttattgatgccgaacatgcgttagatccggtttatgcccaaaaattaggagttgatattgaaaatctcttagtttcccagcccgataccggcgaacaggctttagagatagccgaaagcttggtgagaagcggtgcgattgacgtgattgtgattgattcggtggctgctttagttccgcgggcggagattgaaggagaaatgggtgatgctcatgtcggtttacaggcccgccttatgtctcaggctttaagaaagctcaccggggccataagtaaatcaaaaactgtggcgatctttatcaaccaaatgcgggaaaaagtaggggttatgtttggaaacccggaaactactcccggaggacgggccctgaaattttatgcgtcaattcgcatggatgttcggaagatagatgtcataaaacaaggaaatgatattattggcagccgcacgcgggtaaaaatcgttaaaaacaaagttgcccctccttttaaacaggcggattttgatattatgtacggggaagggatttccaaggaaggaagtttgttggatgttgctgttgagttaaaaattgttcaaaaggtcgggtcttggtattcttacaatgatgagcgattgggtcagggccgggaaaatgccaaagagtttttacggcagaacccggaaatttacagagaaattgagcaaaagatccgggagcaagtattgaactctccagaatcgtcgagttttaaaaattccgaggagtttgaggaataattttgagtagtcgggcttaccaaaaagccttaaactacctttcccgtgccctgcggacaactgcagaagtgcgccagtatctttcaaaaaatggtttttccgatgaagaaattgaagaggcgatttccaggcttactgctatcggttatttagatgacaaacggtacgtggaaaattatcttttaagtggaaaggctttaagatacggaatataccgaataaaatctaagcttttgcaaaaaggaatagatttggaacttttaaataatttgccggtggacgaagaggaggaagttattaaagcaaaggagattttattaaagaagtataaacagcttgacccagaggattatggcaaatattaccgatttttggtgggacgtggtttttcgccggcggtggcgcgaaaagcagttttcttgacagatgataaggagaacgggtaaaatatggataggtgaaagtagaatgggacctgccgattggttttggcctgttggtaggtttcttattctatttcagccgagtagaaactcggttttttttattagctacccgatagtaaggaggtgaaaaattgaatttaataaccgacataattattgctgttgctggagttggggttggggttgctgcaggttatgttatcagaaaaaacattgctgaggcagccatcggttccgcagaagctcaggctaaaaaaataattgacgaagcaacaaaagccgctgaagccaagaaaagagaagcggttttagaagcaaaagaagaaattttaaaaatgaaaaatgaagtagaaagagaacaccgggaaagacgccaggaattgcaacgtttagagcgcaggcttctttccaaggaagaaaccttggatcggaaaatagaaagttttgagagaaaagaagagcagttagccaaaaaggagcaggaaatagagaatttgcggcaaagcttagaggagacgctgcaaaaagaattggctgagttagaacggatttcgggactttctaccgaggaggcaagggagctccttctaaaacaagtggaagaagaagttcaacaagaaatggccttattaatcaaggaaattgaaacaaaggccaaagaagaggccgaaaaaagagccagggaaattattacattagcaattcaaagatgtgctgctgatcatgcggccgaaaccacagttacggttgttgccctccccaatgatgagatgaaaggaagaataatagggcgtgaaggtcggaacataaggacttttgaatctttaacgggtgttgatttaattattgatgatacccccgaggctgttattctttccgggtttgatccaatccgccgggaaatcgcccgacgagccctggaaaagttaatccaggatgggagaattcacccggcgcgtattgaggaaatggtggaaagggctaccaaagaagtagagcaagatataagggaagctggtgaacaagcagcttttgaggttaacgttcacggtttacatcccgagattattaaactacttggtaggttaaaatttagaacaagttacggacaaaatattttaaagcattctattgaggttgcccacttagccggcttaatggctgctgagttgggagctgatgttgctttagcaaaacgggctgggcttttgcacgatatcgggaaagccgttgaccatgaagtggaaggatcccatgtggaaattggggttgagcttgctaaaaaataccgcgagcatccggaagttttacatgcaattgccacccatcatggtgatgaagagccaaaaacagtggaagcagtacttgtgcaagctgccgatgccatttctgccgcaagacccggagcaaggcgtgaaactttggaagcctatcttaaacggctcgaaaaattagaaggaattgctaatgagtttgaaggtgtggagaaatcttatgctatccaggctggccgggaactaagaatcctggtaaaacctgaaaagatagatgacctggcttccgttcgtttagctcgggagattgctaagaaaattgaagaagaggtggaatatcccgggcaaataaaagttaccgttatacgggaaaccagggcagtcgattacgcaaaataggcaaaaaaacgacccgcaggggtcgtttttaattatagaaggaaaaaatggttttgtggtagaattaatttatggtgggtgagatagcaatgaaaaatcctgcgaaatccgttaaaaatgaaaccattgtaaatcttctcacatcaatcttccttttacatcccgagctggcagcgatacaaattgattccaatgccaagcaagttaaattaaaatactttattgaaagccagaaagatgttacccaaaggcttaagaagaccgagtatttatggaaaagttatttagacttaaaaaagatggggaaatatacgttagagataaaatgcagttccctggaaaactatgttatgatagaagtattcagggatttaaatacctttcatttaggggaattaaattttgcagttcaggtgggaaaagggttaggttttaattaccttaccgatgaatttaacgatgttcttgattttatcgaagttgacgagcagcatataagtttacttttagaaaataccaaacgaagtttttataacacggtatttgcgttccgtgaggaaggaagagttgtgatagctaattagaaacggaggatatggctttgaatattttaatactcggggatatagtaggacgggtgggacgccgaggggttaaagaggttattccccggatactggaaaagcatatggtagattttatcattgccaatggggaaaacgcggcgggaggaaatggtttaaccccggaaattgctcaagaactatttgccgcaggaattaacgttttaacgatgggaaaccacacctgggataaaaaagaaatatttaccataatcaatgatgaagcgcgcattattcgtccggcgaattaccctcccgggaccccgggacaggggtatgggatttttagggttaatgggaaaaatgttgcggtagttaacttaatgggacgggtatttatggccgagttggactgtccctttcgcaaaatggacgaaatacttttagaactgcaagatgttgattacataattgtagactttcatgccgaagctacttcggagaaaatagcccttggctggtatctggatggcagggtttctttagtttttggcacccatacccatgttccgacggccgatgaacggattttacccgggggaaccgcctatattaccgacgtggggatgagtgggccgttaaattcggtgattggagttaaaactaatttggtactccaaaagtttttaacgcaaatgcctcaaagatttgaaagtgccagcggtccctatattgtttccggaattttggtatccctgacggaggatggtaaagcagagaatataacccgtattcagtatattgagggagagtaaaggggaaattcccagtaaaaatttaaaaaaaatttaaaaataaaaaaggaaatttccctaaaatagcgaatatattgatataccagatatagtaaaatatacaaactaaggaggtttgctaatggaagtgttgaaagtttcagcaaagtctaatccaaattcggtagccggtgctttagctggggttatccgggaaagaggcagcgcggagttacaagctattggtgcaggggcgattaatcaagcggtgaaagctgtggcgattgcccgtggttatgtagcgcccagcggcttggatctggtatgcatccctgccttcaccgacatcgttatcgacggtgaagaacggactgccataaaattaattgttcagccccgttaaaaagttttaagtgaaatgcctgtttatctttacgatagacaggcatttattctttctaaggagagtgaaatgattgatgattatcgactgtcatctggattctttagtattttactataataagggtttaaatttttttaaggaaattgatccagaagctcaaaccagctggagaagtttaaaagaagcagacgttgtaccatttttagctatctacattgaagaaaaatttaaacccgatggagcctgggaaagatttatccagatctataatttttatcagaattatttaaatagcttgtttaaccacgagaaaacttccttttacttaagtgtggaaggtggggaagtaatagataatcttttgcgaattgtacatttaaagcaactgggggtagcttctcttacccttacctggaattataaaaatttaattgccgacggtgttttagaaaataacccccaaggccttactacttttggccggaaggtggtgcgggaattaaacgagaaaaaaattctgatagatgctgcccatcttgctgaacccggattttgggatttaatagatttatcggaaaaaccttttattgtctcccatgccaactgccgaagcctttgtgaccatccccgtaatcttagcgaccggcaaataaaagctttagcggcaaaaggcggggtaattggaattagctttgtcccggactttatatctgccgaatttcccaccttagaaaagttagtggcccattttatccacgttgctgaaattgcaggggttaatgtattagcaattggttctgattttgatggaatggagaaaagagctgaaggagtagaagattgtagcaagtacgaaaatttaaaggaagcgttactgagggccggatttttacccggtgaggttgaaaaaatattttaccaaaatattgatagagttttaaaagaagtgttatattaattttaaaaattaaaaggtgggtaggggatgaaattttcaaccggtatttttgacgaattatcgatgctgattaaaaaagtatctaaagagcgcgacgtgataaatttaagcatcggaagtcccgatttaccgccacaccctaaaataattgaagtgttggccaaagaggtacaggatttccaaaactatggatataccttaaatccaggcttagaggaattaagagaaggtttaattgcctggtatcaaaaaaagtatggagttaatttaaaaattgatgaaacccttgtattactcggctcgcaagagggcttggctcatttacccctttctttcttgaatccgggagatctggtgttagtaccaaatcccggttatcctatatatgaagcggcagcaaaacttgcgggagcaaagatttattattaccctttattagaggaaaataattatcgtttggacattgaaaagattccttatgatattttacggacggcaaaaattatttttcttaactaccctaataaccctttgactgccatggccaattacgaattttttgaaaaacttgtattttatgccaaaaaatatggttttatcttagttaatgatttggcttatggagaattaacttttgatgagaccagaagtattagtcttttagaaattcctgaagcaattgacgttgcagttgaattttattccgtttcaaaatcatttaatttagcgggaatcagggtaggttttgctgccggtaatcaaaaggttatttccgctttaacaatattaaaatcaaatattgattacggcgtttttaagcctttgcaaaaagcggctttagaagcgtttaagcttagagaggttattatcccggatttagttaagacttatgaaaaaaggagaaatgttcttattaaaactttatccgagtatggctggcaagtaaaacctcctttagctacaatgtttgtctgggcccagcttcctgatggaataaaagattcaagaaagttttctttagatcttctcaccaatgctggtgtagcagtaactccgggtatcggatttggagacctcggtgaggggtacgttcgaattgccctggtggcggacgaggataaacttgcggaagcaggaaaaagaatcggtgaatatttgcagtacaggagggtagtatgagaattgcggttattgatggtcagggcggaggcattgggaagtacattattgaaagaatacgtaaagcttttggccaggagattgaaataatcgctattggaaccaacagtcatgcaacttacagcatgttaaaggcaggagcaaatgagggggcaacgggcgaatctgctcttatttataatttgtcccgggttgacatcatcttgggcccgattggaattgcttttccctacgggatgcttggggagattacaccggaaatggcaaaagctttttccttggccaatattaaaaaaattttgttaccactggcccgggaaaattatttatttgcgggaattggtgacctgcctcttccccatatggttgatgacttgttagaactcttagccaaagaaatacaaaaaagaagtggtaattagctaccacttctgttgtaattgctgttctgccaaggcaattaatttttttaccatgttaccaccaatttttccaccaagccttccaccaacccggccgcattcccgggatggaacttcaccccagtagccgtctttaacttggtcataaataccgatttccctggcggcttcgattttcattttttctaagttttgtctgtaggtggtgtcgtcggtgccgatgcccagttccccggcaacctcatatttaagtttttccaatggtgatttcaccactgtcaccacctccaattatattttttgtcaaattaaaataattattcgaacaattattggggtataagtataaattttgcaaaattgataaaataatgaaagaggaggaattagaatggagtcaaaaatagttaaagaaggattaacttttgatgatgtacttttgattcctgcaaaatcggaagtattacccagagatgtggatactactacgcgttttacgaaaaagatcaaattaaatattcccatagttagtgcaggtatggatacggtaaccgaagcgcggatggctatagctatggcccgggagggaggaattggggtcatacataaaaatatgtctattgaagagcaagcgatggaggtggataaagttaaacggtccgaacatggaattattgctgacccaatatcgctgtcgccggagcatttaattagagatgctttggaaataatggaacggtaccatatttcaggagtacccattaccgttgagggaaagctggtaggaatcataaccaatagagacttacgctttgaatcggattacagcaaaaaaattgctgatgtcatgaccaaagataatttaattaccgcaccggtaggaacgagtttaaaagaggcggaaaaaatactgcaaaagcataaaatagaaaagttacctttagtagatgaaaatttccatttaaaaggcttaattacgattaaagatattgaaaaaacccggaaatatcctaatgccgcaaaagacgaaaaaggaaggttgcgggttgcagcggcggtcggggttagtcgagacatgatggacagggttaaggctttagttgaggctaaagtcgatgcgattgtggtggatactgcgcacggtcactcccggggtgtattagaggcagtatataaaatcaaaagcaaatatccagaagtggaattagttgccggaaatgtggccactgctgaagctaccgaagatttaatcaaagccggtgccgatgcggtaaaggtgggcattggtccagggtcaatttgtaccacccgggtagtggcggggattggggttccacaaattaccgccattcttgattgcgctgaagttgccatgaagtatgatgtacccattattgccgatggaggtattaaatattccggggatatcaccaaggcattagccgcgggtgctgatacagttatgctgggaagtttgttggctggaaccgaagaaagccccggggaaattgaaatctggcaagggcggagctataaagtttaccgcggaatgggttctttaggcgcgatgaaagagggaagcaaggatagatatttccaggaaaacgagcaaaagttggtgccggaaggagtagagggaagagttccctttaaagggcctgtttcggaaactatttttcaattaattggtggacttcgggccggaatgggatactgtggtgttcgcaatatttatgaattaaaaaccaaaacaaaatttatcaaaattacccaggcagggcttagagaaagtcatccgcatgatgtaaccattacaaaagaagcgcccaattacagcttgtaattgggcagctctttttcttttacgtattttaaatcttcccagtgcttaagtaacacgcccagggtggtatccagtacttcgggatttaatgaggttaaatttaataattttatagttttggccatttccaccgtttcggcaatgcttggtttcttttttaaatccctggctcttaaacggttggcaaaatctacgatttggcctgcaagtttggcatcaattcccggaactttgtttaaaatgatttcaacttcccgctcccgggcgggatagtcaaggtaaagataaaggcaacgacgcctcagggcatcggaaagttcccgggagttattgctggtaattatgataaacggtggatttttggcttttatcctacctaattcgggaatggttatggcatattctgctaaagtttctaaaaggaaactttcaaactcttcatcgcttttatcaatttcatcgataagcaaaacggttttagttgcggaagttagagcttttaaaagggggcggggtaggagaaactcttcactgtataaatccttttttacttcttgccagttgttttttaccgtttgtaaaaacaaaagctgcttttggtaattccattcatagagggctttggcctcatccaatccaggataacactgaagccttaagagcggaacttttaaggcttgactaactgcaagggcaacttcggttttgcctacgcctgccgggccttcaattaaaagcggtttttctaaattgtaggctaaataaattgcggttgcaatttgcttatcgctaaaataacccactttgctcaaacgggaagctatatcttcgggatttttaaaaggcattatgttccctcctgaaaaggtgattgacatgatggaacctttacttgattttattaattatctgcggcgtcagggtattacctgctctcttgccgaaaccatagacttttttaacgccctcagcgctttagaacgacctttaactatccaaaacttcaagaatattgttaaaattactctggccaaaactcccgaacagcaaaaaattttagacgatattttttcctaccttctaattgaagattataacttaaatttaccaactttaaaagataagggtgaggatgcgggggatttaggcttaccgtcggggcaaattggtaatgaggaaagtttatattttttactccgcattaacaacgaagaagccataaaaaagcttttaggcagccaggaaaattggtcggcggagattaaagagtttttagctaacgttaaacggaagataaattggtatgaaaatctttataagattgaaaaagaatttggaattgatgtgcgtaaactaactgaagaagagttagaaaaatatttagtatatctttataaaaataaaaaccaaaattttaaaaccaagcctctccaaacaacccttgacctgacggaaaaggatcttttagaaatagacccgctggaaaaagcggtattggatggttatcttaaaaaaattgctcaaaatttagcctggaaaaaaagttaccgaaaaaagctggcaaggcgcggagtttttaatggcccaaacactttccggttaaccctaaaaaccggcggagttcccacgcaaatagtttgtcatcagtataaattaaagccggcggaaattattctgttactggatataagtggttccatggcagattactccagcttctttttaaaattcacctatcatattgccgcacggtttcaaaaaattaatttattcttatttgtggataaagtaaccgatgtcaccaaccttttaaatttgccctaccgggaatttattgaaactttggagaaggaaaagttaagttatacaggcttttctgattaccggagagcttttttagagtttttgcaaaataaacccaagcttttaaacaggcaaaaagtattgataattttgggagatgcaaaaaataactggcaggattccggtgcggaatatttaaaggaaattaaaaaaagggtaaaaaaaatcttttggttaacccctttaaccatggaagaaacaagtaaaaccgattgtgtaattcatgaatacaaaccttttattgataaaatatttttatgccgaagcttaaaggatatcgaaaaattttaccgggacctgttttaaatttgttttatcttgacgaaaggtttttttatgactaacaattttcgcggcaggaaaaaaatgccagaaaattgaataatactaccatcaaaataagatctgaggtggtagtattgcgccttgccaaaaacttaaactcattaaccgatattttaaaaacggttctgtgttattttccctgtatgtcggaagaagagctggttggctatgtccgggcaaaaatgttaaaggaattttcctataaagaaattctggagaaaacccgtaactgtctaaagcaaaatccctgtttttaccagaatgaagaaggcttctgggcggtgcgcaaagaggggattcgggagaacgattctttttttaagcaggtattaataagcaaaaagccccagaaatatacgttaaaagataaaaaaaataagaaagttcagcaattaagccgggacagtcggtttgtgcagttagatgatggctcatgggctttgacttactgggtaataaatgaaagtgactttttgttgcgggaaaaaattgcccgagagcttatgattgaagagttaacattagaggaattagccaaaagagtaaatacctcgccggaaaaagtcttaaaaattttaaaaaaataccctttttttgagcaaaacggttatggttattataaattggacctgagactaaaaaaagtatatgctcaggcttcgctgaaatatatggatgcccttaaaaagttaaaaaagttttatgcagataaaaaaggtaaagttagtgccgaagttttagcacaagcccgggaagctttagagcaagctgcggcggtccagttattgcagagaaaaaatcaagaagaaatcaatgagctttcggaaaaaattgcggaaaaagattttcttttggctttacggcgggaagaattaatccggatgagccgggaaaatgaaaagctaaggcgaaaggcagacagtatcttataccagtgccgctctggcatgcccgctatcagcggataatccgggataaagaagaactattggtgattaaagaaaaactggaaaattccgtggtaaatatgtttcaaaagttaaacgcttaccgggaaaaagataaggaaaaccggaaaaaactttttgaacttaaaaacacctttgaggaaaaagtggctaagcttgaaaaggaagtaattgaagtgcaagagcagttaaaaaaagcggaggaaaactggcagaaaaaagagaagaaattaaggcaggaattagagcggtactcccttgatttaggattccttttaaatgaaaaggaatccctggaaaagcgagaaaaagagcttttagaagaaatcgaaaagcaaaaggaaatcattaaacaccaggaaaatcttttaaaactgccggtaataagtattttatgtaagatagtaacctggtggcggacggtaaatttaaatatttgaatgctcccgtgatgggagctttttttctgaaatcatactaattcacaccaaacaggatttccgacatcgaacgtttttatgtcgccggaggctttggccagtatcttaaccttgaatcggctattaccattggtttgtatccagacttaccccgggataggatgatacgcctgggtaactcttccggagaaggggcccgactggtacttttatccaagcagaaacgggtcgaggctgaggccattgcgcgtaacattacctacttcgagcttaatgccagccaggcctttatgaataaattcgtcggcagcatgtttttgcctcatactaatctcgactatttccctacagtgaaggaaaagttaatccagcgaggactggtagaaggatagggtaaaaaaaagaccttgctttacccaaacggttctatttcttagcgcaagcattcctgctttttcaagcaggttttttctttttagaggaattttgggaaagatgccgaataaggaaacagaaaggaccaaaggagaagaaaaaggctttccaagtccataccgttaccttaaatggtattaatgggaaatagggaaggtggatataaaccgcgggctgccggggatgcaggtagtaggcatccccaatacggcggtcaaggaagcccgggaacggataaattggcgaaaaaaacttggagataagaggcagtgatgaaaatggatgtagttaggttttacagcaatattattaaaagaaatatggataaacctgaaaaaataaataaacttataaattttggacttactactgcttattactatgtaagcatttttaaagataaaaggggacccaattctttacattatctaactaaatactgtataaaaagtataaaagattcattagaaaatcctcaaaattctgcctgggtaaacattttttcaccctgtgagtttttaattgctctggatataaagcccttatttattgaagcatattcttcttttatgtcaggtttttttattgaagattatcttattgatactgccgaatccagggggatagcaaatactttatgcagttatcataaaacttttatcggtgccaatgagcttaaaattcttaaaaagcctgaatttatgctaactacttccagcatttgtgatgcaaacgtacctaccttcaggtatctttctaaaaaacaaaacgttcccttatatattatcgatgtgccttataagtactctaaagaagccgtagcctatgtaaaaaaccagcttatagaaatggtggaaaatcttgaagaagtttttaagagaaagcttgatcttgataaattaagggaagttgtaaaaattgaaaataagacaagaaccctcataaataagtatttaaattatttaaaagaaaaaacccttttggttcccatgacttttgaaatgtatatgctttttgcatcacatatatttattgggagcaaagagatgttaaagttttatgaaatgctgcttgacgatataaaaaatgctcccccaagaagtggaaaaagtatattttttgtccaccttctccctatatttgagaaaaattttcaagattattttaattttagtaataaatttcatattgctggaagtgatttaaattttgattatcttgacgaaattgacgaaaaggacccttttcgcggaattgctgaaaaacttattttaaatactttcaatggtgaaatggagagaaaagttaccagaattagagaattaattgaaaagataaaaccagacggaataatacagttttgccaccttggctgcaagcagtccataggtggaacatttatcattaaagatcttgcaacaaaaatgggtatcccatttctttatttagatggcgactgtgtagataaaagaaataaccaggtggggcagaacaggacaaggctggaagcttttcttgaaatgctttagtaatgcccgtagggggtgaaaacttggtaggttacgtttgtaaatatactccggtggaaattatcgaagcctttggagaaaaaccggtaaggattgaatcaggatgtaagtcttatgaacgtgccgaagccctgcttcatacaaatacgtgcagtttcgtgaaaggagtcttggaaaatattattgaaaataatattgaagaagtgattttaaccagctgttgtgacagtataaaaagactttatgatgttttaaaagaaagattaaaatttatttatattctggacctccccagaaaaaaagatacttttgcggtagatgttttttataaggaaattattaaatttatagatgcgtataaagcatttaaaaataaaggctttgctatagaaaatttcttgaaaattttagaagataaatcatccttcagaaagatgcaagaaccatctgaaagtattgcgattttaggtgcaagactcaaagatgatgttgtagaaaaaattaaaaattcctgctcagtaaatattataaattttacatgtacaggtgaagacagaatattcaatattgaatcagaagataatttattaaaaggctatgcggcgtcgcttcttaatttaacgccctgcatgagaatggcggaagatcggagtaagttcttcaataaagacttcaagggtataatttacaacactataaagttctgtgattattattcttatgagtatgctgaaatgaaaagtcagtttaatattccttttttaaaaattgaaactgactatactgattctaacagtggacagattttaacaaggatagctgctttttttgaagcaactgacatcaaaaaaatggaacaaaaaaaagccaaaaaaggatattttgcaggaattgacagtggttctacttctacaaatgtcgtgattattgatgaaaataaaaatataatatcatattctattataccaacggggcctaaggcgttagagagtgcctttaaagcttttgaaatagcattaaacaatgcaggaattaaagaaaaggatataacatcaatagtagctacaggatatggaagagtaagcatcccctttgcagataaaatggtcaccgaaattacctgtcacggtaaaggggcattttttatagacaacagggtgaggaccgttatcgatatagggggacaggatagcaaagtaataaggcttgatgagagcggcaatgttattgattttgtaatgaatgataaatgctccgccgggacaggccggtttttagaagtgatgtcaaggactttaggtatttcaataaatgaaatggccaaagtacatgcggaagtaaaagaaaatatcacaattaccagtatgtgtacagtatttgcggaatcggaagtaatatctcttattgctcaaaataaagaccaaagggatataatccatgctcttaacaaatctgttgcttcaaaagcagtttccctggttgaccgaataggaagaaagggcaaatatatgatgactggtggcgttgctaaaaatcagggagtagtttcggcaatcgaaagcaaacttggggaaaaacttgtaatccccgctgaacctcagattattggtgcgcttggagcagcactaattgcctttgaaggtacaaacggataacctaaataatttttgtatacacacattttatccgtaaagaagggcatagagaaaatgtaagattccagcgaccttttaatcttttcgacgccttcactgagactttaaagacctgggaggagagagcaagatgggtttcaaggacaaagtagtggtggttacaggttccggccggggtataggacgaagcattgccaagatgtatgccgaacatggggcgaaagtggtcattgccgaccgtaattttcaggaagcgctggaaacagagaggcttatcagcgaggaaggcggtgaggccatggcggtcctggccgatgtcagtaagcccgaggacgttattaacctgatggaaaagattgaaaaaagctacggcagattggatattctcataaacaatgcgggattcgggtgctggaagtcaccctatgacctaactgtagaagaatgggacagcgtcataaatactaacttgcgtggtacctttctgtgttcccgggaagcggcgaagattatgaaaaaaggcggtggaggcgccatagtaaacatagcctccaccagagccatcatgtccgagcccaattccgaaagctatgcagcttcaaaaggcggtatccttgctctcactcacgcgctggcgatttctcttggccctgaccgcataagggttaacgccataagtccaggatggattgagaccggggaatatgaaaaactccgggaaattgaccaccttcagcaccctgccgggcgggtaggaaaacctgaagatatagcccgggcctgtctttttcttacagccgaggagaatagtttcattaccggtgcaaatctggtgatcgatggcggtatgacccggaagatgatttatgaaccatagaaaatatttgcttttgctattgggtttaatgtgaccataaaggaaatgattcaggtaatagccgcaacacagttacctcccatctacggcaaaccatgctaggtgttcaggtaagtagcttatgtcaaatgttccttttcccattacaattttgcacaggatacggacaagcggaaacacataaaccacaacgtttccctgaatttacaacaaaaacttcaaattctatcatatactgattcctggtttgaggaaggttattaattggcccgttattaaggtggtaagcaaaggttattacacttcgagcattgggtaaaaaatcctttggacggtgcccttctggtgcgttttcataacgtattgccggtgcaataccaattgccgataattgcaatgtctgactaaatttaagtaactcctcagtcaacaaaagtatcacttcccctttttaacctttaaataacagcaccggcataaatgccggtgcctccttttatagcacgtattttacagtaattcctccgctttttcagctttaaataaaacctgttgctcctctatagtggcagttccgataagtctgtaacctttgggtccaccctcacgagtagcaattactacttgcattttcccattatcctgaatattctgttgcgttgttttcattttatagatgccgaaaacaagagtatcatcttcccggatttcctttacttgtcctaccacaatcaggtgcggttctccctggcgggatacagtaacgataggtattatagaggctttggggattatgaaacaatgcagtctcgccaagtacttctccaggtccaataacatcaaagattattttccgcccttcatctgtaacctgtacaagtttaaacttacctgctttaattaaatatacagtattaacagggtctccttgacaaaataaaaaactttccttacttactcgcttttttgaggtgcttaaacaaacattaacgaactccggtaagtctaatccttgaaaaattggtaattcttttagacagagtaaacaacgtttcatttctttcacctttcttcaatttataaaacaacattttgctctcgtcaatgattgagttcttacagtaacagtagctgatcttaacggtagttcgattcgattgagtttacttaaattgtaactaaaaaaagcaaatcctaatgtaaaattttttacacgtttgcgcaaaagtgcaagcttataatattaccatatagaaaagtatgggaggattggtaaagatgtcaaaatgttttatttgttgcggtattttacaaaaggagcttgaacaaatctttaaagagattgggaacaggaacaatgtacctgaacgtatatatcttgagcctgcattacatgtggattttgataagctaaaaactgaattagaaagtactcttgcaaatcagcaaaaaaagagtgaaaaattatttctggtttacggattacaatgtcatccggagatgaaagtgttagctcagaattataaagcaacagtaataccggcacaaaattgcatagatatgttgttgggagataaaataaattttttaaatcaagaagctaaaactttttttcttaccccgggatggcttgaaaattggaaaagtatttttataaatggacttggctgggatagtattaccgcccgtcaaaattttggtttttatgagcgaatcctgctcttggatactggaataaaaactttcaaagaagaggaaattttagaattttttgattacacacaaataccgatagaaactcatgagataagtttacataatctgcgtcaattagttttggacaccctgaaataatattaactctggaaaactttcatacacgtccaaagcatagccgtttagcagtaattacacctacagggagctgaggggtttttaattttgaaaaggcggatattttacatcccaatatgggcaatcatatttatttcaaactaaagtacatcacataattattcatttattacaaatgaaatgtggataagttctaagttcttgagcgaaagtaacttttacccatccgtaaaaaataaacatcagtttttaaaaaggagtgattattaaatgaatgcgtcattattgaaaattagtttgttacttattgctatagctttagctataagtgttgttgcattggctgcaccatcaaatgtctctcacccatttccccaggataaatataatgaaaatccgcttcctgcattgcatgctaataataatctttctgaaggtcattttataaccaaggaacatgctattgcaaaggtgtctgttggcaaagaaggtgaattaaagtcggtggaacttgtgacttggaagcagcacttagcaaatgatgagccaaaagaacaattggtaaatactcagatagatcctgacagaatggtattggtagtaaaaaattattttccaaaagggttagatacaaaggctgggttttatgaaaaggctactttaatttctgtatttgatgcccaaaccggacagttattggagtcaactgttatgggagattggaaagggcaaaggctgccttaaaacatgcgataataaggaagtagttacaaatgtagacaggcaaagtgattatggcgaaaatctggctgatgtcagattctatctcgagctcttcaaaaagtgacgggctatttctgaatagcattgcaaaatcaatatcactggtaatacgttcaagctcggtgccataagatccaaatatatatagtgctaaaatgtttttattttgttcacagtatttttttaattcttcaatttgccctttaatatcattcaaattccttttcatctaaatcacctgtaattaaagtgaaagagtaaaccaccagatttcctttttattataccagaatattaggggtgttaaacaaaaattttcaaaaatattccaaaattagaatcaggaacatcattgatttatgataaactttgacatgtttgaacgtctttaagcaagtttttttagaggaattttttgaaatatgccgaataagaaacaaaaatggctaaaggagaaaggggaaataaaaagcatcctaaagtacataccgttaaaagcaatgtttccaaagctgtggagagatggggaagagacacgactactgaagggataatgtagcatataactaaaaaggaaacggatactgttactgcccggagacggggacacaatgaaaaatagcaaatggatgattcgaaatcgaacgaggaaccttaaaaatgttatgtccagcaggttgattgcttaagttaaatacgcatagaattgttaattcggcaggaatacggtttttaatcgtagaattgagttagaaaacagtgttaagtaaaaattacagacgggtgtgatagaaaggagaaggcatgcaaaagattaaaaacattttctttgaagtaatttatgccgttttacctgtaaccgtcgtcattattattcttcaagcgatactccgattatcaattgatattataatacaatttttgattggtgttatgatggttactattggtttaattcttttttcacttggtgtacaaataggtttactaccattgggagaaacgataggtgcagcactacccaaaacaggtaaagcgtgggttgtaattctttttggatttttgctaggttttgtggtgacagtggctgaacctgatgttcgagttttagctactcaaatagatatcgtttcgaaaggagttatttccaaaaaccttttaatcagtgctgtagctctgggtgtggcgatttttgtgggtttagctatattgcggattatactgggtagtcccatgaaacatcttttaattgtagcttatggtcttgtttttatactggcggcttttacaccggctgaatttttagcaatttctttagatgctggtggtgtaaccacaggcccggtaacagtaccgtttattattgctttagggataggggttgcttcggttttaggaggtaaaagcgcatcatccgatggctttggacttatagccttagcttctgttggacctattttagcagtattgttgcttggggtgatttatcgatgaaagaaattcagatattctctggatttagccatgttatattagaagtgtttatagcttttttaccccttgtgattatgtttttaatatttcaattttggctgttaaaatttccaaaatataaagtcttaaatatttttaagggtttggttttaacgtttattggtttagtcatttttttacagggagtttatgttagcttttttcccgttggcaaaacaataggagtagctttaggtagtttagaacacaattgggtattgataccaataggttttattttgggttttgtagctacatttgccgagcctgccgtacgggtgctaacttatgaagtagaaaaggcctcgggaggatatatcccaaaacaaataatgctctatactttatctttgggagtggctatctcaatttctttagcgatggggcgaattatctatggaatccctctatggtactttatcattccaggctatttaaccgcttttataattatgcattactctacacccgaatttatcgcaattgcttttgattctggaggagtggccaccggacctatgaccgtaacttttatctcggctgtagcgttaggtgttgcttcggttatagaaggacgaaatccgttgatagaaggatttgggatgatttccttggtagctctttcaccaattttaacagttttgcttttaggactgctctttactagaaaggagagcaaggatgagtaaaattttaagtaagtgtaaacttataatagccattgttaattatggtgtagcaagaaaagtagttaaggcttctaaggaatctggggccgaaggtgcaactactataatgggaaagggtataggaattcgtgaaagggcgactttttttggcattcctgtcgaggcagaaaaagaaataatttttactttaatacgcgaagaggaattagataccatttttcaaactattatttcaagtgcccaactgaataaaccggggcaaggaatagctcttatcattgatgtgcaggaagtagcgggtatttgccatatgtgcatatctactgaaactaagaaaaagagttttgggaggattgaaatggaaaataacggagagattttatatgatttaatcataactatagttaataaaggtgatgcggaaaaagtagttgaatcttcaaaaagggccggcgcggaaggtggaacgataatatccggccggggaacgggaattcatgagcacgctaagttatttggtattaccatagagccggaaaaagaaattgttctaactttaattgaacgccaaaaaactaagagggtattggaagcaatagtaaatgagaccgatctaaacaaacctgggaagggaatagcctttgtcttggcagtcgaaaaggttgctggaattaatcatctttttaagagctaaagaatagagtaaaccgttttattgttaaaaattaacctcaaataagaaaagattaataacaggcaactttgttggtattagagttctgtaaatcttggcttcagttaattcatttttttgaggtgatatacaatgaagttcctaagttttttagcttacgccagtatcattgtggggattattggtataattttgggaattcgcataaactttcgctggtactggctatcaattcttgctttttacaacgtcagctatttaacaggattttcgttatggtggctatttttaagcattgtatggattttactttcattaacatttggtcattccttgggtttaattaccagctcaagaaaaagcgtcctagcatcctttttgggtttagctatgtggtttgtatcaattctaatgattgacgattactggctattcttgcctatgaggaaaatttatcatttttttagattacaatagttctttaaatcagcttttttcctgctttttcaagcaggtttttttctttttaaaggaattctggaaaatatgccgaataagaaacaaaaaaagtagaaggagaagataaatgctttccaaagttcataccgttgccttaaacggcattaatggagaaatagtagaggcggaggtcgatataaaccgcgggcttccggggatggaggtagtgggacttcccgatacggcggtaaaagaagcccgggagcgggtaaagtcggcgataaaaaactccgggtttgattttcccatcgccaggataacgataaaccttgcccctgccgacttaaaaaaagaaggctctcacttttagctctcgggattttagcggcgagcgaacagttaaacgcaatttatcacactacatctttttaggggagctatccttggaaggtcaggtcagggaggtagatggagtcttaccttcggtattagcggtgcggggtagggtaccgaaagcagtagtgccatataataaccgtactgaaggggcgttagtatccggggttgaggtttacggggtaaagagcctcagggagttagtagcttttttagcgggagaagaagagcttaaaccggaaaagcctcttgatattaccgaaatagtccgggaaaaacccgatgaagagctggactttgccgatgtggcaggacaggtggtggccaaaagagctttagaaattgcggcggcggggaatcataattgcctgatgatcggtccgccgggaacagggaaaactatgcttgctaaacgcttagtttcaattttaccggatttaacgtatgaagaaatgcttgaagtgaccaaaatttacagtgtggctggacttttaaaaaataagccgtttattacccagagaccttttcgcagtcctcaccataccgcgtccaaaataagcttaaccggcggcggaaaaaagccacgaccaggggaaattactttagctcatctgggagtattatttttagatgaactgccggagtttgggaaagatgtcttggaagcgatgcgccagcccctggaagaaggagaagtgaccatagcccgggtggaatcggtggttacttatccggcaagatttatgttaattgcagcaatgaatccctgtccgtgcggatttttcggggatgaggagcggctatgtacctgtacaccccatcaggtacataaatatcaggccaaaatttccggcccgcttttagatagaattgatttacaggttgaagtcatgcgggttcggtatcaggagatggaaaatattaaaaataatgaaacttccgccgagattcgaaagagggttttgcgcgcccgggaaattcaggcgcaaagatatcgtgaactgaagttaaatatttcaaccaactccgaactttcgccaaggcagataagacggtatcttaagctaacgcctcaagctcgggaatttattaaagaagttttcgagcaaaaggttctttcaaatcgggcttatgatcgcttattaaaagttgcccgcaccattgctgatttgggggaaaaggaagtagttgatgttaatgaaattgctgaagccttgcagtttagacttttggagcagaaatactgggaggtttaagcaaatattgttataattgataaaaagaagcttaaggaggacaaaaatggccagcgattatagttttgatattgtttcggaagttaatcttccggaagttaaaaatgcggtaaatcaggccctaaaagaaatttcccagcgttatgattttaaaggtagcaatgtggaaattgagttaaatgaaaaggaaaaagaaattagaatcactgccgatgacgagtatcgcctgaaaagagcggttgatgttcttgaagcaaaacttgtcaaaagacaggtttctttaaaatttttagattacggtaagattgaaccggctttgggtggaaccgttaagcagacaattaagttaaagtcgggtataccaagggaaaaagccaaagagataattgatacgattaaacaaacaaaactaaaagttcagacacagattttagacgataaacttcgggtttccgggaaaaagaaggatgacctgcaggcagtaataaagcttttaaaagaaaaagagtttgggcttgtattgcagtttacgaactaccgttaatccaggccgcccaaattggcggtttttttgtttttagcataaatggattatgtatacatatatatttaccaaagaaaacatttacgggggtttaaaagtggtttatttaatcactttttgcgaaggggaggaagtgcggtatctttttacccaagtttttaaaacaatatcctgggaccttttagataaaaatttaattgtggttaaattacaaaactaatgccggcttttgccggtatttttgttaaaggaagctttcttatttaaaaatcattttgcatataatgtaataacacgaagggaggtaagcccatggagtttttagaaaaacttgaggcttacaaaaaaagagaaagggaacttgcctgggaaggcagttttaaagaatatttagatatagttaaaaagcggccgtatgttgctcagcttgctcatagccgtatatataacatgattaaatcatatggtatagaggagaccgaggaaggcaaaaaataccgcttttttgcctcggaactttttggtttagataaaaccttggcaaaattggtggaagaatactttcaccccgcagcccgaaggcttgatgtcaggaaaaggatattgctcctgatgggtccggtgagcggaggtaaatcaactttagtaacattattaaaacggggtttagaaaagtacagtcggaccgaggagggggccctatatgctatcaaaggttgcccaatgcatgaagaacctctccatttaatacctaaagaattgagggaagattttgaaaaagagtttggtgtatatatagaaggtgaactctgccccaggtgtcaggtcatgcttgaggaagaataccagggaaatattgaggaagttagagtggagcgaatctttttctcggaagaaaaacgtatcgggattggaactttttctccttcggatcccaaatctcaggatatcgcggaattaaccgggagtgttgattttagcgccctgcccaaatacggagccgaatccgatccccgggcctatcgttttgatggtgagttaaatatcgctaaccggggaataatggaatttcaagagatgttaaagtgtgacgaaaaatttttatggaacttactgagtttgtcccaggaagggaattttaaagccgggcgatttgccttaatatatgccgatgaactaatcgttgcccataccaacgaagcggaatataaagcgtttatcagcaacaaaaaaaatgaagccttgctttcccggatgattgtaataaaaattccgtataacttaaaagtttccgaggaagtaaaaatttatgaaaaattaattaaacaaagcgatttaaccaatattcatattgctccccatgccctgcgggtagctgctatgttttcggttttatcaagattaaaagaaagtaaaaagcaggggatggatttaataaagaaaatgaagctttacgacggtgaacatgtggaaggatttatgcccaaagatgtggccgagttacaaaacgaggtagaagaagaaggcatgtccggagttgacccccggtatgtaataaataggctgtcttcagctttaattaaaaccgatactgcctgtataaatcctttggatgttttgcgagcgttaaaagatggtttagatcagcacccgtccataaccaaagaggaaaaagaaaggtatttaaatttagtgtccttagttagaaaggaatatgatgaaattgccaagaaagaggtgcaaaaagcttttgtttactcctttgaggagtcggccagaaacttatttaacaattatttggataatgttgaagcctattgtaacggtacaaaactaaaagatcccattaccgacgaagaattagacccggatgaaaagttgatgcgttctatagaagagcaaataggtatttcggaaacggccaagaagagttttcgggaggaaattttaattcggctatcgatttatgcccgtaaagggaaggtttttgattataacgcgcatgagcgtttaaaagaagcgattgaaaaaaaactttttgctgatttaaaagatgtggtaaagataacaacttccaccaaaacgccggatgtccagcagctgaaaaagttaaatgaagtaggcgaaaggcttattaaccaccatggttattgtccggtttgtgccaatgaacttttaaaatatgtggggagtttgttaaacaggtaggtggggtaaagtgggcaattgtataatttccagagaagattggagtcttcaccgcaaaggagaattagataaagaacggcatcaggaaaaagtacgggaagcaattaaaagaaacctgccggaaattttaagtgacgaagccataatcatgagcgatggcaaaaaaataatcaaggttccgattcgcagcattgaacattatcactttcgctacgattttaataaacaaaaacataccgggcagggaagtgggggtacaaaagttggagatgttttgggtaaagaaagtgggagtgccaagggtgataaaggcaaaggagcaggaggtttacccggttatgattactatgaagcggaagtttcgcttgatgaattaacggaaattcttttggaagatttagaactcccccatttaaaaaacaaaagtaaagataaaataacccatgaaaattacgactttcgcgatgttagaaaaaaaggcttaatgggtaatattgaccggaaaaaaacagtatatgaagctttaaaaagaaatcttttaaaaaatagtgaaaatctgtatcaaatcacccaagacgatttaaggtttaagacctgggacgaagtagaaaaacccgagtccaaagcagtggttattgccatgatggatagttccggttccatgggaccttttgagaaatacattgcccgaacttttttcttctggttggtgaaagttttaaaattaaaatatcaaaatgttgaaataatttatttatcccatcataccgaagccaaagaagttacggaaaaggagttttataccaagggtgaaagcggaggtaccaaatgctcctcggtataccaattagctttagacataattaaacagcgttataatccgcagcaatacaatttgtatgcgtttcacttttcggatggggataatttatcttcagataatgagcggtgtttacagcttgtgcttgaactcttaaaggtatgtaatttagtcggttacggagaaattgaaggcccatattattataccgccactttgaaaaatgagtttaaaaaaataaccagtcccaactttgttctgacttcaataaaagataaagcggggatttataccgcgttaaaagcttttttaaaaaaagatggttaattttgggggaattgttatggaagagttaacgtatttggaagaggcggtggaaaaaattggggaaatagctgcaaatttaggacttgacttttttccgatgcgctttgaaatttgtccggcggaagttatctatacctttggagcatacggtatgcccactcgcttttcccactggacttttggtaaagcgtatcataaaatgaaaacccagtatgactacaatctaagtagaatatatgaattagttatcaataccaatccctgctatgcttttttgctggaaggtaattctttggtccaaaataaactggtaattgcccatgtttacggtcattccgacttttttaaaaataactggcactttaaaaatactaatcgaaaaatgctggaaaccatgtcagtacatgcccggagaattgatgagttttcttttcgttatggaaaggaaaaagtagaaaaatttttagacgcagtcctttccatagaagaacatatcgatccttttgagggaataataaaagaacagagtaaaaagaaaaaagcaaaagaaactaagaacccgtatgcggatctttggtttgaaacggatgttttaaaagatgaggaagaaaaagaaaaaaagcctgtaaaagacattttgggttttattggaaataatagcaggtatttagaagattggcagcgagaaattatttttatggtccgtgaagaaatgaaatacttttggccccagttaaaaacaaagattatgaatgaagggtgggctgcttactggcatattagaattatgagggaattggacttggatgaaaatgaaagtattgaatatgccaaattaaacgctcaaatattacaaccaacgcggtttggtattaacccttatcttttaggacttaaagtatttgaagatattgaaaaaaggtttggtaaagaaatgatatttgaggttcgggaaattgattgcgatgttacttttttaagaaattatttaaacgaaaagttggtggaggaacttgatttgtataattttcaaaaggtggggagcgaatggcgggttacggaaaaatcctgggaaaaagtacgagataacttagtattaagtttaaataattgcgggtttccttatattgaaattttagatgatgattatggaaaaaacggtgaactttatttaagacatcgttatgaaggtattgaattggacatttattacttagaaagaaccctaccgtacgtttatgaactctggggtaagccggttcacttggaaacggtagtggatagaaaacatgtattatttaccttcaatggggaaaaacatttaagaaaaattattgaaggctcgggcaaatactaaaaaagaggaggttataacgatgaagcttaaaaaaccagacctttacggagaattacttgagaacaaaacggaacatttttggcgaaaagtaaatcaaactaaggaaggaatttcagcggaaagagaaaaacttccaatgggtttaaaaactacaacaccaaaattttttgatgccaataaagaagataattaatatctataaaaaaaccggtccaagggaccggtgattttttctggcgggagtgaataggaatcgaacctaccatggacggttttaccgcccaacaacgggtttgaagcccgcggggcccaccaggacccagtcactcccgcttttattgctgcaaagtttattatataataaaattactcattagtcaaaatcgtagaaggattttggactttagaggaagaatacttctttatattttatcaagtacttttgtaggtttaaaaatggagggtaacaacaattaagccagacaatgcagaatagtgcaataatacttactttgtaagggataaagtttaattgtacaaaatcgtaagtgtggtgaaaactttgaagcaagtcataacaatacaagcaaggttatttccaaaggcagaggagaacgtggtattagataacataatgcgaaagtggaactcctgcaaaagatatgcttataaccgcctacttgaaggaaaaacccgaaaagaactcaagaaagaactgcaaagcctctttggattgaattccagatatgtagacgatgctatacttgaagccagcgaagttttgcaaagtatccgagaacttggagaaaacccacgcaaggttatctttggagggaaagtattgttttatagactaaaaagcaaacatttaagcagtgagcagaggcaaaagtacaaaaaagagtgggaagataaacgcaaaggaacccttttctccagaggggataaaaccaagcaggggaatttaaatttaagagttattgaagaaaatggccaattctttttaagagtaaatgcaggtaatagaaaatggctgtttatagaacttaaaagttcgcataaaaaatggagaaagtttgcagaagcaatgctaaattcctgtccttacagcgttcgtttgcagaggaaaaacaataaatactatgcttacatttcttttgaagacgacttgccaaatacagcaatagatttcagcaatggagctatcgggatagacttaaatgcttttccatcacacatcgcctgggctgaaataaaaaaagacggcaatttagaaagctttggggaaattcctacaccacatctctgggatggaagaaaagaaaaaagagattactttgcatgggtatacgccaacgaaattgtaaaattagcccttgagaaaaacaaaggcatcgtagtagaaaagttagcgataaaagacaaaggctaccggggagattacaagggaagaaaatccagaagggtaaagcacggttttagctatagaaagcttattgccagagtaaagatacttgcccagaggtacggtgtagccataagagaagtaagcccggcttatacaagcttgatagggatgctaaagtacgcaccgcagtttaatttaacaaaagatacagcagcagcttatgtgatagcccgaagaggattggctttaagggagaaaattcccttgaagtatagagagctattgaaaagcctgcaaagcaagtcacggtcggtatcttcagctaccgatggaaggaatggaggtactgcggtaaaggggaaaaccttaccgtacaaaccgtggcgagttttgcgggtagccctcctgacgggagctctcctggacaggccattatatcgtgacctgtcaccgcttaagagaatactcataagcggtatgggggaaggtggctgaaagtcacggtaagttcctgcttcttggggcaggggctatggctgtcccgaataccgccagttggggctggggcagcttgaggggcggacaacaaataccccaaccttccaaaccggtgcagttttgcacagtttggaagaccaggaaaagaaattgtttgaacttgtaaaagaggatttaagaaaaattgaacaagagttaattaaagaagttagcgaaaggaacgaatttttacacgaccctgccatgcacttattaaaagcgggaggaaaaaggttaagacctgcttttgctttgttggcagcaaaacttggcgattatgatttcgagaaagttaaacctttagcagtggcattggaacttattcatatggccacgttagttcacgacgatgttgttgataattccatgcttcgccgtgggcttcccacggttaaagctaattggggtaataagatgtcaatccatattggtgaccgaatttttgccaaatccttacttttaatcgattcctgtaaaaataattatgtggctaaagttttagctgaggtaagtgttaaaatgactaccggtgaaattcaacagttaaacggtgcaaaaaacatttctacaagtattaaagactatttaataaaaattaaaagaaaaacagccctattattatccgcaagctgtgaacttggtggagttatggccaacgtttcgcccagggttgttaatgcgttaaaacagtatggcttatatgttgggatggcttttcaaattatcgatgatattttggattttactgctgatgaaaaggttttgggaaaaccggttggtagtgatttacggcaaggattgataaccttacctgtgctcttggctttgaaaagggacaaaaagcatgagctttggcgggagttacaaaatcttccccaaaataatgctaacattgagcaaataatcaaagagataaaataccttggtggtataagtgaagcttatgcctgggcaaaaaattacattgaaaaagcaatttctgcctttgaattggtgccaaagtcaccagttaaagatacttttttagaaattgcccagtttatcgtgcaaagaaattattaaatggtagcaggaaatttgattaatttgtagaaataatttgtgaaaactgtatttaatccttagataaaggagcgcgtttagtatgtatttagtggttgtgggggtaaatcacaggactgctccggttgaggtgcgggaaaagttatctttttccgaccaccaattaaaagatgctttttccgctttgctgtcttatccttccattgatggttcggttattctttctacttgcaaccgtactgaggtttatgtggcgtccttggatgttgatactggattaaaagtagtaagggaattcttggctaattgggccggtttatctttgtcggatattaagaattatacttacaattatacattgtacgatgctgttcatcatctttttcgtgtagcatcaggccttgattccatgattttaggggaaacccagatcttgggtcaggtacgcgatgcttttttaaaagcctcatctttaaaagcgtccaataaaatattgaataccctatttcaacacgctataactgtgggcaaaaaagttcgaaccgaaactggcattgacaaaaatccagtttcgattagttatgccgcagttcaattggcgtgttcattttttggcagtttaaaggataagaaggcgcttctaattggtgctggtaaaatgagtagtttaacagcgaagcatttaagttactatggaattaaagaaatcattgttgctaaccgttcctttgaaaaagccgaacagtttgcccgggagtttaatggaatagctgttccctttgccaaaatctatgatatcctcgccgaggtggatttggtaataagctgtacgggagcacctcacctgattatccataaagagcaattagagttagttatcggaaacaggcagcatccattatacctaatagatatagcggttccccgggatattgatcccgaaatagctaaacttccaaatgtttttctctatgatattgataaattgcaaaatgtggtcaccaaaaatttagaagaaagaaaaaaactggctgaaatggctgaaaacatcattgaaactgaactaaaagcttttattgaatggcatagcacccagtttgtagttccaaccattgtagcccttaagaaaaaagccgaggagatcaagcaaaaagagcttactaaagctttaaataaactgggaaatatcagtgaacgggaaaaaaatatcgtttgtgcccttgctcatactattcttaatcaattattgcatacaccaatagtgaaattaaaacagtatgctttaactcctcagggccatttgtacaccgaaattttgcaaaacttatttgatttacaagttgaaggggaacgcccgaaaaatttcacccatccgagagaagaaatggaggaaagtgatgaaaaaagaagttattgtggggagtcgagatagtgctttagctttgtggcaaacaaattgggtggtggaaagactaagcaaaattcacccagaaataaattttaaaattgtgaccatgaaaacaaaaggggataaaatcctggacgtagctctggccaaaattggggacaaagggcttttcactaaagaattagaacatgccttgttaaataaaaccatagatatggctgtccatagcatgaaagacttaccaacagttttgcccgaaggcttgaaaattggtgcgttttgtgaaagggagtacccgggagatgtttttatttcccccaagggttttaagtttttggaactacctcagggggcgagaattggtaccagcagtttgcggcggatagcccaaattttagccgtaaggccggatttacaagccataccgctgcgcggaaacctacctacacgttttcgtaaaatggaggaaatggacttagatggcattatcttggcttatgccggtgtgaaaagattgggttatgaggataaaattaccgagatgttaagttttgacctctgtttaccggcggttggtcaaggttcgataggtgtggaaatccgtgccgatgatacttttatcgaagagcttttaaaaccaatcgatcattttgcaacaaaccgagctattagagcagaaagggccttcttaaagcgcttggaaggaggatgtcaaatccccattggcgcctattctgaagttaaagaaaaccgacttcatttgaaaggcgttgttgccagtttagatgggaagttagttattaaaggtgaaaaagagggaagtattgaggaaccggagaaagtggggattagtttagcggaggaacttttaacgaaaggcgcccaaaaaatcttagaggaaatcaggcgggatgccaatgagtaattcgcttacctgccgggttttggtaggggaaaaagttgattactttttaaattcggaattgttttttcggggattacgggacgcaaaaaatatttatttttttgatgaagaacttgattttattttaaaaaattttgtaaatactcacttggtaagtgaactgcccagcaacgttaccggagaagatgtaatattaattactaaaaaagaagatttgttaaagacttttcctttaaaaaattattgtttttacaatttacaacattttttaaataatggccctctggcgggagtgcgggttttaattccaaggacagaagctgatgaaaagcgagaatgcgggcgttttggtgccataggtattgaagtaccgctgttaaaaataacgtatattcctgatgaaaggattttacagttagatttttccgcttatgattggcttatctttaccagtgcccacggtgtagagggcttttttttcaatttaaattattttaatgtaagtttagaaaatttcattgggaaaattgcggttgttggggaaaaaacagcaaaagcattaaaaaaatatggtcttaccgcggatttttctccccaaaaatttacggcaaaagatttagccctggagctaactacctccggaatgattcaaaaaggggttatagtcattcaaggaaatcttggaagacccgagcttttggagattttggcccgaaataatattcccactaaaaaactggttgtttatgaaaatgctcccaatgtcgatattaaaccttttttaaatggtttattgaaagctaaattaattgacgtgcttttctttacaagtccttcaacttttaataatttctatcaatttattagtgatgaaaacttagcaaaaaatctaccgcattttgctattgggcccaccacctatgaggcttttttgcaaaaagatattcggagaaaatatttttcctcagaacatacccttgagggtttatggcaaactttgaaaaatcattggcaaggagagtgaattgggttatggatttaaagctacggatgcggcggcttcgggctaatgagaaaatacgttctatggttcgggaaaaccacttacatcccgaagattttatctatcctttatttatcgcaccgggggaaaaataccgcaaagaagttagttccatgcccggagtatttcagttatccattgatgaagcagttaaagaggcaaaagaggtgcatgagcttggtattccagcggtgatcctttttggtattcccgagcataaagatgagtttgggtgtgaagcctatcaggacgatggtatcgtccagagggctataaaagcaataaaaaaagaaattcctgaactttatgttataaccgatgtttgtctctgcgaatataccagtcacggtcattgcggtgttgtgcgtaacggagaagtgataaacgatgaaactttggaacttttagcaaaaaccgccgtatcacatgccaaagcaggagcggacatggttgcgccttcggatatgatggatggaagggtaagggctattcgtgaggctttggatgaaaatggattttcgcatatcccgatcatggcttattcagcaaaatatgcgtcagctttttacgggccttttagggaagcagctgagtcagcaccgcaatttggcgatcgccgttcctaccagatggatccggccaatgggaatgaggccttaagggaagtatggttagatattgaagaaggtgctgacatagtaatggtaaaaccggctttaagctatctcgatatagtttggcgggtaaaacaagagtttggctatccggtttgtgtttataatgttagtggagaatacgctttggtaaaagctgctgcccgtaatggttgggttgaggaaaagcggattgtattggagatcttaacctcaatgaaacgggccggagcagatttaatcatttcttatcatgctaaagatgttgttaaatggctaaaggaggcaaaataaatgttagtttcctggaataccaccaatcaatgcaatttgtattgtgaacattgttaccgggatgcgggagcaaaggttgaagaagaactatctactgaggaaggtaaggcattaattgatgaaatcgttaaagccgggtttaagataatgatattttccgggggcgagcctttaatgcgggaagatatccttgaactggtagattatgcttcccaaaaaggcttaaaaccggtttttggtactaatggcactttaattaccctggaaatggcgcaaaagctcaaaaaagccggagctttagctatgggaattagcttggatagcgttgaccccgaaaaacacgaccgttttcgggcttctcccggttcttgggaaaaggctgtggaagggatgaaaaattgtaaagctgcagggttaccctttcaaattcacactacagtggtggaatggaattacgatgaggtagagcaattaaccgattttgccgtagaaataggtgcaatagctcatcatatcttctttttagttccaaccggacgtgcggtaaatattgagcaggagtctttaagggctgaacagtacgaaaaacttcttcatcgtataatgaaaaagcaaaaggaagtccctattgaattaaaacctacctgtgctccccagtttatgcggattgccaaacaaatgggcatggatttgcggtttggaagaggctgcctggcgggaatttcttactgcattataagccctaaaggcgatgtgcaaccgtgtgcctatcttaatattcccttaggtaacgtaagggaagtaccgtttagtgaaatctggaaaaataatccggttttaaacgagctgcgtacattaaactataagggtggatgcggtacctgtaaatacaaagaaatttgtggcggttgtcgggctcgggcttatttctaccatgatggcgattacatggctgaagagccgtggtgcctataccaggggcgtaagggatattaaaagtaaggagtgagagaatgcctttaaaaatcgatagatcaatcgaagcttttagcgaagctaagaaagttattcccggaggagttaatagtcccgttcgtgcttttaaatcggtgggcttaaatccggtttttattgaacggggcgaaggctcaaaaatttacgatattgacgggaattgttatattgattacgttggctcatggggtccgcttattttagggcatcgccaccccaaagtggaagaagctttagccaattgcttaaaaaaaggtacgagtttcggggctccaactcttttggaaaccgagatggcggaaattattgttaatgcttttcctgcaatggatatggtacggatggtaaactcgggtaccgaagcaaccatgagtgccatccgtttggcccggggttttaccggacgaaataaaattgttaaatttgaaggttgttatcacggccatgcggattctttgttgattaaagcaggttctggagctttaaccttaggtgttcctacaagccccggggtaccggcgaatattgccaacaacacgataactgctcaatttaatgacttagctctcttagaagaaatatttgcccaggaaggtaatgatattgctgccgttattttagaaccggtggccggaaacatgggagtagtcccgcctaagccaggctttttagaaggtgttcgggagcttaccagaaaatatggtgctttgctaataatggacgaggttatgaccggttttagggttcactggggtggagctcaggttctctataacgtcgaaccggatattacaaccctcggaaaaattattggtggaggcttaccggtaggagcttatggtggcaggcgggaaatcatggaaatggtggcaccggccggacctgtttatcaagcaggaactctttcgggtaatcctttggcaatgaccgccggtattgccacgttaactgttttaaaggaagaaggggtttatgagcagttagaagaaaaatcaagttatctggaaagcggtttaaaagaagcggcaagagccgcgggcttaaagctctggtttaaccgggtcggatcgatgctttgcactttctttacctcggaggaagtggtggattataaaactgcttgcacatccgatactcaaaagtttgcggtgttctttaagactctcttagaaaatggaatttatattgcgccttcgcaatttgaagccatgtttgtatcccttgcccattccaaagacgatttagataaaaccattgaagcttcatataaggcatttaaggctgcagcagaaaattaatggcaaagaaaaaccccttgaagtaaaccttcaaggggttttttctcataaatggtgcggcagagaggatttgaacctccacgggtataaacccactagatcctgagtctagcgcgtctgccgttccgccactgccgcacatataaaaatggctggggcggctggattcgaaccaacgaatggcggttccaaagaccgctgccttaccacttggcgacgccccagtaaaatgtattaagttaaataaagtcagagatcaagtgacctctgacgtttattcttaataatggtggagggggtaggattcgaacctacgaaggcattcgccggcagatttacagtctgctccctttgaccactcgggaacccctccaaattatctaaagtaattttataaagtaattttttcactggtcgggatggagggatttgaacccccgacttcctgctcccaaggcaggcgcgctagccaaactgcgctacatcccgtaattttgaactgttcattccggacattttctattatatatatttggtgtaaggtcgtcaagtattaaatttaaaaaagcaaggtataacatgtttatttaaagaataaaatagtggtatgcaattaaattttatgttataatttgccataaggagagtgatatttatggatatctttaagcggagtattttattaggtttaggtttgataactcttacgaaagaaaaaaccgaggagtttttgaaggaattaatggaaaaagggaaaatgagcaaagatgaagcccagagttttctaaatgaaataattgaaaaaggcaaaacccacaaggacgaattaaaagcggaaataaaagaggaattgcaaaaaatagttaaagagttaaacttagtaacgcgggatgaactaaagcttttagaaaaccgcttaaatgaattagaaaataaaatccaggaacaaaacagggggtagcaaccccttgtttttttaagggggatcaattgtgtttcctttaacaccaaagcacctttcaaggtttcgtgaaattgcccgtatttttactgaatttggttttggctttattttaacttatttaaaaaggccagcagcactggataaagtggaaatcaacgaataccgtttaattgaactggccgggaatttaagggaaatgttagaaaaattaggaccaacatttatcaaacttggacaagttttaagtacgcaaagagacttacttcccaagccctttcaagctgaactggaaaaattacaggatagagtaaccccggttccttttgaagttatagcttcatatattgagaagaacttgggctctcccctgcacgatatctttattgagtttgatgaaaatcccattgccagcgcttccatagggcaagtataccgggccaagcttaaaaacggaaaaaatgtggttgtaaaagtaaaacgaccgggggttgatgaactgattaaaactgacctgcaaattctatatcaaattgcttcctttattcaaaacaaaaccaactggggaaaaattaataaacctttgcgaatgtgggaagaattaaaatcaagcttggaaagggaattagattacaccggggaagcacggaatatagaaaatttcaggcaaaatataaaatataaaaaactaattattcccgaagtgttctggaactttaccaatgaaaacatcttagttttagaagcggtttacggtattaaagtaagtgaacgcttccagctaattgaaatgggtatcgatttggaccagttagctcgagatttagtggaaatttttattttgcagattttagaagacggctattttcatgctgatccccatccgggcaacattgcaataactccgctgggggacattattttgtatgactttgggatggtaggttttttaaatccgtggttaagggaaatactaatcactttattaataagtgtagtaaggaaggattttgcaaggatttccgagttattaattgaattaagtcaaagacaagacataattccagcggaaataaaaaaagatgttcgggaaattttaaatcgctattatttcgtcccattatcttctttatcgttaggagaattattaaaagagttattaaaccttgcccaaaagcacgaaataataattccaccggaaattgttttagtagcgaaaacaattattgctttagaaggaatagtgaagaatttaaacagtaacttatcggtagccgaattagcggagccgttagcaaccaatcttttacggaaacgaatttttaagtttccatcctttaaaaaagttgccttagatttatataacttagttgacaagctttttgctttgccaggaatgttagaaagtagtttagcaaacttagaaaaagctaaattcactctcaaaatagaagaacgtcaattagaaagacaagtaacttcgtttgctaaaagtattcagtttttagcaatagttatcttttatgcagcttattttttgggttctccggcaattttaaatgctcttccggcagaccagaaaggtaaaatctttatttttataactgttgtttattttaccggtgggtacattttatggaaaaagcatctgctttagcatagattgtcctcttagggcatatttttttttagaataaaccctaagggggtaagggagaatgttaaaaaaattttttaaagtaataattatttttcttattttaaattctcttgcttatgccgaacagttaaaatctaccgaaggaacatctgcgagcacctcgaaatttgtattaatttttattgaagattttaatcgcgagaaactttatcaaatttaccttccaaacttagttaatctttacgaaatgggatatagcggtgtaattgaaggtcaagatttggcttttcaacaaacaattgaacgggtattaaaattaaaaggttttgcaacgaatttccctattttggctgaaaagtacggttataaggtttatgggtatggatttaatttaaaaaattattccgggtttaaatacctgcctaatttaagttattttgaagcaaagctcggttcaaaggaaaaatacgggtttattcttgcttttaaaaaaggtcaagaaaaattagctgataaaatcatagaaaagctttatgaaacaggaagtctccaaaatacagttgttgccataattggaagcggcaatgaaggggtttttggtgtatttgcccaaaaacttaaaaagaatgtacgggcagaaatccttgtggatgatggaataatatcgataatttctttagctttaggtatttatccgcaggaggaatggggtccagttttatggagtgcaatctataccggagactgggaaaaggataaccaaaataggattaaagagcaaaaagaaattttaacctatgttttaaagcttcggcagtcgctaaagggtaaagatttagaaattgcaaaatattctttagaaaaagagaaacttttaacaaaattagcggtgaaaaacgctgaaaaccggcgtttaaccggtgtaataaaaaggttgaataggttaatttcagcactaaaacttttaactttactcatctttgtaaccggagtattagcgcttttccttgaatataaattcttaaaaaagaaatatctgctattttaaatccggtaaagggttgttttttaatgttataaaaatcacaaataattcagaaaattttatatattataagcaggaattttaagtagaatgtcgaaaaatttttatgtaaatttgaaaaacattttccgtgagtggtaggaaaattaagttaaatggtcgaatatttaagttaaacgacggtcagtggaggggaaaaagttgaagttagcggttgcaggaaaaggcggagtgggaaaaaccacagtggcagcaggcttaataaaaattatggcttccgattacgataagatttatgccgttgacggcgatccagatagctgtttagggcaaaccttgggtctgtccattgaagaagcttatgctataactcctttaatcgaaatgaaagatgaaataagagaaaaaaccggggatggggggcttttaatcttaaatcctaaggttgatggtgatcttgataagtacggtcgttatattgatgacaaaattttcttaattcgcatgggggaaataaaaaaaggtggatcccaatgctactgccgggaaaattcttttttgggttcagtagtaagtgcgttatttttggataaaaaagaagcggttgtcatggatatgggagctggtattgaacacttaacccggggtacggccaaagcggttgacatgatgattgcggtaattgaaccaaatttaaacagcattaaaactggcttaaatattgaaaaattagcgggggatttgggcataaaaaaggtgcgctatgtgattaacaaagttaggaatattaaggaagaaaaacttattaaaaagcatttgcctgaagataagattctgggcattataccgtataatgaactatttatagaactttcattaaaaggcgaagagatttggcagtctacaaatccggcttttgtaaatcttcatgacatataccaaaaattgcgtttggaggtgggataaccaaaacaagagggggtgcttttaagatttacttaaaaatatttaaaaaggaggttattaaatgccaaggtttagagatttagagcatacctcaaaaccttccaaagcagatcgggtttgggaacccaagaatcggaaaagaactatcgatcctgctgctttggaaatgctggagaaagctgaaaaagatggggttaaaacggcgtttgatcgttttgtagaaatgcagccccaatgtcagtttggttataagggattatgctgtcgtttttgcttacagggaccttgtcgtttaccaaacgatgatcctagcaagaagggaatttgtggagcttccgcgtggaccattgcagccaggtctgtcggaacattaatcttgaccggagcggccgcccataatgaacacgcccgccacattgcccatgctttaaaggaattagcagaaggtaaagctcccgattataagattactgacccggacaaattaagaagaattgctcaaaggcttgggctgatactcaaggaaaagacgatatgaccttagcaaaggaagttgccgaattagctcttgaagattttgcgcggttacccggatttggtgaaaacctctggatcaaaactaccttaaataaagaacggttggaaaaatatgatgaatgcaatattatgccttccggtatttttggggatatttccgatcttttagcacaagctcatattggaaatgacgatgacccggttaacattactttcagtgctttaagggttgccttaaccgattatgccgggatgcatattgctaccgatttttcggatgttctctttggtactcctaaaccaattgttacggaggcaaacttgggggttttagatgctaataaggtgaatattgctgtccacggacacaaccccctcttaagtgaaaaagttgtagatgcggcaaaagaattagaagaggaagctaaagctgccggagcggaaggtataaatattgtgggtatgtgctgtaccggaaatgaagtattaatgagaagaggtgttcatttagcaacttcctttgcttccagcgaacttgcgatcgttaccggagctatggatgccgttgtggttgatgtgcagtgcataatgccaggattaaaacaagtcactgaatgttatcataccagacttattaccacatcaaacattgcaaaaatgcccggaacctaccatgttcctttccatattgaaaacgcccttgaaagcgccaaggaaattgtccgtttaggaattgaagcattcaaacaaagagttggcaagcccgttcatattcccgaggttaaacataaagttgtagctggatttagctttgaagctttaatggaaatattcgcccatgtcaatcaggaaaatcccatcagggtattaaacgatgctattttatccggtcaattaaaaggtgttgttttgtttgccgggtgcaacaacttgaaacggccgcaggatgaaagccatattactatcttaaaggaaatgctcaaaaacgatgtatttgtagtaaccaccggctgttcagctcaagcttttgcaaaacacggtttcttacggcctgaagcgttagaacttgcaggagaaggccttaagtccttcattaagatgcttgaagaaaaagcaggacttcagggtcaactacccccagcatttttcatgggttcatgcgtagataatacccgcgcttcggatattttggtagccatggcaaaagatcttggtgtggatacaccgaaagtaccttttgtagcgtcagctcctgaagctatgagcggtaaagcagtatcaattggtacctggtttgttacactcggtgtgccggtacacgtaggtaccatgccgccgcttgaaggaagtgaactgttctatagcattaccacgcaaattgcttccgatgtttacggtggttatttcatgtttgaagttgatccagtggttgctgccaggaagatattaaatgcgcttgaatacagaacttggaagttgggcgttcacaagcaaacggcagaaaagtttgagaccgccctctgccaaaactattaaggtaaggaggggagtatatgagcgaagttattaattttgatcaaatttttgaaggggcaattgaaccgggtaaagaacccaaaaggctttttaaagaggtttatgaaggagcaataactgcgaccagttatgcggaaattctcctttcccgggccattgaaaaatatggacccgaccatccggtaggttatcctgatactgcctattttctgccggtaattcgggcttttagcggtgaagaagtcagaacattaaaagatatggtaccaattttaaaccggatgcgtgctcaaattaaaagcgagcttacctttgaaaatgctcgcttggccggtgaagcaacctggtacgccgcagaaattatcgaggctttacgctatcttaaacacactccggaaaacccgattgttgtacctccctggaccggatttattggtgacccggtggtccggcagtacggtataaaaatggttgactggaccattcccggagaagcgattattattggacgggcaaaagatagcaaagctgcgaagaagattgtcgatgacctgatgggtaaaggtttaatgcttttcctttgtgatgaaattattgaacagcttttagaagaaaatgttaaactgggagttgactatattgcctatcctttgggtaactttacccaggtggtccatgcggcaaactatgcattacgggcaggtttaatgtttggaggtattgccccgggacttcgtgatgctcatagggattaccagcgccgccgagttttagcttttgttctctatcttggcgaacatgatatggtcaagactgcggcagcaatgggagctatctttaccggttttccggtgattaccgaccagcctcttcccgaagacaaacaaattaaagactggtttatttctgaaccggattatgataaaattgtacaaactgccttggaagtccgtggtatcaagataacttctatcgatattgaccttcctattaactttggacctgcctttgaaggcgagtccattcggaagggtgatatgcacgttgaatttggcggtggtaagactccaagctttgaattagtaagaatggttggaccggatgaaattgaagacggtaaggtcgaagtaattggaccggatattgattcggtagagcccggtggtagactgcccattggtattgttgttgacatttacggtcggaaaatgcaggaagattttgaaccggtactggaaagaaggattcactactttaccaactacggtgaaggtttctggcataccgcgcagcgggatttaacctgggttcgcattagtaaagaagcatttgccaagggagcgcggctgaaacatttaggacaacttctttatgctaaattcaagcaagagtttccatctatcgttgaccgggtccaggtaacaatttataccgatgaacaaaaagtcttagaactcagggaaattgcccgaaagaaatatgctgaacgggatgcacggttgagagaattaagtgatgaagctgtagatacctattactcctgcttgctctgtcagtcgtttgctccaacccacgtgtgcatagtttcaccggaaagggtggggttgtgcggagcgatcagctggttggacgctaaggcggcttacgaaattaaccccaatggtcccaaccagcccattcctaaggaaggattaattgacccggttaaaggtcagtgggagtcatttaacgagtacatttacaagaattcacaacgcaccattgaaagaatgaacctctataccattatggagtacccgatgacttcctgcggttgttttgaagcgatcatggcctacttaccagaattaaatggtttcatgattgttaaccgggaacacagcgggatgactcctattggtatgactttctccactttagccggtatggtgggtggaggtacccagactccagggtttatgggaattggtaagtcttatatcggctcgcgcaaatttgttaaagccgatggaggccttgcccgggtagtttggatgccaaaagacttaaaagaacaattacggtcaattattgaagaaagagctgaagaagaagggcttggtagggactttattgataaaattgccgatgaaacagtaggtactaccgttgacgaagttctgccattcttagaagaaaaagggcatccagctctttccatggagccactactctaaaaaagtactttccaggcggaaggaatttccttccgcctgcttaaagatttaaagatttaaaaaataactaaagaaaggagaatcggaaatgggcttaacgggattggaaatttataagcatctgccaaagaaaaactgtaaagaatgtggtcaaccaacttgtcttgcttttgccatgcaaattgccgccggtaaggcggggttggatgcttgcccatatgtcagtgatgaggctaaagagcttttggaatccgcttcagctccaccggtagctttaattaaagtgggtaaaggggaaaaagtattggaaatcggtcacgaaacggtattattccgtcacgataaacggtttgaacatccctgcggtttggctattttggtagaagatactttaagtgagggagaaattaaagaaagagttgaaaaaataaataaactggtttttgaccgggttggacaaatgcattcggtaaatcttgtagctttaaaaggtagctctcaagatgcggcgacctttgccaaagctgtagctactgcccgggaagttaccgatctgccttttattttaatcggtacccctgaacagttagccgcagcattagaaacagaaggcgcgaataatccgctactttatgcagcaactgctgataattacgagcaaatggtagaacttgctaaaaaatacaatgttccgttaactgttagtgcaaaaggtttagatgctttggcggagttagtgcaaaagataactgctttaggttataaaaaccttattttagatccgcaaccggaaaacattagtgaaggcttattctatcaaacgcaaattagacgcctggctatcaaaaaacttttccggccttttggctacccaaccatagcctttgccttagatgaaaatccgtatcaggcagtgatggaagcttcggtttacattgccaaatatgccggtatcattgttttaaacaccgtagaaccggcagatattttaccgctaatcaccttaagacttaacatttacaccgacccgcagaaaccaattgcggttgaacctaaggtttacgaaattttgaatcccggtccggatgctcctgtatttataaccaccaacttctcgttgacttacttctgtgttgccggtgatgtagaaggagcaagaattccggcttatatccttccggtggataccgacggaacttccgtattaacagcctgggcagccggaaaattcactcctgaaaaaatagctcagttcttaaaggaaagcggaattgctgaaaaagttaaccacagaaaagcaatcctccccggtggagttgccgtattaagcggaaaacttcaggaattatcgggctgggaaatcttggtgggtccgagagaatcttcgggtattaactcgtttataaagcaacgctggaatgtctaatctgagttttaaaaatgaaagaaggtactgtaatggcagaatataaagttttgtttaaaccagaccaaaaggaagtagcaatttccgaaaataccaatttaatggaagctttaaatttagcgggaattaatattaaaactgtttgcggtggtgccggtacttgcggtaaatgcctagttcgggtggtggacgggcaaaaaagagtcgaaagctacggaaaattaaaacaagaagaaattgctcagggttatgttcttgcctgtcaaacataccccgaaagtgatttaattattgaaattccttttgactcacgccttactcaacaccaaatagtaactgatgatgaaaaagcttctggagttatgaatgaattagatttagcggaagaagatgaattggaccctctttttaaagaagtatcactggaattaccggtaccaaccttagatgacccaagggatgatctatcaagacttacggcaaccttttcccgccaggaaaatggtaatctgattgtagaatacgaacagttaaaggaccttccacaaatcttacgaaacgaaaacttttccgtaacggtgggagttagtgattatctgggactgaataaagccctgtatattaaatccggaagtgcaagccagagggtctttggtttagcaattgatattggcaccactactgttgtggtgcaattggtggatcttgtatctggtaaagtgttgggaacaaaagggaattataacaaacaagcagcttttggggatgatgtcatcagcagaattatctatgtggacgaaaatccagatggtgcagaaaaattacgaaaagctgtattatccacaataaacgagcttatcttccaactttgcaaggaacatggtgtagagaaaaaggaaattatggctgcagtagttgccggcaatactaccatgacccacctctttttagagatagatccacgatatatccgtttagaaccgtatactccagctgctctgtttataccaccagtaccggcaacagaagctaaaattgaaatgaatcccaagggctttgtttacattatgcccaacgttgccagctacgtgggtggtgatattacctcaggggttttatataccgggctggcaaattccgacgaaataaccctatttatcgatatcgggacaaacggagaaatggttcttggcaataaagactggcttgtaacttgcgcctgctcagcgggtccagcgtttgaaggaagcggaattaagcacggtatgcgggctatgcagggagccattgaacgggttagcatttctgaagcaggcttaaaagttaaataccaaaccgttggaggaatacctcctgtaggtatttgtggttcgggtttaattgacctgcttgctaacttaaaaagggccggaattattgaccgtagcggcaaaatcgaccgaacagtaaataaagaacgaatccgcgaaggggaagatgggctggaatttgtcttagcctgggccaatgaaagcggtaataataaggacatagtcattaccgaagcggacatccaaaatttaattcgggctaaagctgctatttttgcaggagttcggacgatgttagctatggttgatttgcccttagaagctattgaccgggttatcattgctggaggatttggtaaatatctcaacataaaagatgctataaccatcggccttttaccggacatcgatattaataagttttcctatgtggggaatagctcgctaaaaggtgcaaggaaagccttgctttcccgaaaagcttgtgctgaggttaaggaaatagcacggaaaatgacctaccttgaattaagtgtaggtactactttcatggatgagtttgtttcggcatcgtttattccccataccgatttgcatctatttccttcagtagaataagaaaaggcaggaggagttgtcatggcctttaaaattgcggttgcaggaaaaggcggtacgggaaaaaccaccttctcggcattagttatcaaacagttgctaatgtctggtaaaagacccatcctggctgtggatgcggatgccaatgctaatctaaatgaagctctgggtttacaagttgaacaggcaatttccgatgtaataaaccggttagcgaaaaatatggatcccattccggcaggtatgactaaagaccagtatataagttttaaaattcatgaaaccctttccgagggggatgatgtggaccttttagtaatgggaggccccgagggtcagggatgttactgttatgctaataatttattacggcagtttattttaactctcagcaataattatccctatatcgtaatggataacgaggctggtatggagcacttgagccgtagaactaccgatgaggtagatgtattttttgtcataagtgacggtagtgtgcggggaataaggtcggcaggaagaatcaaacagcttatcgattccttggatttaaaaatcaaagaaaaatacttagttataacacggattgaggaaaaagatatccctgaagttcaagaagaaattgagaaaaccgggttaaagttaattggtgtaatacccaatgatgagttggtgacggaatttgaccggtatagcaaaccgttaattaatctacccgaggatagtaaagcggtagtggcagtcaagaaaattttacaaaatgcgggtattatctgataagaaataacggaaaggagagatttagatggctgttgaggttttaaaagaaaagtggaattcaaaagttgtagaagtaaccttaggtactggcgataaaacggtaactttgggtggcgacagtactctacctttcttaacttttgaaggggaaatgccaaatccacctcgctttgcattagaagtatttgatacaccgccaaccgactggccagatattttagttgagcctttcaaagatgtaataaacgacccggtagcctgggccaaaaaatgcgttgagtacggagcagacatcgtagctttaaggctggtatccgctcaccccgatggccaaaaccgatccggagcagagttagctgaagtttgcaaggctgttgctgatgctattgacgttcccttgatgattatcggctgtggtgtggaagaaaaagatgcggagattttcccggttattggggaagccttatcgggaaggaactgcctgctttcttcggcaacaaaagacaattataagccaatagttgcaacctgtatggttcacggtcattcggtagtggcttccgcgcctctggatattaacttatcaaaacagctaaacatcatgataatggaaatgaaccttgctcctaaccgcatcattatggacccgcttattggcgcattgggatacggtattgaatattcgtattccattattgaaagaatgcgtctgggagccttaaccggtgataaaattttggccatgccggtagtctgttttattggtcaggaagcctggaaagcaaaggaagctaaagatcccgaggttgccgaatggggtgattatgccctgcgggcaatccactgggaaaccgtaactaccgttgcgcttattcaagcgggagggcacctctttgttatgcgccatcccaagtctttggctgaagttaaagaacatctaaaaagaattttaaaataatttacaggagggaaatttaagatgtttataatgatcggtgagcgtattaacggaatgtttaaggacattcgggaggctattttaaataaggacccacgtccgattcaagaatgggcgagaaggcaggctgagaaaggtgcccattacttggatgttaataccggtccaactgccgatgatccggtgcgcgtaatggaatggctggtaaaaacaattcaagaagttgttgatttaccttgttgccttgattctactaaccctgatgccatcgaagccggtttaaaggttcaccggggtcatgctatgataaactctacttcggcagatcagtggaaaatggatatattcttccccatggccaaaaaatacgaagcagcgattatcggtcttaccatgaatgaaaagggcgtgcccaaagatgccaatgaccgttcccaattggcaatggaacttgtggcaaatgctgatgctcatggtattcctatgactgagctttatattgaccctcttattttgccggtaaacgttgcccaggaacatgcggttgaggtattggaaactatccgccaaattaaactaatggctaatccggctccaagaacagttctgggcttaagcaacgtttcccaaaaatgcccggatcggccgcttatcaatagaacttatctggttatggctatgactgccggcttagatgcggcaataatggatgttgatgatgatgccctggtagatgcggcggccactgctcacatcttgcttaataaagaaatttactgcgattcttatcttaaaacctttagacagaagtaagaggacggggctctgccccgtcttaataccatttatttaattcaatttaaggcgagggattgtaatggccaataacaccttaactatggaaattgcagaactgtcccatcagccggtaagtcgctgctttcaatgtcaaaaatgtagtttaggctgtccggtggcggaagaaatggactatcttccccaccaggtagttgatttgataaataaaaacctatcagaaaaattgattggcagcaatgcctcttggatttgcgttagctgcaaaacctgtgttcagcggtgtccaaatggtattgatattggggctatccacgatgctcttaaaaatattcattttaaacataaattacctgtcggagttaaagcggttgctgatttttacgaaagctttttggatacggtttatgactatggacgggcttacgaattagggatgatagtgaaacacaagttaaaaaccaaaaactttactcaggatatgaaaatggggttacagatgtttttaaaaggaaaaataaagattactccccataaaatcaacaaaatatgggaagtcaaaaatttattttccagtgtaaaggggagtgagtaatgaaaaccggatattatcccggatgttcacttcattcaactgctaccgaatataacgagtcagttttggccgttgtaaaggcaattaacaacgaggtaaaagaaatcgatgattggaattgttgtggagctaccgccggccacagcacttcatcggaactggcaattggacttccccttcgtaatttaatgcttgcggaaaaggaaggatttgacgaattgttggtgccctgtgcggcttgctataatcttttcaaaaccgcacaatttgaagttgcccatggtcaaaagcaagatttagttgccgacatggaacatcaattagggttaacataccaaaataagataaacgttttaaattttattgaatatgttttaaaaccagaaaatatcgaaaaaataaaaaaattaattaaaaggccgttaggaggaataaaagttgctgcttactacggttgcttgcttttaagaccacacaatgtagttggatttgataatcccgaaaggccaacaaaaatggaaaaacttctggaagctttaggagcttcgccggttcgttggaatgcaaaaaatgaatgctgcggtggtagccaagctctttcaaaacctgaattggttgtgaaactggttaataatattgttgcaaatgcccgcgataatgaagcagaactgatagttacggcttgtcccctctgccaggcaaatttagatggacggcagataaactgggattcaccggaacaaaacaaacagcttttaccggttttatacatttcggagctaattggttatgctttgggtttacctgtagaaaagtggtttgccaaacatcttgttcccccttcgttaaaagcttaaggggaaggtggggaggtttttatgacaaaaagctatctggtaatcggtgccggcgcagtgggattacaaatagcccaggatttagaagaaaatgggcatgaagtttggctggtagaagaatcagcaatgccgggaggaaagtttaacagccaaaaacctttggaaccgggaataaaccttgcttattttagcggaacctaccatcccggagattatttgtttaccagtaaagcagtaagtctgatggcttccaaacgggtaaaggtcctttatggttcaaaggtttcggtgattaatgaagaaaagggaaaattttataccgaaattattgctcctaaggaaaactacaccaaagtttttgatggagtgtattttacccctggctttgtgccctttaatcctgaagaaagagccgaatacttgtatgggataaataattttgtcttaacgggcttagaattagagaatttactaaaaactggagaaataaaaaagaatccaccggaaaaagtagcgtttatccagtgtgtaggttcccgaaataacggaattgggcctggaaagccttattgctctggcttttgttgtttatatagtttaaaagaaattgaccttctgaaaaaagttttgcctgataccgttgtcaaggtcttttatttggacttaaggctttacaataagggtgctgaaaagttatatcagagagcggtcgcaaataatgtaagttttattcgcaacatgatttcggctataaaagaagaaccaaaaagctataagccgattattcgttatttaaacaatggacgttttaaagatgaactttttgatttggtagttttagcccaaggagcagaaataagcccaaatattaaaactcttttggccagtctcaacattgccgaaaatgagctcctggaattttacggtacaccggaaaatccccatcaaattcgaccgggaatatactttgccggttcgttcttaaatccaatggatggcgcagacagcatggtctccgcaggttctgcaactcttccggaaataaattttaaagaaaatgtccaaagcaccagggaaattaaatattttaccaacaccggtattattttctgtaattgtcgagggtcattgccggttgatgagctaaaaggtacagcagcagatttaccaaatattactatttccgactgtttgaatgaagatgatctgggcaaagtaagaagtttcttactcgacaaccaaattggtaatgcagtttttgccggttgtagcaagataaaaattttgcccgggttggagaagttagcttatgaggaatcaatcggtacaaggtttgaagtggtaaacctgaaagaacagggatactctttatacggcaaggaaaagtttaaagctattgcgccaaaattggtagcaggagctttagctcgcctaaaattcagcactaacccggcgcttaaggtgaaaaatgatattaactttgatgtagttgtaataggcggtggtcttgcagggttaaaagtagcggaagcactaaccgaaaaaggcgttttggtaacagttgttgaaaaacaagattcctttggtggtaagcataaaaataaagtcattcccttagagggaattaatttaaaggagtttattgaaaaaatccttttaaagttagaaaaccgcggggctcttttactaaaaaatgcagaaattgtggaagtctcaggtggtccaggtaattatcaattaattattgaacgctttggtaagcgtttgaacatcaacgctgctgccgtcattttagcaaccggaacgcaaaagagttacggccgctataaaaaaacttcgcaagttatcttccaggaagacttattttcctcggcggacttgctttcgcaatgtgactcaattggttttttgcaatgtgccggtagtcgaaatgatttaaaccccatttgcagtcgcaattgttgcgtttcaagtttagatgcggcaatctttattaaagaaaagtttccggaaaaggatgtctttatctttcatcaggatataatggcttacggtaaatatgaatacaagtacttaaaagcaagagagttaggaattaagtttgtggtttataatcgcggtcaatatccggaaattaaatctaccggcggtaaaattcaagttgttaccaacgagaactatttagacgatgttgtccttgatttactggttttagccgaaggggctgttcccaataaggaaaatgaaaagctggcagaattgttcaaagttgggcttgatgaatttggatttttacgggaatcccaccaagatatttctggaggttacttccccaaatggggagtctttgtggccggtgaagctcaaggacccaaaaccgtaagggagatcctctattctgctcaaaacaccgcaaaaaatgtgctgacttatctaaatcaattacaaaattcccagttaaaagtcaattacagtgaagttattgaagaaaagtgcgctgcctgcctaacctgtgttcgggtttgcccatactcggttccagtagtgattaatggcaaaaacgttgcatatatcgatccaatttcctgtcagggctgcggtatatgtgcttccgaatgtcccaacaaagcaattgttcagaacaatcgtccccatcacggggtattggctgaaataagggtattagcaggggagggtaaatgatgacggctaaaattttaatttatcagtgttcttactgttcctatttaactttcgatttattaagtcaatacaaaatttctttaccggataacattgttcttaccgatctcccctgtaccggcaccatatcagtaaatatgttattagaagcggtggagaatggttttgaaaaggtatttgttttaggcggaaccggtaatgattgccgctttttaaaaggtagtcaaagggcacaaaaacgagtagaagaggcggtcaagattttaaaggaaatcggttatgacagagcaacaattgctttttacggcttaaagccgggagatgttgatagtctgaaaaacatcttaagtacgatttaattacctgaggaaagggtgaccaaaccttgattgttgctgaaagaaaaccgctcgaagaaataattaagatggtggaaaagcatgaaagtattttagtcttgggatgcggcggttgcgttacggtatgtttagccgggggtgagaaagaagcagaacagctcgctacgaccctgcggctttacttccaaaaagaaaacaaaccgtttaaaactattaccaccactattacccggcagtgcgatccagaatatgttaagtccgttgcggaagaagttgccaaagtcgatgctgttttatcaaccgcttgcggtgtcggagttcaatttatggccgagaactatcctggtaaatgggtttatcctgctctaaatacaaagtttgctggagcaaatttagagttgggagtttggggagaaagatgtggcctttgcggagaatgtattttacacctaaccggtggggtatgtccggtaatccgttgttctaagagcttgttaaatggcccttgtggtggctcgcagaacggaaaatgcgaggtttccagtgaaatcgactgtgcttggcagttgatttatgaccggttaaaaagtttaaatagccttgacctaatccttaagattcaaccacccaaagattggtctaaagcccgggatggtggtcccaggaaagtaattaaggaggaggtccggttatgataacggaaagccgcctggaaaaattatttgccgaaggtcattttgtggttacggcagaaattggacctcccaaaaacagtaacggagaagtagtacgcaaacatgctcgtaacttaaagaattacattgatggagcaaacttaaccgataaccaaactgcggtggttagattatccagtattgccgctggttttcatgtattatccgagggagttgaaccaatcattcaaatgacctgccgggatagaaatcgcattgggcttcaatcggacttattaggagcgtatagtcttggaatacgcaatgttttggccctgaccggggaccaccaatcgttcggtaaccatcctactgctaaaaacgtctacgatttggattcgatccagttaattcaaaccatcaaaaaattaagagatgaaaaacaatttttatccggtgaacctattaaagaacatgaaccgcgctttttcattggcgccgtagaaaatccttttggtgatccctttgagtttcgagttttacgccttgagaaaaaaatagaagcgggggcacagtttattcaaacccagtgtatctttgatatggaaagatttgaaagatttatggaaatggttagagaaagagggctccacgaaagggcgtatattttagcaggtattacgccattaaaatcagcgaaagctgctaagtatatgaaaaacgttgccggaatgataatgcctgaccatataatagaacggatggagaaagccgaagaccaaaaagaagaaggggtaaaaattgccgttgaaatgattgaacacttaaagaatgttaaaggcgttgctggggttcatatcatggcaattgcctgggaagatattgttccggttattgtggaaagagctggactgcttccacggcctgaagtttaaacttcaggcttttttcttttaaacttcctgattttctgatatattattattgcgagattggaggggtaggattgcaggattaccatatacaccccggttactcaatagatgcagccgattatccgctaaaagattactgcgaaagagctcttgccctaaatcttaaagaaattgcctttacaacgcattttgaggcagagccagaaagaaggcacctggattggtttgtaagagtaaacggcgagatacaacctatggaagttgatgaatggttgaagttctattttgccgaaatagaaaagttaaaagaagaatataaagaccgcttagctataaaaattgggttagaggtaggatattttgaaggaattgaagaaaaaattagcaaattaaaagaaaagtacccctttgactttttaatagggtctattcataccttagatcatcttgctatttcttcaaaaaaagaagcatatcaattgtttgttcggtattcggctaaagaaatcattaataaatattttgtgcggcttgaaaaccttgttaaatccgggttatttgaagttattgggcatttggatttattcttgcgatacgggcttaatttttttgagcttgaaaaattgttggtttttgatgaaaaaattagggatattttctatttgatcaagcaaaagggtcaaattattgaattcaacacctcggcgctcaggcgcggtcataatttcattcatcctcatcaattttattttgaaaaattgctcttggcaggtatcgataaatttgtaattgggtccgatgcccataccctttcggagcttggttatgaaagccaaaaagcgttagaaattcttaaaaaatataatttaaagccggtttcgttggcaagaggtaaatgggtaatttgggaggacttctgatgagcggattaactttgtttttagctgagctatttaatcaagggttgctaagtgttcccgtttttttattaaaaaattaccggcatctaaatttaacggaaaaagaattggtatttttacttcaactgatgagttttaataatgaaggaaacttattaccttcggctgagtttttagccaaaagcttaggagaggatttaggagaaattaaaaagaattatcgcgagttaattaaaaaaggcattatttctgtgagcaagaaatttgatgaaaaatctggaaaatatgtagaaacaattgattacactccgcttttcgaaaaattaaccgatctatgggctgcccaaaaagtcttaaatgaagtaaacaataggcctttagaaaaaggtagcgtagattctgcggcaagagtggtagaggtttttagccgggaatttggaagaggactgtctcctattgaaattgaacttattgataactggttaaatcaaaaaaaatactcagaagaattaatctatgaggccttaaaaagggcagtaattttaaataaaaaaagttttcggtatattgatgctattctttaccgctgggaaagtaataatattaaaactattgaagaagttaataactttgaagagcaaatgaagaaaaagaagactgctaaagccagtaaaaatgaaaataatgacatggacgagaaaaagaaggagctaattaaaaaactttatttaagttaggtgatttaaatgacaaaatgtttaatttgccaggatcgtgggctaattttaaatgaaaagggagaatatgaaaaatgccaatgccttagcaaaaaagatttaagcttaaaacaggaaaaaagttttattccaccattataccggaatatgacttttgctgattttgatttgagctattattcaaaatatcacatcgaccgcgagagaaacatttcctattacgaaagtgcccaaagggctttaaaggctgctataaattttgttaaacttcttaccaccaatcaaccggtaaaaggattgtatttttccggaccggtggggagtgggaaaacgcttttagcagcgataattgccaatgaagcgcttaaagcagggaaagatgttttatttgtagttgtacctgaatacttagaaaaaattaagcaaagctttggtgatgaaaacgatggttacttaattgaaaaagcgttatccaccgaactattaattttagatgatttgggtgctcataattataccgaatggacaaaaaatactttgtatttaataataaatcaccggttgtactatcaattaccggtagtaataaccacaaatataagtcttgaagatttagaaaattatttaggagagagaactacttcgcgcatttttgagctttgccatcactactggctaccggtggatttagatattcgcctgaggaaaacccgaggaatgtagaaaaataattagggaaaactattactgtttaaaaaaaacaacgggctgattgacatgcaagaatcccaaaggcttggagaaattcttcgggttttaagtaaatatgggctaacggtcctgaaaaacaagttacaaaaacaagttgtattaacggattcccagatcctacaactcttcaccgatttaggccctacgtttataaaatttgggcagtttttaagtacgcgccctgacctggtagacgaaaggtttataacagtacttcgtaatttacaggataacgtaccagcggtttcctttacggtgtgcaaaaaatttattgaagaaacttttgcggtaaactactttactaactttaaggaaattgacccccgacctatagccagtgcatcaattgctcaggtttatttcggaattttaaaaagtggggaaaaagttgttcttaaaattaaaagaccagatatagaagaaactataaaaaccgatttggaagttatcaaaaagtatttactaccacaattaagagctttaggatttatttcccatttcgatttgaacaagattttcaatctatttgaaatcaaacttaaagaagaattagattttttaaacgaactgcaaaacttaaaaatttttcacagggctcttaaaaattatgaagacctgataattccgaaagcatttaaggaattatcgggacggaatgttttagtaatggagtacgtggacggcaatcttttaaaaaattttttagagcaaaaggtatattacccaaccttaggagagaagctaatccataacttttgccgtcttttattttgggaaaggatatttcatgcagaccctcatccgggtaatattatttttaccaaaaataaaaagctttgctttttggacttgggtgccgttggctttgtagaccagagaaccgttgaaatcctggccgaactatttatttatttatgtgaaaaaaatttaaatggagtaattaatttaatttttcgcctgggacaataccggggagaaattgatgagtttactttttaccaggaaatgtacaagttacttgaactcgtttcggaagtgggtaagggtgaggtcttggcgggaaagctaattcttgatattattaaaattagtatcaagtatggtattaatttgccggtaaatcttgtttatatcggtaaagctgcgttaactctggaaagtactgctatttccctgggaacacgttttaatttttttgaaatcgctaaaaaatatggcgaagaaactttaataaaaactaccttaaacacattggcaccgtccgatatagctttaaatttatacaggtacttggaaattaagggaaaattaccgttgcttttcttttcaatcttaaaaaagtttgatgagggaaccttccaggtaatttttcggcatgccggattagaaatcttcatcaaagctttggacaggacttcaatgagaattacttttgggttaataatttcttcattacttattgcttcaggtttaattgtagctgccgatggccggcttttgcaaactttagggactgccacctacatattatcaatacttgccgccggttatttaatttatttaatttttaagtcaggaaaatggcattaaacgaagggggagatttatgagttccgaagtttattttgtgaatgtgcgtgcccagaaaggagcaagtttactggaaaaactggaacgcttgattgaccggagcgggttaatggatattgtagcaccaaatgatttggtggcaattaagcttcattttggcgaaaggggaaataccgcttatattagacctcaatttatcaggagaatagttaacaaagttaaagccaaaaaaggaaaaccctttctgaccgatgccaataccttgtatgtcgggagcagggccaatgccgtcgatcacctggaaactgctattgaaaatggttttgactatgctgtagtgggtgctcccttaataattgccgatggtcttaccggaaaggattacataaaagtgccagttaatttaaaacattttaaagaagtaaacattggaagtgctgccgtcttagccgatgccctaattgctgtaacccattttaagggccacgaagctaccggttttggcggaaccctgaaaaatataggaatgggtttgggaagccgttcgggaaaacagcaaatgcactccgatctgctgccggaagttaatgcggaaatctgtaccggctgccgaaaatgtgcccgctggtgtccggctcaagccatttcgtatgaaaacggcaaagccgtcataaactatgagctctgcataggttgcggtgaatgtaccgtaacctgcaattaccatgccataaaaattaactggaaagatgaaaatgatgttattcaggaaaaaattgttgaatacacctatggcgttttaaaagacaaaaaaggaaaagctgcttttattacttttttaactgacatttccccggattgtgattgctgcagttggaatgatgttcccctggtgccagatataggtattttagcttcctttgatcccatagctattgaccaagcagccgtggatttagtgaataatgctggatctattgagaactccgttataggtaaattagctccgggggttgataagattaaagctaacaagccttcaattaactgggagaaacagttgatttatggggaagcaataggtttaggctcccgaaaatacaagttaattgaagttaaataataatctttttgacaattacatctaacttaacaatttcaataccggtttgtccttcaaattccttgataacgtgtggtataaattttttaatttgctgggggatatctgaacttttttccacagctacttccaccgttgcggctaacagtccgtatgaataagttagatcaatgtttaaaaccttttttacaggtttattttgggataagataaaagctaaaattttttctaacgcatcttccgcaatcgacaatttacccaattcgttgtaaaacggcttaactattgttttatcgaaaacagtctttactttttttcctcttttaaaataaatttttaccggttcaaaaaatatcgctggaaaagatttttttacttcaaaggcgggtaccggtataacgtgttttccaaggcgcgaacggtgaaaacgggcaatttttatttcatcgggtgatgcgacgtcatttatgtaaataaacctttcgggtttttcgagggataaattttcacatattttttcgaccatatccttggatgttcctaaaactaaaatattttccgattggtagttttccaggattttttttgccatttcccggtgaaaagtatcctgaaataaagcggtgcgaatagcagcaatttttgatatttgcttttttgccgaaattcctcctaaaattttttgacctttaattatcaagccatcgtcgataataatttgacaattattttcaaaagcaattaaagcagctctatgactttttcctgtaccgctgggtcctacaaagcctattgtagccattttagatactccttcctaattaaaaaatatttaatttggaggtgttttgcaaatgtggtatattgaaaaacacaatgaaaattatcaagttggttggagggtttctgatatattatatcagaaaaaaaccccgtatcaaaacctggcaattgttgaatttgctgaattcggtagatccttaattttagatgatgcggtccagaccacagaaaaagatgaatacgtttaccatgaaatgttggttcatcctgcagcttttacccataagtctccccgtcgggccctgattataggaggtggtgacggaggaactttaagagaagtattaaaacataaaactattgaaaaagttgatttagttgaaatagatgaagaggttatcaaagcttcaaagcaattcttaccatctttaagtgaaagttttaatgatccccgggttgaagttattattgatgatggtatccgttacgttaaaaaagtaaaaaattattacgacctgatctttgtggatgcctcagaccctgtgggacctgcagtggttttatacagtgaagaattttaccgttccctttttgatgctttaactgctgacggaatagctgcggttcaatcggaatcgcccaatttctaccccgatattttcgttaaaatcgtaactactttgcgagatatttttcccaaggtaaatgtcgctttagctcccgttccgtcatatattagcggtttctttgcttttaccgttgcttcaaaagtttataatcctaaagaaacaactcccaacattacgtttcctactaagtactacaatgaagaaatccataatgcttgctttgcattaccaaactttatcttagatatgctaaaaatccgctaatttttagcggatttttttataaaaaaaggagttttaatttttaaaccgaataaattaaataatgagggaaggaaatggaaagcaaagtactggaaatgctcaaacaggataaaattgtttttaaagcttctgaaaaaattttattaaagccacttaattccttaacccgggaagaacggagaaaatattttcaagaaattgagccggagcttaaagcattgcggacggatctccaaaatttatttaaagccaatccggcaatgcgggagaaatatttaaatgcagtagtgtcagaagttcttgacaataaaggggttataaacactttaaattccactgtaattaaagctttaggctctttcgacttttaccgtttattaattgcaaaagctcgggaaaaaaacataaaactttcgctgcaaactaacaattatacctttctggtctggcttttattattttttgtcttgtttttctacattcttatcaccaggaggagttaaaacttgagcccctttaaaaacgctctcaaagaatttatcttttatgcgggaaggcatcgtatcgccgaacgtaccgggggaaagctttgcggggataagatttatcttaaatacttagggcaaaatatttattttgatttaacccgctttacttttagttctttaaaacttgatgagtttgataaaactttaataattcggtatttttatcaggcaagtggttttcctccaaaaaataggtggctttcctttttagatttgccggaaggaatgcaccattaccagccatttatttatgaagccttaaagcctctggctgaaaaggcgtttttacccgaaagattaagttctttaaatgccgtaaaattagcctttggttcggagtcttaccaaatttaccctttacccaggcttcctcttgctgtaattaagtgggataaccaaaaaagtcaagttttgtttgaccaggtttgcttatcttacttgaaaacagtagatttatatgttctgggcataaaaacggtaaactacttgacaggcgggatataaaaatatatgtttggtttctttaaacttcccaaaaaccttgcagaaactgaattcgggttaaaattcaaggctacttattgtaccctctgtaaagaattaggctcaaaattcgaaggctttaaactattcaacaattacgatttcaccttctgggcactttttatagattctttttttgatgaaaatcctaacgtggttagttttttttgcccgtatactgtaaaaaagaaatttcgttataataaacctacttttggcatcgtaaaagcagcatattacacaaaactttttatgcgcttaaagttaatcgactttttgcaggacctaccaataaagcatattgttgcccggaatttatttgactctcttttacacgaacaacatcttagagaaaaaaataaattacagaccctagaatactatggagaaatttcgggagttcttttgggtataattacggcagatacattggtcgaacgtcatgtttctttcgataaaatttttgctgcttataatctttcttattttattggacgctatatttatttagttgatgcccttagtgattttaaaaaggatataattttacgcagatttaatgcaatattagcagcttatccggatttgaaaaataaaaggtacggaaaaactttttacgaaattaatttcgtcttgtaccgccatttggaaataataaaaaagtacctacttgatttaaataacaggtttgctccggaaatgatagttgtcttacaaaatagttacatcaaagctattgagctatttttaaaaaacttatccctaagggaggatgaatatggaaacttacctgaatcttggcgcctacttaccaaaaaatcttgaactttactgggaaaagataaaggaaaaacccctaactgaacaaataaaatacgtaacagcggatttaaaaaacggccttagcggtgagtactggtatttattgggaattttatacgatcttgctggtgagttttcaaaagcttttcgggcctttgaaaaagcagaaccatttcttcaagataaaatttttaattattatccccatcatccccgtggctaccgcagagaaggtctttctttatgtgatgtggcgtgtggtgcctgcttgttagacacctgctgcgaatgcatgggaggagatttcatttcgtgctgttaaagaaagatcttatggcaacttttcttggaagtttggcttttttagcaacatttgttgcagaatattttcacatcgctccaagggtaataggcattggtgttggttttttggtgttattttgcagcaattttttaggaaagcgccaggcatttctttacgtgctgatattaactattttagcggtattatttcttaatcctatagttgctttaaaatatttcttgctttacctacttatgccactcttgctggcaataggtgatggtaaactttctttaaaaatcctaacccttattattggtagcggaggaatatttttatacttattagcttatttaaaatactttaaatttatttacatcctaagttataaaataaatagtattggatacttaatagtgattgcaatttttggcgcagctgtgtattatttaattttaacttacggatggacttacataagaaaaaatattccggctaatttcttaaattatttatcaaatattcttgactaacaaaaaaaaatgatgcataatataatagcgacaacgggttgtagcgcagtttggtagcgcgccacattcgggatgtggaggccgtgggttcaagtcccgccaacccgaccattgaaaataaagccccgcaaggagttgcggggctttactatttttaccagatgcgtttatttgtatgattgctaaaagacatccgagtgtcccaatctttcggaaattatttttgcgggaacgccggccgctaaaagaaaagtggcgtaaaaatgccggagatcatgaaaacgtgcctgaatcccaagttttattacagttttaataaatactctggtaacatagtcaggtcgcaaagacagtccatcttcatagatgcaaatataaccagtatcattataagcaggaccaagattttttatgttcattaattttttcctttgcttttagtaattcctttttaactatttcaggcatgaaaaacagctcttccatgacctgatttaggctctttttcatacggttttcctttaacagaaacaatattacgacgaacaaagactactccattatccatatctatatcttcccattttaagccaagggcttccccttgacgtaaacctaaaaaagccgagagaaaaattggcatatacgcaggttcgccatcaattgcttttaaaatagattccacatctcttggaattaaaacaaacatttacttttggttttggctttcctggtggttcaatttcatcgcgggggattttggcaacaagattccatttgaatgccatgttttaaattttaaattttgaaactaggaaaactccatttatctttaattttattttgttaaatttatatcttatcagctagaaggatttaatttgtttgcatcgaattagtaatttaaagcagataaatgtcgtcgatgttttagggttttggcattcttggatttcgacgacgattttaaggttttcacactcgcttaaaaatgaaaaatttctatttaagaaaaaataaaaataaaacttcatataacataaatttagcaagatattttgcttctaccttcagaaagtttgaattattaagaagagaaaagtgttaaatattgcagaatattcttgattctaatcgtatatttatttttaattttttaaactatatgtggggtaacctaaaaaatttcagagaaataaggaggaatgaaaaatggcaagtcgtattgtgcataccactaaaatgacttgggtattggacccccgggagccaatgctaggccctgtagtagatgggggaacaattgttgcccgagtttcacccgggtgctggggtcctatgattactcctgattatcctagtggtcacgaagttactcatcctgttgcagttgaaggtgctgaagtaggagatgcggttttaattaaaataaagaaaataaacgtcttgtcgctagcaacgacatccggtactgacagttttaatgatggcaattatgttggtgatccttttgttgccaaaagatgtccgggatgtggagcaattaatcccaaaacatatgtagatgggattggcgaagacgccataaaatgtgtaaactgccacactcctgttaagccttttcatttagataacggttacacaatgctttttaatgaagaaaggaccataggtattactgttcctccagagttggctaaggaaatagcaaaacaagcaagtcattttagcgcaattccccctgaatcacatcagtattcctcaaaccttattgccaaaggtgacctagctggagtgttgactcgtgttcgtccgatggttgggaatattggctcatgtccagctgttcctatgccatcttcacacaatgctggagattttggtagtttccttttaggtgctcctcatgattatgcgcttactgaggaacaacttcttttaagaacagacggccatatggatataaacgaagtttgtgaaggaacaatgataattgtaccggtaaaagttccgggagctgggatatatgtcggcgatgtccatgccatgatgggggatggtgaggtagctggtcatactaccgatgttgcagctgaagtaattattgaagtcaaagtaataaaaggtttaaaaattgatggtcctatcattttaccaagacctgaagacttaccatatttagcccgtccatatactgaagaagagaagaataaagcacgtcatttagcagagatttacggatttaatgtggaaacagaaatgtacccacttcaggtgtttctactcacataaaataaccgtccaatgctcagatttcgtggccaaatagaaaaggaatttgtttagataatggcgaataattggagaaaaaatctaaagaaggagaaaaaggaaaagtcttcgagtaaggtttacggagctgacactccccttaccgaagactttcctccataccgtactttgattgtaacttatcttggagcttcagtaaaggagtatttagaaaattacttaaattttttggaagaaaaccaatggtattgcccggtttgtagtgcaaagatgtcttttcacggatggtatcgacgaaaaataataaccttagatggaactactactagaattccaatagcccgctatcgctgttctaactgccggaaaacccatgccattttaccggattttgttgcgccttaccgccattattcccaggttttgattgcagctgtagttgaagaagtagtttccaagcaggtaccgccagaacgggtcgagggcaatcaggatattcccactactcggcgatggatacgccgatttctaaagcgatgtcatgaggttataggcgttttagaaagtatagcttttagatacaccgggcaaataaaatcgcttctaacggaagcacggtcgtcgccctgggagcaaatgcttgcggctttagaactactgccggcggtaaaagctacttcggtgtttggtgcggtaaatctctggctgaccatggacgtggtcggcctctggctttaactaatttcacatagtttggtctcctggccattcttgggattgtggtatggtgaatttaacaccatatttaaacaaggagatggtcaggttgccaaaggaattatcttatcagcaagaaattgctcttaaacgttttgctctgatagcacctttgctggagccggatttagaagcggcggaaaagcgccaacgccggaaagaaatcttagccaggagtgaaatttcctcccgtaccctgcgccgctacttacaactttaccgccagcagggtttatccggtcttatgccaaaaatccggtctgataatggaagcagtcgtactataagccatgaaataatcgaagaggcggtaaaacttaaggaagaacttccggaacggagtgtaagccaaatcatagcgattttagaaggagaaaagaaagttcctgcaggaatgttagcccggtctacccttggaaggcatctttctcgtttaggcctaacccaaaaggaagctaaccaaaagatatcagggcacaggcgttttgcaaaagaacagcgtaatcgcctctggcaagcagatatcaaatatgggccgtatctaccgcatccaaagaatcccaaacgcaaagtgcgaacttatttagtggcatttatcgatgatgctactcgtcttctttgtcatggagagttttatcttgaccagaagaggccagttttagaagattgttttcgtaaagccatcttgaaacgaggaatcccggatgcggtatatgtagataatggcaagatttttgtttcccgctggtttcgtttgggatgtgccaggctggggataaggccaattaatactaagccatattcacctgaatctaaggggaaaattgaaaggtttaaccgcaccgttgagtcttttatagccgaaatagaactgcaacaacctgagaccctggcagaacttaaccaggcttttgctgtttgggttgaagaaggttataaccaccacccgcacagctctttagaaaacgaaactccggctaaccgtttccagaaggatacccggcgtttacggtttgccagcctggaagaatgtcgggaagctttcctctgggaagcaagtcgtcgggtagataaaacaggatgtatcaaacttgaaggacggttttatgaaattggtttggaatggatacgaaaaaccgttgatctccgttacgacccttttgacttagaaagtatcgagttctggtataacggccaaaagcagggactggccaagcctttggttatccaggaatacaacaaccttgctgcaaaaaataaaaaagagcaagaaaataaaacaccaaaaacttcccgcctcttaacagtacttgaagaaagaagtattgaacgccgccggcgaaaattaggggccatacccttccgccagctggaagggggtaagtaaaaatgtttgaacacttttttggttttcaccgcacccccttcgggagggatctgccggtaaactctttgtttaccactcctgcccatgaagagctggtatccaggcttaaatatgcagcggaaaaacgcctctttgccctaattaccggcgaagtaggagcaggtaagtccacagcattacggcaactattatcgctattaaaccccaataagtaccgggttatttatattagcgattctggtctaactcccaggcatttttactgggaagccctgcggcagcttgactgtgagccacgctttaaccggggacaggctaaacgtcagctgcatcaggttatccttgacttagcagaaaatcaacagaaaataccggtagttattgtggatgaagctcatctccttgaccgggaaatgcttgaagaaatacgctttcttttgaattttcgcatggattcgtataatccaatgagtctaattctggtaggtcagccagaactgcgccgtatcttacaacttcaggtttatgaagctattgctcagaggattaaccttcgctaccaccttccgcccatggaacgggaggaagcaaaaggctatgtggcccaccatctcaggacagccggggcaagttcagcaatttttaccgatgatgccttggatatggtctatgagtatgctgggggtattgcccggaaaatcaataacctgtgcattgcttgtctaatggcagctgcagccgaacagaaacggcttattgatgaccgtatggtcaaggtagtaattgaaaatgaattttctgtataaaattatgtcaatggccaggcagtataaaaaactgcctggccaaataaagtgagcaatatttgcggccacttaatttgagctaaatgtggtcaattagtgtgagcggtaacattcaggttgtaggctcgggtgtagatttaaataaagcaacaataaacggacttgaaagaatggctaacttaacaggcctttcaatctctgaagtaaaaaacagagcaactattaccggtgacattcaaataggcaggttaccaggagtagtacaggtcaccatgttaactccaagcagcattttgaagaaattgaatttactggagatatatgaggagcaatataagtaaaggaaacacactaaatttgtaaagtaaatcaggcggggtaacccgcctgatatgtgtctttcttggcttgtattatcgataagaatatggccatgtataactatacttaaaatacaggggcaagaaatactttttagtgttttttatagttctttactttttaaataatttaaaaggaagttagatattaaatttctatttcgagtccaccgcactctgactttaattaaatctgctagctgcccagcttagtaacaataatctgttggaagataaataagtttttttgcttcatcctgggttaaatctgtttcttttttatttagttaaatctaactcacacctttttattgttcggaatttattttttgcctggacatggtcagccctggataatgtatgtattaccggagttgacgcgaaatagcttgatgttatatggagggtagtatttggtgaaataagtaaagtaggatagtttttaaaaataattttgggaaaagaggaggaaaatttttaagttactggtaataaagtgcaataatgtataacaatgccgctgtaagtacattaaatgttgatgcctcgaataggttaaaatttttttcgcgataaaattcctaaagggcgggagtggcacaatccttttttgaaaggatggaaataacagtgaatattgtgctcattgctccttataaaaatctgcttgaaatagctattgaggtcaaaaaggattttgattttgcttttaatttggaacttggagatctaagtgaaggcgtgaaaatagcacaggagtgggaaaagaaaggagccgacatcattattagccgtggtggtacttaccaacttataaaagaagcagtatcgatacctgtagttgaaataaaagttagccccttcgatattctcaggcagtttaaaggactgattggttatagcgaacctattggagtcgctggttatatgaatgtaatttacggttctgaagttatcggggaagtattgaatttaaaccttattaaaatagaaatcaaaaaggaaacagaagctctatttcaaattgctgaagccaaggaaaaaggcgcaaagataatcatcggtgacaccattggtgcttgttgcgctgcacaactagggcttaaaagtcggctaattatttctggtaaagaagcggttgcaaatgcgcttagtgaagcattcaggctagcggaagccattaaatcagaaaaagaaaaaaccgaacagattaaaacaattgttgactttgtacatgacgggattattgccgtggataaagatgggaggatatctatatataataaaatggcggaaaaaatattcaaaaaactaccttccgaagttataggaaaaaaagtagaaacagtaatacctaatacccgattatacgaggtgataaagacaggaaagcctgaaatcggaaaaatacaggaaatttcgggaactatgattgccacaaaccgagttccaattgtggtaggtaatgaggttgtaggagcagttgcaacatttcaggatgtggctgaaattcaaaatatggaacaaaaaataagaagacggctggcagataaaggattgattgcgtcttttaagtttgatgacattatttttataagtgataaaatgaaagatgttgttaatcaagcaaaaaaatatgctcttttagattctacagtccttattttgggcgaaacgggtacgggcaaggaactttttgcccaaagtattcacaatgcaagtgaaagaaaaaatggtccatttgtagcaataaattgtgctgctttgccagaaaatttattagagagcgaattgttcggatatgctgaaggagcttttactggcgcaagaaaaggaggaaaggcagggctattcgagcttgctcataaaggtaccatatttttagacgaaatcggtgaaatgcctatggggctccagtcaaaactgctaagagtaatccaagaaaaaaaggtgatgagaataggagatgataggttaatcccggttgatgtgagaataatatgtgccacaaatcgaaatcttattgaaatgattaatgaaggtaagtttaaacgagacttattttaccggattagcattcttcaaatccatataccgtctctcagggaaagaaaagaggacattgaagtacttgtaccatactttataaaaaaatattcacttatttgcaaaaagcatattcaaggaatcacttccagggggatggagcttttaaagaaatgggattatccaggaaatgtaagggaattggagagcattatcgaaagagcctgcgctatttgcgaaggtaatattatcgatgtaagggatattaaactatacaatgatcaagatagtatggaaaataaagtgtcaagtcaatccttccttgaaataaaaccattagacgaaattgaaaaagaatatattaaaaaggttataaaatttacagatggaaatttatcagaagcagcgaaaaagcttggaataagtagaacaactttatggagaaaattaaaaaatttcaattaaattcattaccggaaaccattgttgcattttgcaacaatggttttattttttaacgaataagtgtttcaaattttaacatttgtattaaagtatttagcaattaacagataaaacgttggcatgacctttgcttgaggtattaaatggaggtggttatatgaaaaaacttgcagttgtggctcatcctgaagataacgtggccacagcagtacaaaacttaagtaaaaacgaggaggtgctagtggatgtaaacggtaaagaattgaggataaaattaattgataatattccctttgggcacaaatttgctctcaaagaaattgagatgggagcaaatgtggttaagtacggtgaggttatagggagagctacaaagtccatcaaagttggcgaacatgttcatgtccacaacattgagagtttgcgcggtaggggtgactgggagggggatgtaaaatgaaaatcaaaggttttgtaaggccagacggtaaagttggtatccgtaatcacgtgttaataattccatcatcggtttgtgctagcgaagtagctatgcggatagcttctcatgtaaatggagcagtagctctcgccaaccagcacggctgctgccagattggggctgatctggaacttgttacaaagacgcttataggactcggtaagaatccaaatgtagcagctgttcttgttgtaggtttaggctgtgaaggggttcccactgagaaggttgctgacgaaatatcaaaaactggaaaaaaagttgaatatataattatacaagattgtgggggaactttaaaagctgaggagattggtacaagactggcaaggcaaatggctcaggaagtttctttgcttaaaagagaagaagtagatatcacaaatttaatattggcggttgaatgtggaggatctgatactacctctgggcttgcatcaaatccggtagcaggttatgtttcagataaactaatcgagcttggtggcacttcaatgttttcggaaactacagaaataattggtgccgaacacctacttgctaaacgcgcagtttccaaggaagtagctcaaaagcttctagaaatagttagaaggtgtgaggaaaaagccaaaacaatgggagttgacatgcgtggaggacagccaacccctggaaatatcgaaggtggtataagtaccatagaagaaaaatctcttggatgtatatataagggaggtactaaaccagtacagggcgttttggaatacgcagaggcaccaacaggtaaagggctttatattatggataccccaggacaggatattgaatcgataacagggatgacagcaggtggagcgcaactagtaatctttacaacaggtagaggaacaccaactggttcacctatagctccagtaataaaaattactgctaaccctgatacatttaaaaagatggaagacaatatcgattttaatgctggcacgataattttaggagatgaaactattcgggaagcaggcgaacggttatttagtgaaatgatagaagtttgcaatggcaagcttaccaaagccgaggctctgaaacatagagaatttggaatatataaacttatttcaaccttttaaagattcaatttatatgcataaaagtctatagcagtccccccttttttttagagggggactgtcaccttaaaacattgcaactgctatactaaatgctttgcagaatttctcgatatcttctgaattacaaatatgcttaaatttcgtaaatttttaattttggtctaattataatttatgtaaattttttagaataatctaatttatttaaactaaaattttgcaaggagggagccaaatgaaaattaaagcaactttagaacgtgtacctggtggtatgatggtcattcccctttttttgggtacattaattaatacactttttccaaatgcagcaaacacatttggatcctttacaggagctttactaaccggcgctttaccaattttagcagtattttttgtatgcatgggagcaaccatagattttaaagcgacaccttacattttaaaaaaaggtggagctttatggattacaaaaatattaattggagttatcgtaggagttataggtgccaaatttcttggagaaggaatgataaaaagtggtccgtttgtcggactttctgttttagctcttgtagcatcgatgaatgatacaaatggtggcttatatatggccttaatgggacaatttggcaaaaaagaagacgtagcagcttattctgttatgagcttagaatctgggccgttttttacaatggtgacattaggagtggcaggactttcagcatttccatggcaaatgcttgttggagcaatacttcctcttataattggtatgattttgggtaatttagataaagaactgagggaatttttcggtagagcagtaccagtattaataccgttttttgcttttgggcttggagccaaaatgaatttgcttgatgtatggaaggctggacttgtaggtatcttggtgggcgttgctgtagtagttattactggaacggcattatttattgctgatcggttaaccggtggtaacggaatagccgggttagcggctgcatctactgcaggaaatgctgcagcagtaccagctgtagttgcatcagcaaaccatgcctatgctccagttgcaccagcggctacagcaatagtagcatcgtcagttattgtcactgcatttttggttccaattataaccgcttggtgggcaaaacgtatcggagttgtaaataacaatgccgcataaaattttgaatataaaagcattatatctgaatcttacattaggataaatgttataggggtcaagggtaagcaagtttcaaaatgtgtggttccttgacccctaaaattctaaaatgttatatgtactgcaatttttacttttctctaaaaaataaaaaaatataaaaactgataaagaaaactagagaaaaaaggaagtggtataatgtgaaacaaattgctattattgccgatgatttaactggggcctcagataccggtgttcaatttacccaaaaaggactaagaaccttggtcatctttgatataaaaaacttatttgaagatgctaaaaatgtgaatgtagttgtaattgatactgacagccgttctcttacttcttctgctgcttatcaaaaaataaaagaagtttctcaagtattaaaacctaaaggatacaagctaatttataaaaaaatagattctacacttcgtggaaatattggtgcagaaatagacgccataatggatgttattacttttgattttgcagctatagtgccggcttatcctaaaatgggccgaaccacaattgaagggcaacattttttacatggagttccgattgataaaactgaaatcgcaaatgatcctatatgccctgtcaaagattccaatatagtatctttattatcgagtcaatcaaaaagaaatattggcttagttaacctgcaaacaatacgatcagggattgaaaatataaaagccaaagttgataatttattaaaaaaagatgtccaactaatagtattcgattctgaaacaagtcaagacttaaaaatcgtaaccgaatatctttcttcaagcaactatcaaattctctgggttggttcagctgggctagcagagtctttactagatgcacttgagtttacctttaatgacatatcgcaatttaaattactttcaacagaaaatccggtattgcttgttattggaagcatttcaaaaataactcagcaacaactttcaattatacttaaacaacctaacgtaacttcggtaaaactggacccattaaatgttttaaaagatgaacaatacaataatgaaatttctcgttgcctcgttgaaataaaattagcattaaaaaaaggatttgatgtggcttttcatgtcaattcgtcacctgaaattgtgcaaaagacacaagaaataggaaaacttcttaatattccgcaaaaccaaatatcgaatagaattgcagatgctcttggcatcatttcaagccaagttattaaggaaattcctctgcaaggacttattttaacaggaggagatacagcaaaatcagtatgcaaacaccttggagttagaggtttgaagttgattaaagaactagaaccaggggtcccaataagccaacttattggctttggtaatttgttggcaattacgaaagccggtgcttttggaacagaaagaactcttattaatgcagtacactttttgaaaggagataggtgatatgtcaagaccggtaatcggaattactatgggagatgcagcaggagtagggccagagataataatgaaggcgctacgcgatcctgaaatttatgcaatctgtaaaccattggttataggcgatgcaaagatactgcaacgggctgaaactattatccatactggacttcatattaaaccgattcagagtatcgatgaagcagaatttaaatttgggatagttgagtgtttggatcttaatttacttcctcctgatattccctttggacaagtttcagcaaaagctggagatgcagcttttcgctatttagaaaaagctattgaactagcaaaagaaggtaaaattgatgctatttgtacagcaccactaaataaagaagcactgcataaagcaggtcatatgtatcctgggcatactgagatattggcagagctaacaaacacaaaagattttgcaatgatcctatctgcacccaaattaaaagtcatacacgtaacaacacatgtgggattaaaagatgctatagatatgattaacccgaatcgggtatacaaagttataaaacttgctcatgataccttaaaaaaagctggttattcgaatcccagaattgcggtttgtggaataaacccgcatgctggcgaaaatggattatttggctacagagaagaagaagaaaaaattatcccagcgattaaaaaagctcaacaagaaggaataaatgcgattggtcctttgccagcagatacggtattttacagagctatcagaggcgattttgatattgctgttgctatgtaccatgatcaaggccatactcctgtcaaagtattggggttagaagtcggggttaatattactgcaggccttccttttgtcaggacaagtgttgaccatggcactgcctttgacattgctggaaaaggaactgcaaatgaattaagtatgaaagaagcaatccgccaagctgttgaattgacttccaaaaaaaatttagataaaaattaatatcaatttgccaatctcctcgaaaacgatatttcgctaatacaatgaaattggctcttcgctaagtagcatgggtaaatgtctctaatgattatattagtattaggactaaaaatctattggattgtcacaaaaagtgaaatttaacttgaaatgattaacaaaagttgttaaaattaaaaaaaactaaatatggtttaggggagctgagggggtaagctcggctgagagtaggcaccgaaaaccctgtgccttgacccttggaacctgctccgggtaatgccggcgaagggaaaaagacgacgttaaagcctttaatgctaattacaaccggcattaaaggcttttttatttaaagtatttaaatggcatcataagaaaaccgccggcgaaatggcggttttttatttggtgttgaagaaaggggggagttcatgcttaaggtcaatgacaaagagcttaattttacaggaagtattaaagaattacttgattacttaaaactcaaccaatcttcatgtgctgttttggtaaatggcgaaattatcaagagggaaagctgggaagagtacctgctcaaaaatgatgattatgtggagattgttagttttgtgggtgggggttaatagttaaaaatttgccaggaaagggtgattacatgtttactattggcgggaaaacgttaaaatcaaggctttttgttggtacaggcaagctaccggattatgctttaatttccaggatgtattatgaagcaaaggttgaggtttttactgtggctgttcgcagaattggtctcaatacaaaacatgaaaaaagtgttttagagtttattcccaaagaggcagtaattatggtaaatacttcgggggcaacaaactataaggaagctatcaaaattgctcaaattggcagagagttgacttcttcggactgggttaaggttgaaattgaaaaagatacgaagtacttatttccagataactatgagaccctcaaggcgtgtgagattttggtgaaagaaggatttaaagtttttccttacatttaccctgatttaaacatcgctaaagagcttgaacagattggtgttacggcggtaatgcctcttgcagcacctatcggaacaaacaaaggaattggttgtgaagttttattaaagccaataattgctgaagttgagatacctgtaataatcgatgctggaattggccggccatctcatgctgcccaagctatggaacttggtgctgatgcagttttaattaatactgccattgctacggcaaaagatcctttggtaatgaccctggctttttccaaagcagttgaagcgggaaggcttgcttatgagattggactattaaaagagtatgaatatgctcaggcatcgtctcctcttgaagattttataaagggataaagagtttaatttaaaaaggttagaaggtgttagctgtgcttgattatttacaaaaatgttttgaactttattttaggtatgagcaatatgttccttccttttctgaagctttggatattttagcaaaagactatttggataaaattgacttagtcaagcttttaaatgttgaggatgaagaaataataaagtttatggcaaaaaaagccaaaagaattacggaacttaattttggaaaagttattttattgtatgctccattgtatatagctaacttttgtgaaaatgggtgtgtttactgtggtttttccaaactaagaaaatacccacgggaaaaacttagtttagagcaaatggaagaagaaatgcagcagataaaaagtgagggaattgactctattttacttttaaccggtgaggacaggaaaaattcgccttttgcctatataaaaaatgcctgtaagcttgccactaaatatttttcagaggtttcaatcgaagtttatcccctttccaaagaagagtacgaagaattagcaagaattggggttataggtactaccatttatcaagaaacgtatataaagaaagattatgaaaagctgcatctttttggtccaaaaaaagattatgaatttaggctttatactccggaaagagcattaaaagcggggtttaaagcggcaagtataggaccgcttttaggattatctttgcccaaactggatgtgtattcggcaattttacatgctgactatttaatgaaaaagtatcctcaagcggagattgcgatttcttttccaagactaagggctgccaatacgggatttaaggccaaacatgtggtatccgataaagagtttattaagtttttgcttgtgaccagaatctatttgccccggattggtattaatctttcgacgcgggagaggccaagcttacgagatgctcttctggacatttgcattacaaagatgtcagccggttccaaaacaactgtcggagggtattttagcaaaaaggaggattcccaagggcagtttgaagttgaagatcgaagaatggtagctgagataattgaggttataagaaaaaaagggttgaggccagagtttacaaattggataagaggtgttagaccttatgagctcctttaatttaatgctaaaaaattattttaatgatgatttgttgcagaaactaagcagagtaaaagtactaattatcggctgtggagggcttgggtcacacattgcctggatgctaattcgttgcgggttccagaacttgaagattgttgattttgatcgggtggagcttaagaatttaaataggcaaggttatttttttacgcaggtgggtctacctaaggtattagccttaaaagatattcttacccaaattaatccaggggctaatattgctatagcagttgaaaaaattgatggtaaaaatgttgaaaaaataattatgtcctatgatgttattgtggaggctgtagatgatgaaacaacaaaagctttaattttcgaagcagctatgaaactaaacaaaaaggttgttgcagcttccggagtagctggctttggcgattgtgagcgtataaaaatcaaaagaggtaggaactttgttattgttggtgattttgcaacttctgtcaaagataaaaaaccttatgctcctaaagtaacggccgttgctgcaattcaggccgatgaggtgttaaggatggtggtggaggatgagtaagctggaaaagttaagacttttggaagattataatatttactgcataactgctgagaagttttctcgtggtagagaaaatcttaaagttgtttctgagatgctaaaagctggaataaggataattcagtatcgagagaaatataagtcactgaaggaaaaatattatgaatgcctcaaaataagagaactgacaagacaatatggggctattttgattgtaaatgaccatgtggatttgtgtcaaatggttgacgcggatggggttcatcttggccaagacgattatccggttaaagaggctcggaggattttaggggatgaatatataattggagtttctactcattctcccgaacagctgaaaaaagcagcaaaggaaggagctgattatgcaggtgttggaccgctttttgccacgaatactaaagataatgcaatacccccggttggactggaatatctaaaatgggcagttgcaaactcaagtataccctttgttgctataggtgggataaaagaatataacattcaggaggttctcgacttgggatccaagtgtatagctcttgttacagagattgttggggctgaggatattaaagataaaattgatagactaaataagattttagaaagatatagggttagtaacaaagccttcgattaaagagacgggtattagtcctaacgttaattgaaaaataccgatatctctccttctaataattttcataagataaattaattggacaagaaaatttttctatgctacattacttttaaggaaaatcttgaaaattaatcaaactagtttaggaggattcgctgtaaaaaaaatcataactttaatttatgaaagttgaggtgttaaaccgatgaataggcttaagcttgtgtttcatattaacgaacctgataaatggcaaagggtaataatgaatatcaataattttttaaacgatgtgggccaaggaaatgctgacatcgaagtagtagctaatggagaagcagtttctgccttcaaaagcaatggtcaaacaaataaaatgctaatagaacaaatgcagaagctagctgaaataggggtaaactttgttgcttgccagaatgctcttaaggctcaatcgattgctaaagagagtttgcccgaatttgtaacagttgtaccggccggcataacagaaattgccaggaagcaaacagaaggatttgcgtacattaaaccataattagtttagctaaataagagaggagtatgcagcatggtggaaattgtagattctcatacccatgtttcgttacttccttacgagggactcgaaaacatggccctggccggagtaaaaaaaattattggctgttccttattttttggagctcagcatgcggagacactttttgatcattttcaccagatgttaactctttcgcggacaaatgctgagaaaaacggcatcaagctttttgttgctgttggtattcatccgatgggaattccgaaagattggcccagagtaattgaagcattacccaactggttgagaatggacggggttatcggtttaggagaaatcggcctgcatgagggtagccggttggaacaggatgtcctccgcgagcagttaattatcgctaaggaattccagttgccagtgatcattcatactccgccgcagaagaggatggaaataaccaatgaaacgcttgaaattgctgcttccgtcggtataaaaccagaaaaagtgattattgatcacgctaatgtagatattcttgatttaatcgagggatttggggctgttcccggacttaccatccggtccgatggaattactccgcagatactcctccacaatttagaacgtttccaacggggggttcttaacagtgattatagtaacctcaagcccaacgatcccttgagtgttccaaaagctgtccagtacctgaaactaaacaaggcatcgcccgaagttgttgcccgaattgcaaggtataatgctgaaaaattgtttggcatttaattttacaaatggaaatatcctgtgttgtatgttacttttcttaaagaagtgcaagtataaaccctgctgttatggcagggtatttattttagttagttttgtccattatctactaacaaaaatccattacatttacatttaataaattattaaaataaaattaaatcaagtagatcacgaaaaaaatggaggaggttactttaatgaaaatagttgttgcccccgattcttttaaaggaagcctgagttcattaaaagttgccttagctattgagagaggtattaaaagagctgcatccgaaatagatgcagaaattgaaataataaaaattcctatggccgacggtggagagggcacagtagaggccataatgtgtgctctgggtggaagacttgtaaagacccgggttcttgatcctttaggaagggaaatagattcttttttcggtgtactaccagatggtaccgcagtaattgaaatggctgcggcttccgggcttaatcttttgaaaactgaagaaaagaatcctatgataactaccacttacggcacgggtcaacttataagggcggcacttgatgagggatgtagaaaattaattataggaataggaggcagtgctaccaatgatggtggtgtggggatggcccaagctttgggcgtaaaatttcttgatagcaacgatcgtgagattggttttggaggtggagaactttataaaatagagcggatagattactcaggccttgatgcaagaatcaaagataccgattttgtagtcgcctgtgatgtgaagaatgtgctatgtggtccaacaggtgcttcggcagtttatggacctcaaaaaggtgcaacccttgaaatggtaaaagttttagatgaaaatttaaggcatctagctacaatgataaaaagatacctgggaaaagatgtggctgaggtcccgggttcaggagctgcaggtgggctgggagcagctttgctggcattcttagatgcaaaacttcggccgggaattgaaatagttatggaacttactcagtttcctgaggtagtaaaaactgcggaattaattattactggagaaggagcaacggattaccagactatgttcggaaaggtccctttgggaattgcccgggtggcaagaaaatttggtaagccagtagtatgtatttccggttcccttaatacaggttacgaaaaattatatgccgagggtataacagctttgtttagcatagttaaccgcccaatgactttagatgaagctatggaaagagcggaagaactgcttgaaaaaatttctgaaaatgtcttcagactatattatttaatgcgggaaggggataaataaatgacacctgaacaactcttaaaacagcaaaaggttccatgacgaaaaataaataacggtaataaagatccgcaatttctggccatcaaaacgaccaaaaaccgcaatataccagaaaaggaaatgatttaactccttccttgcagctaaaagatataaatataaaaaattttttagactgtgaaggaatttttaaatttatgtcgaaaattaataataagaacagcgtttgatattataaaacaactaaaatgttaaaaattttatttttattttcttaaatcaaaacaatgtttgataatataagacattaatacaagaggagggaaaatatgaattaaaagtaaagttaatatttgaaaatgttgggagttttttatgatgggttgtttttatgatttgctaatgggggtgaggaaaagagaaaaaagaaagaaaaaaagaagaaaaaaagaagaagaaaaaatgaactagatatggaatttttgtagggaaaaaaattagattaatatgaaggagggtaaagatgagtatttctaataacttaatggagaaaggttataatattggcgaaagctttaaagaactcgttaaaaatctttcttttcccggcttaactactggattaatcggtgcgttatttagtagcatggggccgggcttgattgtgatgagcgcggccaagcaaggtaaccttcctgatgatattgcagtgtcctggatttttgcgatctttttctttgctgggttagcgacgatgtttgtttcactttactatcgcgttcccctcgtgatagcttacagtataccaggttcagttctaattggcaagtacttggcatctggtgggaatatacacgaagcggtcggtgtttattttagcatagctgtgcttgttattatccttacggctacaggtgctattaaagctgttatcgaacatattccgattcctataatgctggggatggttggcggagtacttttgagctttggattaaatgcttttacaagtgctttgaccacgcctgcagtttatggcataatggtaattatttattttatatggtactattttaaagggttatcaagtaagatacctggagttgtggtatcactgattgttggtgtactattgctgaaatactttggattaaccaagaatgttcctatacaatgggaagttgcaaagcctgtaattgtttctcctagttttagtttaaaaggtttactcaccttgggagttccactgttctttatggtagttggtgtccaaaacatccaagcagttggggtattattatccaggggatataagccaccaataaatgcaatgtattttattccctcgattgctacattttttaatggtttgtttgctggtcacactgcagtaacggcaggaccaagtacagctatttgttctagtgatattgcagggcccaaagagtaccgctggattgcttctttctttgaaggagttttttgggtattggtgggcttattagcgaaagttggggttgaaagtgcgaagttggctcccaaggaatttatgcaagtcattgctggcttagctatgtttgaagtatttataagtgtttttgaaggggcatttagtcaaaagtttcgcaagggagcgatggtagcattctttgtggctgccagcggtatttctttatttaatattggcgctcctttctgggcaattgtatttggcgtcatagcttcactgatagctgaaaatggtgattttaaaaaaataaataatgaacagcaataaaacttttgctaaaaattgataaattgaaattaagcaccttctatgggggtgttttggcaacacccccaccccttttttgcaaacttaagaattgaaagaaggtgttaatttgaaggataagttaattcatcggataaaaaaaatacagaatctaatggccaaaaaagatatagatattttggtggtagtaaatcgcgaaaacctaatttattttaccggcttaacgcaaattgaatgtatggctgttttaattccattaaaagatgacccatgtgctataacgctttggcttgatgctgattacgtagagcaagaatcaggtttaaaaacttttggttatttctttcccaaagaaagcttgggaagtaaggttgtggagcgaatcaaggcttatggttttcgcgctccccggattggatttgaaagatattttgtgccttttgctttttatgatgttttgcggcaaaactttccggagtcaaactttgttgatgcggctgatttattttaccgtgtccgggctgttaaggagccgaatgaagtggaaatgattcggagagcagcttttgctgtttgtaagggaatggaggctgctataaaaacaataaagccgggaataagtgagctcgatgtattggcagaagctgaatacgctatgttaaaggcgggttcaaatggtttaccttttcgaccgcaaattgtttccggtaatcgttgcctgcttacccaccctcatgcaagtactaaattaattgaagaaggcgaggtagttgttgttcacctcggtgcaacttacaatggttattgtgccaaaatgtgtcgcactgttgctgtaggagaaatttctgctgcacatgaaaaggtatttaatcttttgttagaagcacaggaaaaagccattgcggctttgaggcctggttcaaaagcctgggaagtggatgaggctgccagagaagtgatcagaagggcaggttttgaggaatactatcttgatgttataggatatggggttggattacggcaatcggaattttacccaattatcggaaaaggacgtcaggatattattgaggttggaatggtagtagatttattattaccaactatatatcatcgggacgtcggaggaccaaggataacggatgtaatttatgtcggtgaaaatgaaaatgaaatattaaccggctatccaagaaaattgattaaagtataaaaataaagttttctattgaattgaaaaaagtaaaatttttatacaaattttgaaaggaaatttaagatttatgttgaaaataataacttaagtaagggaggatacaaattgattaggagtttttattgatggaaggttgaaataatgaaaaaaaacaataacgatactcttattcaatcggttgatcgggctttaagaatattagatacttttagccttaaagaaaaggaattaggtgttacggaaattgccaatcgtttaggcttgcataaaagtactgtctttgggttactcaggacccttgaacattggggatatgttgaacaaaaccaagttacaggaaaataccgtctaggtcttaagttattagaattgggtaatcgagtaaaagaaggcttagatttacgggcggtagctttgccatttttacaggatcttgttgaaagatacggtgaaaccgttcatttggctgttcacgaccggggagaaattgtctatattgaaaaagtggaaggaccaaatgctattcgaatgtactcgcaaattgggcgacgggctccaatgcattgtacaggtgtaggtaaagctatccttgcttttagacccgagaaggaaatagaggaaataattcgcaccaaggggcttaaatattttactcctaacacgattacagatcccaagaaactacatgaagaactaagtttgattagggaaaatggttatagtcttgacagagaggaaattgagatagggttaagatgcgttgcagctcctatcagggatagtcaaaatacagttgttgcagctattagtgttgctggtccttcaatacgcatgaccgaggagaaaatacaggaattaattgttagtgttaaagaagctgccttagaaatatcaaagcgtttgggctatcaaacatcaagtaggtagttatatttcgtaacaaattagttttattgtgccaataaatcaaaacacagtttgataatacaaaacaaagcaaagaaatgtaaaggaagggggaaaggcagatatggtctggtccttaaataaaagtagttgttaatattctgttcgtaaataccaaataatattactactgcaaggaggggttttatgcgagttgttaatatgcttgcgcagattgattatgataagtgtattggatgtcagacatgtgctaaagtttgcccggttttggctatcaaaattgagaataaaaaaccggtaatcaatgctgaaatgtgtagaggctgtgcagcttgtgagcagagatgtccgcaatatgccataaatatggtaaaaagggaagaaccttttacagtttatgttgatccttcaacagtagatgcagaaaaaattgaggaattatgtaaaaaagcccgcctccatccggaacaaattatttgttattgtactgcgaccagagctgaagaagttgcggcagctattttaaaaggtgctaaatcaccggaagaaatttccttacaaacaggtgttcgcacagggtgtaaggtcgaatgcattgagccaattttacggttactggaagctgcgggcattactcctgaaaaaccagagggctatcaatggtatggaagaacacccacagtttgggaaattcctgaaagcgtaaaagaaaaatattcaagtagagggttctattttgacgaagatattaaattactggacaaagttttagcggcaaaaagcagcagaaaggaggataagtaaatggctgctaaggtaattcccccgattaaaccaagagtttcgcaatatggtgttgatcccaagtatgtgaccaaaagaatttcggattatccggaaatgacaagtgtaaagctaaaagaattgttcgcggataccccggatgtgatttatccttcggaaaaagggattgcggtgattcgcgaaaatgttattaaggctctggaaaaagttgatatgagcatgataaaaccaggtgattcggttaacatcctggcatcccatcatggatttaccttgcttggcggtgaaccctatgctgaggtattaaagacggtaagggaagttattgtcgaaagaacgggagcaacggatataagactgcgggcaggagttgggttacgcttcagggaaacagaggaatatattaaagcctttggtttagatgtagcatttaacggaaaagccaaaggggtagctcccatagataaaggaataccaattgagaccgagataggaactctttatggaattgcagcggtctacgatgcggactggattgtccatgtccataacagcgacgtacgtgaagtccacttccaccggcacgttgaccgggcagtaaagccgtttggtatgtcctatgcccggatagagaccagatcaacgtatcaccaaaaccttgggcccagaggagcaaatttcacagcgcgggcaatttttgcctccgagttcgtgcaaagtaaatttgcctttgcaactttcatgaatatgtcaccggcaggagtagtatctattgaagccgataatgaccttctcgctttgaacgaaaaaattactgctgatggtttgcggtactacgggaagattatgaccttgcttggtgaaattgacgaatgtatagcaggcttggattttcctgcacccgttccgtatgtttttgctgcgggagtaatttttgctaactttgttggagcaaacgttgatctttttgacctggataaccctcttccaccgtacacctggtatactgaagctttttacgataagtcagggaagccattaattgaaaatgtacccccagtaaatcctgccattaaaatggttgtccataattatgcctggggtggatatcccagcgcgttttttgcccatcaaatacctactgtagtagttgggcgggagcaagctgacttgatggaccgagatccgcaaaacttggattatatgaagtatgcagttattgccagggacttagattcggcaatggcttatgcttataaagtagcaaaaacggataaggttatcatttttgacggggctgctggtggtttgaactgtagtgaaagcttggctgaatatttgaaagcaaaagctcccgaagtaagtagaagagtagaccaggagttgctgcccaagtggttacgtcagcgggggattgatcccaacgtttttaataaataacattagagaaaattaaacgttgaaaaagctcgctatttaaaaaaggtgctcctttctgttttaagcacctaatggcgggttaaaaaatgcagaaaggagcacctccatttttaaaattggattgtggaggcaaatatgaatttcaataactctggagatattcgcgatatcttattttctaaaataatgcaaaagcatttcacagctcagattaaagctgaaaatggcgggattattgctggtgcccaaaatgcatataatgctttgaaacaacttggtttagaaatcgaatattttgtttatgacggaacggaagtccagccggaaacagttattgcccgttttaaaggaaatcccaaacaaattgcgcaagcggaagaagtagtaatgggttatttaatgaaaacttccgggattgctactgccacccggagggcgattaatttagccgaaggcaagatcaggattgtttccggggcatggaaaaagatgccttccgaaatgaagcaattagtaagggaagcgattgctgttggtggcggagcttttcgcatacttgatgttccctttgtttatttggacaagaattatattcgcatgtttggaagtatcgttgaagcattaaagagtgcccaggtatttggtgataggtataaagtagttcagttaagaggcgaaatgaaagacattaaagaggaagcaattgaagcggctacaaatggagcttatgtgctcatggtagatacaggcaaaatttctgacgttaaaattgttaatagtacgttggaagagcttgggctaagaaaagaaaagcttgtagcttttgcaggaggagtaaaaattaatgctattcctagttatattggtttagggatagatattctcgatataggatccgaaatagttgatgcgccactaatggatatgaaattagatgtaataagcgaaggaaaggagggagaggatggaacttaaccttttagaaaagacagaactgtggattgaaaatatcaaattacaaaatgctaatttatcaacaattgccgaagttgtggccgatgttcttgaaatcccgaaggataaagtacttgtggtggatgtcagggaaaatcatattactttagacattttacaaaaaacaattcaggctgaacaggtatttggcaaaaagcaacaattattaaaaaagctgtcggaaataccgggagttaatatcgtaccggaaactgacattcattcggaaggcatattgggctttatttcccttgatgaatccgaggtacctcaggttttagcgagaaccgaaaagattgttgatgaaataaaaatgaagattgcgaaaagagttattgttttcccgacaggttttgaagttaaaaggggaatgattgctgataccaataccccgtatattatacagcggatgaccgaagctggttataaagtaactaagggagaaattctggatgattctgctgattatattgcagcgaagttaaatgatgccgtaaattctggctacggattaataattactactgggggtattggagctgaagataaagacaggacggttgagggagttttacttgtagacccgcaagcagcaactccttatattgttaagtaccagcaaggaacgggacgccatgaaaaaaatggcgtgcgaattgctgttggtatggtgggaaacagtttaattgtctctctgccagggccacatgatgaagttaaattagctctggatgtgcttataagggctcttgatgaggggaaaagcaaggaagaaattgcccaggaaattgccggtgttttgcgggctaaattgcaagcggcaggttttaaacatcattaaaataaattaagaggagggagaatatggataaaactgctttacaagtagcagcggaagcgctctggaaagcctgtcaagaaagaaaagcattagaacagcctttaacggaaatttatcctgatattactattacggatgcttaccagattcagttaattaatgtagacaagaaaaaagctctgggacgtaaagttgttggtaaaaaaataggtttaaccagccgggcaatgcagcaaatgttaggagttcatgagccggattacgggcatgtaactgatgacatgattggcgatgaagaggttgctatttctcgttccaaattattgcaacccaaaattgaagcggaaattgcttttgttttaaaggacaggcttgtaggtcctggagttactttaacgaaagtattgcaagcgacagcaggagtaattccagtatttgaaataattgatagccggattaaagactggaagattaagattcaggatactattgccgataatgcttccagtgcgatggttgttttaggaagtaaattaataccggtagatcaggttaatcttaaatatgttgggttagtattagaaaaaaatggagagattattgataccgcggccggagctgcggttttagggcaccctgcattagctgttgcctggcttgccaataaactttccgagtttggtattgccttggaaccgggggagattattttatccggttcgctgactaaagcgtatgaagttaccggtaatgaccattttgttgccaatttcgggcctcttggttcggttaaagtaaaatttactgattaacgattaaaaattaatacggcaaaggagtgaagcaaatgtcgaacaaaattaaagctgccattatcggtcctggcaatatcgggatggatttaatgtttaaattaatgagaagtaaatatattgatgttgacacagttgttggcattattccggaatcggaaggattggcattggctagaaagcatggaaagaagactagtgctgaaggaataaaagcaattttaggaaataaggatattaaaatcgtttttgatgctaccagtgccaaagctcatttaaaacacgctcctttattagaacaagatggtaaaattgctatcgacctgacacctgcagcagttggtccttattgtgttcctgcagtaactatggaggaacaattaaattgcaaaaatgttaatatggttacttgtgccggacaagctactactccaattgtttatgcaattaacaaaattgccgatgtaaaatatgctgaaatagtagctacaataagtagccggagtgctggtccaggaacgcggcagaatattgacgaatttaccgaaactacggcaaaagccctggaaaaaattggcggggccgataaaggaaaagcaataattattcttaacccggctgaaccgccaattatgatgcgaaacactatttacacccgggtagcaaatccggatgctcctggaattatcgaggcaattgaagaaatggtggggaagatcaaaaaatacgttcctggttatcgcttgaaagttcctccaatcattgatggagataagattaccacaataattgaagttgaaggtgagggggcctatttgcctaaatatgccggtaatcttgatataatcaccgcagcagcagtagcttttgctgatgaagtagctaaaaagttgctggctgaggagcaagctaaggaggttagagcacatggctaaaaagattaggataattgacagtaccttaagagatggaatgcatgcggtaagtcaccagttcacacccgaggaaatggcagaaattgcagcaggactggatgcggcagggattgacaccattgaagtgagccatggtgatggattaggtggttcgagctacaattatggatttgcggctgcaaaagatgaagattatttaaaagcggtatctcaagttttaaaaaattcaaagttaggtgtccttttgctgccaggaattggtactgctcatgatttagagatggctgcaaaatttggtgcaaaagttgtgcgagttgctacccactgtacggaagccgatattggcgaacagcatatcaagattgccaaagaattaggaatggaagccattggatttctaatgatgagccatatggttcctccagaaaaacttgtggagcaagcgaaattgtttgaaagttatggagcagatgcggtttatattacagattctgctggagcaatgactccgtatgatgttaaggtgcgcattgaagcggttaaagctgctgttagcgtgcctgttgggtttcatgctcacaataatttagggttagcgattggtaatactctggcagctatcgaagctggagcaacttatgttgacggcaccgcgcgaggacttggagcaggggccggaaattcacaaacggaaattttggttgctgttctggcgaagttaggttatgaaactggtgttgatttgtataaaattatggatgtagcagaagaagttgttgctcctaaaatgagaagaccgcaaattgttgataaagcggcattaagtttaggttatgcgggtgtttacggaagctttctcttacatgctatgcgggccgcagaaaagtttaaagttgatgttcgtgatattttaatcgagttaggaagattaaaaactgttggcgggcaagaagatatgatagttgatgttgcctatgaattaagtaaagcaaataagcaataaatgtttttttatttcaattaataaaaacagaatacgacaatgatgaatagcttgaacaattattggaaagcaggccagaagaactctggcctgctttagcggttttttcgctgatatgatacgaatttgttataactttatagtataatttttatggttaaaaaacataaaggtaagatatttagccttaaaaaaaataatattaactggaggttagaagttaatggaacaggtcagaagacacaagcttgagaaactacaaaatattttacaggaaatggggagtgtcgtgattgctttttcagggggtgttgacagtacctttctcttaaaagttgcaaaagatgtactgggagataacgtgcttgctgttaccgcaacttcatcaacttatccggccatagaactggaagaagcaaaaaaattggcccaaacttttggagttcgccatcttattattgaatcagaagagttggatattaaagagtttgtcaataacccacccaatcgttgttatttctgcaaaaaagagttgttttcaaagcttctacaggttgcaaaaaaagaaggattttcttttgttttagatgggtccaacgctgacgatttaaatgactttcgccccgggatggaagcggctaaagagttaggagtgcgaagtcctctaaaagaagcgggcttaaaaaaagacgatattaggtacctatctaaggaaatggggttacctacatggaataagccatcctttgcctgtttaagttcacgttttccttatgggacaaaaataacaaaagaaaaattaaatcaagttgatagaggagaaaactttttgagagcgctcgggtttcagcaaattcgtttaagacatcatggcgaaattgcccggattgagataaaaagagaacaatttcccctattaatagagaaagctcaagagatagtggagaagttaaaagactgcggttttacctatgtaacattggatcttgaaggttatcgaaccggaagtatgaatgaacctcttttaagaaagggcgaactttatgaatgaaaaaaagcttcgtcaattacttattagcattcaaaataaagaaattagtatagatgaaggaatagcaagattaaaaggtttaccgtttgatgatttaggctttgcaaaagttgatcatcaccggcaattacgccaggggtttcctgaagtcgtttattgtgcgggaaaaaccaaggagcagatagtagcaataatggaaaacctggtaaataaatcagaaaataatattttagcaacaagagcatcacgggaagtttatgaagcggtagctaaaaaaataccggatgcggtgtattacgaattagcaagggctatagtagtctggcggggagaacaagaaaaacgagggcatatactggttataagtgcgggaacttccgatattccggtagccgaggaagcagtaataacagcagaagttatgggaaaccgggtggaacgtctttatgatacgggagttgccggaattcatcgcttgttaagtcaaaaagagaaactatttgcagcaagagttttaattgtagtagccggaatggaaggagccttagccagtgtagttgccggattagtagacaagccggtaatagcagtaccaacaagtgttggttatggagcaaattttgggggactttcggctttgcttactatgcttaacagctgtgccagtggagtcggtgtggtgaatattgataatggttttggagccggatatttagcaagtttaataaatcgattgggagaggttgagtcatgaaaattgcctattttcattgttttgccggaataagtggtgacatgattttaggagctttaattgatgcagggttggattttgaacaattaaaagctgacttagctaaactatcattggatggttatgagctacaagtaaaaaaagtaaagaaacaaggaataagtgcgaccaaagtagatgtaataatagaggaggaacatgcacaccgtcatcttcaggacataaagaaaatcataagtgaaagctcgttaccagaggtagtaaaagaaaagagtatccaagtttttacccgtttggctgaggcagaggccaaggtccatcaaaccacattagagaaggtacattttcatgaagtgggggcaaaagatgcgatagttgatatagttggtgcagtaatagggctatggcgcttaggaatagaagaggtatactcctcgcccattcacaccgggatgggttttactcaaagtgctcatgggaaaattcccgttccggcaccggcaaccttagaacttttaaaaggctgtcccatttacagtgaaggtattgaggcagagcttacaacgccaacgggtgcagcaattcttacatcattttgtaaggaatacggagatatgccgcttatggaagtaacccaaataggttatggagctggtgaacgggatttggagattccaaatgttttacggttgagtattggtattaaaagggaagaaaaaggtttttgcaaacatactgagcaaaaaaatagctttcatcagggagaagcagtaaaaatcgaagcaaatatagatgatatgaaccctgaattttacgattatttaattaccaaatttttaaaagcaggggcaatggatgtctatttggaaagagtgcagatgaagaaaaacaggccagcgattctgctcaatttgctggttcatgctcaccaagtggaagagttttgccggctgatctttgcagagaccaccacaattggtgtccgcacctatccggttaagaaatacatgttgccctatgaaattatttcggtagaaacggaatttggtccggtaccggtaaaggtagctaaatatcagggagttgtccaaaacatagcccccgaatatgaggtttgtcgaaaaattgccgatgagcagcaaaagccgcttaaagaaatttatgatttggtaaagttccgtgcttatcagaggttaacgtaaattaatttttaggtcagattaaaatgagagggggaaaaaattgttgtatcctaacccttttggcaactatccggtgatcggtagaaatacttatgttcacccctctgctcaaataattggtcgggtggagataggagaaaattgttttatagggcccaatgctgttattcgcgcagatgagccggaaaaagggaaagtaagcccaataataataggtaacaatgttaatgtgcaggatggagtaatcatccatgctttagcgggaactgaagtaagaattggtaataatgtttccctagctcatggagcaatcatccatggtccagtagtaattaaagaaaactgttttgttggttttggtgcactggtgtttaaagcggttttaaatgaatgggtatttgtaggacatagggcagtagttcaggaaagggaaattgaaagagaaaaatttgtgcctgaaggagtaattttgactactgagtattctttaccagtactttcttccgaacaaaaagaatttattaaaaaagtttgccggataaatttgattttaacaaaacaatacttgttaagtgacaaataatccttttagattgggccatctttacaaccttttgttagaattaaagttaaaacaaaacaaaaatattcattaaggatgaaaaatgtctcgaaataatataaacattgattctgaaattttgtataaatttatcctggcttaaacacataagcttacatggcggtgtctagtagtttcagataatcatagcttaaaatgtgctaatcgtaaaaaattccaagagcaacctgccaacacctctttatatgtgtgttaatcgataaaaaacataatttttaacaatcaaattacaacaaattttgcaatagggtcagctccgtaaaccttactcgacgacttttccttttttctctttcttctaattttttctacatttttgaattggccataaaatacgagcaaggtaaggttattttatgctggttaaaaaattatcataattgcatttttgaagtttaccggtattaaagaagtagactttaataccggtaataattttttatgaatttgtacgttaattacaaaaaacggcttaaaaagataaaaaacattggaaatactgcatcggttttaaaatacgtctagcagtctttgttgtcgatcgtgagttaaatatcaagctaaaactgattggaaagtatggtaagggtatttgtaaagaatagaatgggtaccgaataaaaaagttatgcagaaatacatatgttttaatttatgcagaaatacatacgtataatttttttcaaaaatggctttactttcataaatattttttatttaaaaattggcataaaatttgctaaaaaattttttggaggcaacgagattaaaacggtacgaaataaatgggagtaatttaaaggggggtagatcattaaattgaaaacttaaaattagaattaagttgcttctattagctgtatttaaagttgagaggaggaggcttactatgcaggaggtagtaattttaagtgcggtgaggactgctataggcaaattcggaggtagcttaaaagacattcctgctgcagaattgggggctatcgttataaaagaagctttggtgagagctcaaataccacctgcagaggtagatgaagttatttttgggaatgtcttacaagctggacaagggcaaaatccagcgcgtcaggcggctattaaggcaggcattccggtagatattccggcaatgactgtaaatatggtttgtggctccggtttacggtctgtcagtttagcagctactcttattgctgcaggggaagctgatcttattgtcgcaggcgggatggaaaatatgtctgctgctccctatgccatacccggagcacgttggggtacacgcatgggggatggaaagattgttgatttgatgattaaggatggtctatgggatgctttttatgactaccatatggggattactgctgaaaatttggcagaacgctataatataagccgggaagaacaagacagatttgctttagaaagtcaacggcgagctgaaaaagcaattaaagaaggacgtttccgtgatgagattgttccggtgaagttacctcagcggaaaggagaacctcttgaatttgttcaagatgagaacccgcgttttgatactactcttgaagcgttagcaaagttaaagccagcatttaaagaaggtggaacagtaactgccggcaatgcatcaagcataaatgacggtgctgcggcattggtaatagcttccagcaaaaaagctgagagtttgggaattaaaccaatggctgttattcggagttggggagctaccggggtagatccaagtattatggggatcggtcctgttggagctactcgtaaagcgttaaagagagcaggcttaacaattgctgatatagatttagtagaagctaatgaagcttttgcagctcaagcccttgcagtagctaaggagttagaacttgacttaagtaaaactaatgtaaatggtggtgctattgctttaggtcacccgattggtgcaagcggggcaagaattcttgtaactttgcttcatgagatgaaaaaatcaaatagccgctatggcctggctacgttgtgcattggtggcggtatgggagtagcagctatagtagaaaaagcttagatgaacattgattcttagggtgaattatgatgaaaaaatcaataaatgcaattgttattaatgaaaatgataatgtggctacggttattgaggatataaatttaggagatgtagtagtatttgaaattttaggaaaaactcaagaaattattgcgagagaaaatataccaatttaccataagatagctattaaagaagtaagagtaggcgagtatgtatataaatatgggcagaaaattggagtagctacaagagatattcaaattggggagcatgtgcatagccataatctttccagcttacgggaagatttaataaagtaatcgttcagaaggtgaaatattacatgaaattttggggatatcaaaggcctgatggaaggatagggataagaaatcatattttgcttttaccgacctgtgcatgttcaagtgaaacatgtaggtttgctgctttacaggtgacaggggcagtatcaataataaatcaaaatggatgtgctcaggtaaaaggtgaccttgaaattacagaaaaagttttagcaggcttggcggctaatccaaatgtttttggaactgttttagttggtctagggtgtgaaaatgcccagcccgataagatggaacaacttataaaagctaaaactaataaaccgctaaaaaaagttattattcaagaagttggaggtactttagctgctattaaacaaattgtggaatatgctagagaaatggtggaagaagcatcaatgcttcagaaagaagagtttgatatctcaaatttgattgtagggacagaatgtggaggatcggatccaacatcaggcttggttgccaatcctgttgtgggtaacctaagtgatagattagttgatatgggggctacggttatccttagtgagacaacggagtttattggggcggagcatattttagcagcacaggcggaaacaccggaagtagctaaaagaatttacgcgattattaataaatatgaagaacatttaaaaagtgtaggtgaaagcttaagagaaggcaacccgtctccaggaaataaagctggaggtataacaaccttagaagaaaaatcattgggatgcatccataaagggggacacagacccatagttgaagtagtagattatgctgaagaagtaactaaaaaaggtttagttatcatggatacaccaggatatgatatagcttccgtaactggcatggtagctggaggagcccagatagttgtttttacaactgggaggggtactcccacgggtaacccgattgcgccagtaattaagataacgggaaatagagcaacatatgaaaagatgaaagaaaatattgattttgatgctagttcgttacttagaggtgaaaaaagtttagaacagttaggggaagaacttttttatgaagtattaaaagttgcaaatgggaaaaagactaaagcagaatcttttggttttagtgagatagcaataagcagactttgcaattatgtatagttgcatttttatgacaaaaagactcacggtaaaaaatcaaggaccaagaaatggaaattagaaaagtaggggctaaaaaaggcaataataaccctctccaactatatggtaatagttggaaaatagcagaggagagaaaaggttttattcaagaactatttcatcaccgtccctttgtagatttggcctttgctcagcagggcaaagaccagccttactaatttgcgggcagttagaaccagcgctcgcttatgttgatgcttggtaacttcgtgatacttgctctggtagtaggccttatactcctcgttgtgcacccgcaacgagttggcggcctggaccaggtagtagcggaggtaccggttgccactctttgtcaggcggcgttcttcggcgtcaaaatcacctgattggtagcgggtccaggtaaggccggcgtattgagccagagcggcttgatctttgaaacgtttgatatcgccaatttcggctataataccagcagccgagatgggaccgaggccttttacgctggtcagagtttgaggtatggcttctaactcccggcaaatgactttatccagttgtttaagctgccttttgaggtggtcaatattctgcagagtaagagaaagagccacctcacaagctgcgagcattttaggattaaggcggtaggcgcggcgggcagcctgtttgagggccttagccatattctcaggtgaggctaatttgttgttaccatgggactggatgaactctgccagctcttccaatggcatttctataagttcatctggtgtaaattcctgtaataccgccagggaggccttaccgaaagtttgactaaaaggcttgtcctggtgataattagaaaacttaaggaagaggagatttaaggctcggttctgctcggccgtcaccatttccacgaggtgtaggcgcaggcgggtgagctggcacaaaggttcagtcactatagtttcccggctacaaggggtaagatggccgaagcgcacccgttctgcgataacgtaagcatcgagggcatctgttttagggcgcttggtaccgaaggccttcttaaaactggccaccatgacggggtttatttcatagaccttggtggagtatggcttaagctttggggagtccaggaggaactgacggagatggacgctatagatagaggtggcctccaaccctatatgaagttgctggatgttaaacttatgggcgagaccatccagcacctcaaccatagcagaagcgccttcgaggctgttaggaaaagacttaactggggcgagctgttgcccttgctcatcgagacacaccaagtcgcatttaagagcgctgacatcaatgcctgcaaaaacgacccgggccaaagggtatccctccttgggctggcccaaattaggggcgtgccctgcgggtacgtcgcgtaacaacctcgcggggcgatgagagcgtggcaggacagccgggggtgcacctctggcctgctgaatccagaagccggctggtctgttggctcagctcacgcgtaagaaacatgcgccgcaccgcaagggtctcactcttacatgagtagtcaccgggtttactcgggctacaggaggtatttaagagtgaccccggaccaacctattttaatcttcgcaaaggcacgccaagttatcaagaacccttaacctaatttttcggctcgggttctatggtaatttaaattatacgaggagggaaaaatattgaagtctgttttggttttaggggcaggaactatgggttcgggtattgctcaagtatttgctcaagcgggttttaaggtatttttaagggatatagaaataaatttagtggaaaaaggcttaactactattaataaaaatttagagcggttagtaaataaaggtaaattaactttagaagataaacaggaaataatagggcgaattaaaggaattgtaaatattgaggaagcgcaaaatgttgacttggtagttgagggtattgttgagaatattgaggtaaaaaagaaagtatttgcagaattagatgagatatttcccgcaaatactatttttgcgacaaatacctcaagtctgagcataaccgaccttgctgctgttacaaaaaggccggaaaaggttataggaatgcatttcttcaatccggtaccggtaatgcagttagttgaggttattaaaggtgtagctacatctgaagaaacttaccagacaatttgtgatttagtaaggcagctaggtaagaccccggtaacggtaaacgaagccccgggttttgtagtaaaccggttgcttatccccatgattaatgaggctgcctatttactaatggaaggtgtggctacggcagaagatattgatactgcaatgcggttgggagctaaccatcctatgggcccactggccttggcagatctaattggtcttgatgtttgcttggcaataatggaaactcttcataaagagtttggtgacgacaagtaccgtccttgtccattattaagaaagatggttcgtgctggccatttaggtcgaaaaacccaacggggattttatcagtatacgaatgaaaattaaaataaaaattttttcttttggcagtacctcttccgtaagttgggggcaggtactgccaatacgtgtttattcatgagatataaaattttgaggagggttaatgatgagcgtaattgaaatggtaagggaagaaggaattgctatacttaccatcaatagggcaaatgttttaaatgctttaaataccgaagtgcttttagaattaaaaaaggttttatctcaaatcaaagaagatacaagtattaaggttgttataattaccggggccggagagaaagcctttgttgcaggtgctgatataagtgaaatggtaaagcaaagcgtagatgaagggtatagatattcccgtttagggcaggaggtacttgcacttatcgagaatcttccccaaccggtaatagcagcagtaaatggttatgctctgggcggtggctgcgaattagctatggcctgtgacatgaggattgcttcggagaaagcaaagtttggtctgccagaaattaatttgggtattattccagggtttggaggcacgaaaaggctaacagaactggtaggtaaagctaaagcaatggagttaatattaaccggagagatgattgatgctgcccaagctgagcgtttaggattagttaaccaggtagtaaaagcagataagttattggagacagcaaagacgctggctcaaaaaattgcatctaaaagtcaaattgctgttcgggcagctaaactggcagtaaataagagtttgtacactgatattgaaactgcaaatgcttgtgaagcagggctttttggagtctgttttgcttcagaggatagaaaagaagggatgatggcttttttagagaagcgtcctgcaaaatttaaaaattaggtaagagaataagtcttaatttgcaaatgttttttttaacctgttcttatttactcaaacatgattatgttttgctgcattttaataaataaaagctatatgagcttttcgaagcttatggtttgggaaaagttaatattgctagagctgtatttttctaagggttttatattgggaaaacctgcgtttttggtaagccgttttattttgctctgcttcctaccagaaagttctgtttacaaaaactcggccaagaataaaaatttttttaaaaaagttccatgtaaatcttgatatggactttttacaaaaaatttgcacttaatcgtaaaaatgtgtctttattaagttataaataaataattagttgaaggaagtggaggaatgagcttagctgaaagggttaaagtaatagcgcaggctttgaaagttgatggatattatgaagatttagaaaaagttgaagcggcaatttctataattgcccagtatgttgcttataggaatgagagtgactatgaaagagctgttggggctgttaagctattgaataagttatctgaaaaagtaggcttggataagttttatgatggtgatttttcggattatgatggaataagagagtttatgagcgattttgtaatggatatttttgcaaatcgtaatcaatgaggtaaggttaatcgagaatatcaatagcaacagatgaaattgcgacattagctttaaggaggggactcgatgaatccgcaagacttaactaaagagcagatcttaaagctattggaggattttgctaagcgctggcttgctcacgatggtctttggtttttagaagtggaaaaaaattttggcttagaaaaggccattgagctcgatgaagctgcctgggcccaatttacagtcctcgaagctaaaagaattaaaaaatttttgaaccttccagaaaatgggggacttgaagctttaaaaacagctctacgctttcgtttgtatggttttttaaaccagcaggaattaagtatggaaggcaataagctgatttataagatgaaaacctgtagggttcaagaggcgcggaagcgtaaaaatcttccggatttcccctgtaaactggtgggaataaccgaatattccgggtttgctaaaaccatagatcctcggattaaaacccggtgtctggcctgcccgccggacgagcatccggatgacttttactgtgcctgggagttttgggttgaagagtgaatagtttttaagacaagtgagaaaacttcctggaatttattccagggagttttctctaaaaaaaggagggatatttatgaaaatgcctattgggataaaaataggtggtggagtcatactgatacttcttttatttgtagcagtagcggtctggtcactgcaaatttttgatagtattgtaaccgaggttggggatatcagtacaaggattcagatggtggatttggatcataaacttatcaatgcgtttaaggaagctaaccgagatgccgaagcttatttactatatggtaatgaaaagtataaaaatgattatttacaggatgtggaaaattttattagccttataaacaaacggattaataactgtttagcagaagaccggcctaagtttgatgaagttatagctaattttaatcaatattacgatgttcttattaaccaggcttttccattagcggcaaagggtaagctccaggatgctataagtaaagcacaaagcgtttccagctatgctgatgctgcggaaaaaattttagaagaacttattttatcaaataaagaaaatacaactacttcgctttccttaattcaaagtgaatcgcaggaaggacgatggctaatcataattttaaatattgtctccctgattcttggaattattatcgcattctggcttacgcggatgattaccaaaccccttttacttaccgtaaaggaagctcaacggattgccgaaggggatttaactggaggggagctattagtgaagaccaaagatgaactttcgctactagttgaagcttttaatacgatgcgtgccaatctacggaatatcattagcacgttaatccagactgccaagcaggtaagtgacaattcccagcaatttgctaaccaggcccaacagacggcagcgggaattagtgaaactacagccgcaatgagtgagatggcaactacggtagaacaaattactcagaatactcaggcagtttcgattagagcggagcaggttacagcccaagccacagagggtgcgaaagatgtagaacacgtaatggaacaaatgaaaatgattgaagaatcttccaataatgcttcaaaagtaattgaagaactttataagactaccggtgaaatcaccaggattgttgatttgattacccaaattgctgatcagactaatcttttagcattaaacgccgccattgaagcagcccgggcgggggagcatggtcgcggctttgctgtggtagcagaagaagtaagaaaacttgcagagcaatcggcaaatgcggctaaagatatatatgaactaattaccaacattcaaaaagagaccaagcgggcggtggaagcaatggccacaggagttactgaggttaaaaaaggaagtgtcactgtttttgaagttggtaagaaatttaaagaaattgtttcatcgattgaggaagttacccggcagattcaagatgttgcttctgctgccgaggagatatcagccggggtacagaatgtagttgcgtctactgaagaacaaactgcagctatcgaagaaatttccgcttcttccgaagaattagcttctttagcggctgaacttgaaaaaattgctgccagatttcgagtgtaatgatttaaaaaaagctctcctggcttttttaaatgggcttccaaaaagtacttagatatagctgaatattttgattaaaaaatggaagctttaaaaaatcaagagtaaagatttctcaaataaggtagcctttatcactacaagcaattgctcaaaaacatacgaatcatctgaagtcaaggacgggcaaggcccggcgacacagaggtggtattctgcttaaccagcgttgattagtcactagtttctaaatgtacgaatttaatacaaaaatttggattagatcatacctaaaaattattgaacaatgaatagtgtgcaaattgttaaaactttattaatatgcaaaaatgcataaatattcaaaattgaataatgtagagctacaaggttaaaactattattaaaaaataataacgaataaacagaactgtaaaagatttataaattattttttaaaaattcgtaaacctggtattgtttttgcttaagtgttattgtgtgtaaaagccggccggagcggaaatttatatttggtttgggagtggtaaaagtgctttccaaaaaaatcgttgaagaattgtgggaaatagtaggaaaagaaaatgttattactgatcctatagttttagaagtttacggaattgatgcttcaccgtatagttcaatacccaaagcagtgatttttccggagaatactgaacaaattattaaattagtaaagcttgccagtcgcgaagacctgcctataatacctaggggagccggaacatcgctttgtggtggtgtggttcctgtaaaaagtgatattattcttgtcctaactaaaatgaaagaagttatcgaaataaataaaaaggatggatatgctgttgttgaacctggacttaccaatggcgagttacaagaaatattaaagccttatggttttatgtttgcacctgatccatcaagttttagtgtctcaactataggaggtaacgttggggcaaatgccggtggtattaaaggggttaaatatggggtaacaagcaatcaccttttaggcctggaggtagttatgcctgatggagaacttattaagacaggaattttatcacctaactatggggttgagcatgacatcacaggcctattttgtggttcggaaggaacatttgggattataactaaaattgctgtgaaattaacacctttgccacaaagtataggtactcttttaaccttttttacttcattgcatgatgctggacaagcagtttctgatattattgctgaggggattattccaactacattagaaataatggataaaattacagctaaagcggtaaatgagtatataaatttaggattgagaccagaaactgaagccttgcttcttattgaagtagatggcttagaagctgaaattcctggaacattagctcgtatagaaagaatcttacataaaaacaactgtataagtgtttcgaaagcgcaaacgccagaggaaagagaattactttggcgggcacgccgttcaaatgctggagcaatgggtaggattaggcctttaaatataactcaggatattgtggttccccgtgataagttaccggaaatgattagtaccacccaagaaattgcaaaaaaatttaatgttcttattggccaagtagcacatgctggagacggcaacgttcatccaatatttttatactatccttgggaccatgatgaattagaacgggtagaaaaagcttgtgacgaggttatcaaattagcaattgatttgggaggaacgatctcaggtgaacatggtatcgggattgaaaaattaaagtatatgagttgggagttttcacctgaagatctaaattttatgaaacaaattaaggaatgtttagatccaaaaggtattttaaatgctggaaaggttataccttaaattgcgggtggtgaatttaaagatgatgagcgatattttagagaaaattgaaccaggtactttagaagaactaatgtggtgtataaaaaattatgaaaaaacaaataaacatattattcctataggacaaggaagtacccttaaaacagtctcattaacaaagagtgatgattatgtgtatgtttcttccaaaaatttaaataaagtaatcgaatttgctaaagataatttaacaattactgttcaagctggggctaccctaaaaaaaattgatgagttgattaataaaaacagtttaacattaatgcgcagtcctttaatggcaggggaacggacaattggaggtattgttgccgaaggagcattttttaatagagatttcagtcaaagcattcttggtttaaaagttattttacctaatggtgatcttattaaaactgggggaaaaaccattaagaacgttagtggttatgatttaagaagcttattttttggaagtcgtgggactttaggttttttggtggaagtaactcttaaactccagcctgttaaacctgcagctgaattaatagctataaaggttcatcccgatgatgtttctaccgttttgatgaatattcttccctatcgttattatataacccatttgttaatagaaaatgttagccttgaaaatgaagagaaaggtgaatatgtaaatattttgttattttatgaaggtagcgttgaagccgtagaattcttacataaatttattttggataagatgataggaaacaagtttttaaaaacaattacaaagacaattacagacaggaaagaaattcaaaataccattaataaacttccggctaatgagtcacaatttgctgaatacagagttttggatgaaattgaactgtttaaaaattgtggatttaaaaacgaaaaattcatatttgatattaaggcaaaatatttgcgaatttttaatgatacttctaaagcagaaatagaagtcagtgggaatgctgcgaaagtgttgaaacattatttgtttaatgacgttttcctccaaattaaaaagaaaattgatcctaagatgatatttgcaccatatttggtgaaaattgtgaattgaggtggtaaaatgacacaaataaaagaattgttactaagatgtaataaatgcggtctttgtcagcaatcgtgtccaacatataaagttacaaaaaatgagttttacttagctcgtgggcggaatcgattaatggacttagtactagaaaaaaaatatgactggcaaaaacaaataatatatgcaatagaaacttgtttacagtgtggagcgtgtgttgagacctgtccatcttcggtaaaaactgacttagttatgaatttggcgaaaagagaaatagtaaaaataaagaaacaaaatatcttattaaaatttgcctacaaaattttgttgcctactcctcaaatgataaaaattgtaggtaaatttgtcaaggtatattcaaaagtaaaagataaaaaagttgttaaatatgttaaaagattaaatcctattaatgaccttaaaaggttagagaggtctttgcctaattatcgaggggaagtaggtgagttaaaaacaaagggaaagggaagttttaataaagagataagagttggctattttaaaaattgtgctaatcttcttgcctttaattttttagatcaatcaacttttaatgtgctgaaagcagtaggaattcatgtggagaatttaacaaataaatgttgtggagctcctcattggtttagtggggatatagaaacatttaggaatttagcaaattacaatttaaaaaatagtgaataccaaaaatatgattttattgtgacagattgcgctacctgtggggcaatattaaaaagatatggagaattattggaaacgaaagaagcgcacgaatttgcccaaaaggtaatagatattaatgagtttttagtaaaaaatgagttgcttgattattttgaatatgaagagaggagtgatgttataacagttcatgatccatgtcatttagtgcgggagcaaaaggtaaaatttgagcctagaaaaattgcgaatatggtgcctggggtaaaactaattgaaatgaaagactcgaatatgtgctgtggaggagctggggtctttagcataacacagccaaggatgtctgatgaaattttgaaagtaaaaattaaaaatatattagaaacaaaggctaatatagttttagctgcctgtccttcttgtattatgcaattaacgcggggtgtagaaacttttgctcctaatagtaatataaaagtatttcatccaattgaatatttagttcaacatataaaaaaataaattagttaattatttggaggaggtggcctttttaagaaaaattgagtaaagttctaaaagaatacttaagagcgatagggggtgaaagtaaaaaagtttgatggtaaattttttaaaaaaatttttagaagacaatttggctaaaaaaattaatactaaaggaggagtgggaaaatgaatttaagaaaattcgggattttactgcttgctctattatttacatttggaataataactggttgcggcaaaggtggaacgaaaactgaagaaaagaaaagtagtgaaaataaccagggagtaattgaaataaaattatcccacagttcaccggcaaccaatgaccgtttagaaactgcctgtcaggcttttaagaagtatgtagaagaacataccaatggaagagttaaagtcaccacttatcctgctagcgttttaggtggtgaacgggagcagttggaaggagttcaaatgggtacaattcaaatggcagctttaagtactggaccatttccaggaatctttccagaaataatggtatttgatatgccttatctcttccctcaagataccagagtagtttacaaagtattagatggtccagttgggcaagaaataagtgatttattattgaaaaaaaccggagtacgtaatcttgcatttggggaaaatggatttagacattacacaaatagcgttagacctatcaagaaaccgggcgatatgaagggattaaagattagaacaatggaaaaccctgctcatatggctattgtgaaagcattaggtggcagtccaactcccatggcgtttaatgaagtttattcggcattacaaacgaaaactgttgatggccaggaaaacccaatttctctaattgtttcaatgaaattttatgaagtacagaaatacttaaccttagatggtcatatatacaatccttacctgcttattattaacgataagttctataatagtttacccgaagatattagaaaagtaattgatgaaggagcaaaagtctggcaaaaagttgaaagagaagaaaaccaaaaacaaatcgaagctgggatgaaagtattaaagaatgcgggaatggttataactgaacttactcccgaagaacttgaagcatttaagcaggcaacaaaaacagtttacgatcagtttaaatcgcaaattggtgaagaactcttaaataaagtaatcaaggcagtcgaagaagcacaaaaagaaatacaataagaaaaaattaagtagaagagagcagtggccccaatttatagaagggccaaatgctctcttcaaaatgataagtaatgatgtaaataggtaaaaaataataaaacaaagtatgttaaatttggacaaggaggatgacaaagtacatgagtttcttaaaaaaacttgatcgaattttggaatttattgaacaaaatcttgttgctattttactaatgataatgacggcggtagtattttggggggtaataacccgttttgttttaaaagatgcatcatcgtgggcagatgaagcctcaagatatttaaatatttgggcgatttatgtgggagcgagccttgctgcaaaaagaggggctcatattggggttgatgcttttgtgcattttttacccaagcaagctcaacgttttgctgccatactagcagcagctattaatttaattttcagcttcgcaattgcttatgtgggctatagttatacaatggacatcgtaaaaacaggtcaactttccccggccatgcggataccaatggcatgggcatattttgcagttccatttgggcttaccttaatgggcattcgttatcttatgattttaattgaaaatattaccggaaaaagtatattaagctaagttatgtaggaggtagatacctaatggcaaatatcttgtttacattatttataatatttgtggttttgaatgttccaataggtattgcaattggattgtcaacatttggagcaatattagcatcccaaaaagtaccattatttttagttgcgcaaagattatttacaggtcttgattctttcccacttttggcaattcccctgtttatgattgctggaagtctaatggaatcgggtggtatttccaaacgtttgattaattttgcttcaaatattgtaggacctatacctggcggtttggctatggtcaccgtacttgcctgtatgttttttgcagcaatttctggatctgcgccagctactgtagttgccattggatcaattatggtaccggctatgattgaagctggttatgacaaagattttgctgtgggattaatagcagcatcaggaatgataggtgtcttaattcctccgagtattccctttgttacctatggtattactatgaatgcttcaattggtaagctatttttagctggaatagtgcccggtgttttatttggtctatcttttatgattatttcctacttttatgccaaaaagcgaggttataaagggacagctaagcctacttggaaaagttttctaacttcatttaaagaagcaatttgggctttaggaatgcctgcaattattttaggtggaatttacggtggggtatttactccaactgaagcagcggcagttgcctgtgtttattctttaattgttggcttttttatctaccgggaacttactttacaaaacatgtttaaaagttttgccaatgccggtgtttcttccgcaatggttggtttaattattgctgctgctaccgcaatgggttgggttttaactacggagcaggtaccaaccaatgtagctacagctatctccagtattgctcacagtaaatttatgctgctactgttaattaacttaatcttacttattacaggatgtttgatggaactcaatgcggcaatcattattttggggccaattttcctgccacttattatgcagtacaacatagatattatccattttggtgtaatcatggtggtcaacttaacaattggtcttttaacccctccattaggtgttaacttgtttgttgccaatggtttgcaaaaggatcttacattatcgcaagttgtaaaagcatctcttccatttatgattttcgcaattattgatttaatgatcctgacatatgtccctaatctatcactatacctaacgcatttactaaaataaaattttgaaaatatgcgctaaggcataaaattcctcaattcaattaaaaaatacaaaaagcgaatgagtacggttgaagaattacaaccggaaagttcgcgctttttcaactaaaaatattactcgttttaagttggcattaattttgcagaaaagaattattatgaatttggaaggtgcaaagatgtttgaaaaaaaaataaacatattatttggcgaatatggaactggtaaaacagaattagcaattaatctggcaaaaaattttgagtcaaagggaaaacttgtatattttttggaccttgatccagcaaagcctcattttagggcaagggactttttaaaaaaagaaaaaattaaaatccttgcaattggtgaaaacttttacggccttgatataccgcttatttcaaaggaaatgttacaggcaattatcgagcctaatgtttatgtggttattgaccttgggggcaacgattggtttagggtgattggacaatttaaacctcttttaaacccggaagaagttgggttgtacttggttattaattactatcgacctgtttttgaaataagtccattaaaaaaatttgctaaaaaaatggaaaccttacttggtataaaattaagcaatatattaaataattctcacttattggaaactacaaaaaaaagcgatgttataaatgcccttccaaaagttttggatattgcaaaacaaattggtgtaccagttattaatgtattaagtgaagaaacatttgctaatttgtctgaaaaagaaaaggagatatttaaaccgtattggcttataaaacgcttttgttcatatagttttaaaagaaaaatttcctaaggaggtgaagagcaaaatgagagcaatgcataccagtttacctgaatggattttaaaaatgaaagccgcggtttataactattcaccgtttaaagaaataaaaattagagggattgaaaatttaaaacacgcaaagtttcaatcactacgcaccggacgagtggaatttgctgtgtctgaacttgccgctgatcatcgaataaaaaatatcgaacttgtaatcgtgccaagaattcccgaaactatgcataccatcattatcaaaggttatgatgaagagggtaaaccggtaaaagccatattagaaaatactaatattttgcatccaactgaggatgtggaattggaagggtttaccgaaattgaagaccgacggccaaagctgggagagcactaaaagggagggggagattaacttgggagaattaaccggtaaggtaggtatagtgacaggtggaagtaaagggattggatttgctacagcaaagcggatagctgaggaaggggctaaagtagtaattgccaatcgtaataaagaagagggagagaaagcagctttacaattacgtgaaaaaggcctggaggtttatagcatcccatgtgacgttgggaaagttgctgatataaaaaaattagtttctgaagtgtatgggcgttatggacgcattgatattttagttaattgtgcaggagttaatgttcggaaacctattgaggagtacacagaagaagattggaattacatggttgatattaatttgaaaggaacattttttgcctgcattgaggcaggcaaacatatgattgctcaaaaagagggggtaattgtaaatttagcttctattcaagcggaagaagttttaccagaacgaggaatttacgcaactactaaaggtggggtaaagcaacttacaaaagccttagcagtagaatgggcgaaatataatattcgggtaaatgcagtatcgccggcttttatcaaaacagaaatggttgagaaagtcctgcaagatccctactggggtaatttaattattaacaaaaccccgatgcgaaggccaggaacccctgaagaggttgccgaagcgattttgtttttagtttcccctaaagcttcgtatataactggaattaatttgctggtggatggaggctggacagcctaatgaaagctgcggtattaatggagccgaaaaaaataatttttaaagaagtcccagtaccagaactggaaaaaggtaaggtgcttattaaagtagaggcggttggcatttgtgggagcgatatgcatctttatcttgacgggcacataggggcaacagttctggataaaccattagtgttaggacatgaaatcgtaggcacggttattgaagtgggtgaaggagttaatagagaattattaggccaaagagtaattgttgatcctggtgaaaattgtggacaatgtgagcactgtcggacgggggcttataacctgtgttcattttccaaatttaaaggtattccaccagtagatggtggaatggcggagtatataacagcattggctacgcatgttataccgctacctgaaaaccttgattcaccaacagctacgttattagaaccatttagtgttggtttacaagctgtagatgtggctgattttcgagctggagctaaaattgcagttttaggtggaggacctgtaggagtgttaacagcaattgctgcaaaaattagagggtgtggtgacttatggctaactgaattatacgaaagaagaatagaaattgcccgaaaattgggaatagaaaaggtaatcaacgtagctcaagaggacccattgaaaacaataatggaagtcactaaaaaatcaggtgtggatgttgtttttgaaactactggaaatcctaaagctgtcgaacaagcgcttcagattgtaaaacggggaggtacggtggtatttctggggattggtgcaggaaaagtccctattaatattgatcaagtgacaagaacaggtcttaaacttttggggagttttcgctatcaatatcactttgctggagcagttgccttggtaaaaaaacataacctagacttttctccccttgtcaccaatatctacgactttgtagatatacctaaagctttagaagaagtttcaacttataaagacagaattatgaagggagtaatagtctttccccaaaaataaattgtttgaggtgaatgtatgagtaaaaaaattaaagtacgatttttaccgaaaggccgtggtcccaaacatggagcgccggtaactatcgcgtatgttgatgttaaagaatttcaagaagcaaatttggaaatagatgaaggtttaaaaattattgcaaagtactttaattctcctgtagctataaatgtgtttgatatggaaaatgcttttacgaccaccagtgatggactttgtgtagaaggagcaattatcgcatttgctgctgctgatagggggaaaattcatcccgagtttggacggctattttgtaaagagcgggaattaaagccagaaatgtttgaacgggagcctcatttgaggatgggttatgaaaattttcccaccaaaaagctttatataggaccggatccagctcagaagcttgtgcctttacacaatgttgtgattagtggcaggacggtaaataataattcaggtacagaagtaatggattgcgtaacaatggaagaaatgcttctgccaatattgggacaacttcaaataatgcgagatgaggatatactttggggcattacaggtggacatatatctgtgggaattggttgtacaattgttgaagattatagtcgttcccagccttttatgaaatgtaaaccgggtaatactgctcataattcaggaccttatgctcaaacattgaaagcaaaactaccttgtattgttgctccaaaagatgtgttagcaaaacatattcttgatgcgttggattttggattaagaccggcgaaagaattgggatgctcaccggcggtattatatgttgcggcttactacggggtagatctaaatattgagaatattactccagcagcaaggttggagttagaagcacttggaattgaccttgataaattgcctgaaataactcctaaattaagtcgggaagaaataatagctcgtgcggatgagataattcctggagttgaaaatgctgagctgattccaagcacggcaattatagaaaaagttgagattgttttgtagtggggggaggaggaagtaagactgtggatgacataacaattgaagaagtcgtcattattccaacaggtggtgaaataaaacaaggaattgtattggatacaaactcaccaaaattaatggagttaatattaaaaaaatggcctgattgtaaggtgattagaacacctccaccagaagatgatataagcgccatacaaaaagaagtaaaaaaatggggtaaatgcaagggaattatatttattacaggtggtgcaggtgggggaaagaaatttaacagtggtttaacagttgattgtacgcatgttgctgttttagaactaattcaaaatgctgaatcagtagaaatacatggtagtaatggtcatttattagccaaaattgtagtaggtaaatatgaagaaaaggtaattataactttgccaggacctacggttgaggcagttagcggagcaaaagccgcattaaaagttttagataaaggccttttagattgcaaggtgatagcctttgaggttgctgatgcgatttttagtcaatatccccagaaagaaaaaattttaaatcaatattaaaagaggtgataagaattgaaagtaactgttgattatgaacggtgtaaaggttgtggattatgtattgatgtttgtcctaaaaaaattatttatttaaatcaagattttaacagtaaaggttattattatgcaaccatttcaaatattgaagaatgtattggctgtggaagatgctatcagatttgccctgacctggtatttgaagtgaaagaggaggcgaagattaatgggtaaagtattatttaaaggtgctgaagccattgcggaagctgccattcgaagtggatgtaaatttttctttggctatccaattacgcctcagactgaagtagctgaatatatggcaaaaaggttaccgcaagttgggggagtttaccttcaagcggaaagtgaagtttcagctattaatatggtatttggggcagctgctacaggagcacgggttatgacatcttcatccagtcctggtgtgagcttaaagcaagaggggatttcttatattgcaggagctgaattaccttgtgttgttgtaaatatcatgcgtggtggacctggtttaggttgtattcaggcagcccaatcagattattttcaagcggtaaaaggtggcggacatggagactataaaaacattgttttagcaccgtcaactgttcaagaagcggttgatttagtgtctcttgcctttgatttagcagataaatatagaaatccagtaatgattttaggagatgcggttcttgcacaaataatggagccgattgaattacctgaagagaaaaaggaattgcctgaaaaaccatgggcaattactggttgcagtaatcgggagcaaaatataattacctcatcatacccggtacctgaggatttagaagctgtaaatgaaaggctcaatgcaaagtataagcagattataaaagaagaacaacgctgggaagaagatggggtagatgatgcagagttggtttttgttgcatatggaactagtgcccggatagcaaaagatgctgttgaaactttaagaaataaaggaaagaaagttggtttgattagaccaataaccttatggcctttcccgaaaaaagcgtttaagaatagaatggcgggcaagaaaatattagtagttgagatgagcaaaggacaaatggtcgaagacgttgaaattgcagttaaaggtcaaggcgaaatttatttctatggaagaacaggtggcattgtgccctatgttgaagaagttctcgaagtagctgaagctattttaaacaatgaaaatgttaaaaaatggggggaagatgatgaaaactaaagagtacattcgtccaaaaagtttaaagcctacccaaacccactactgtccagggtgtactcatgggattatccatcggattttagctgaagtcttagatgaaatgaatttgagagaaaaggctgtagcagtaattggggttggttgttcatgttttgctgaaaggtattttaattttgattgcattgatgtagctcatgggcgggcaccggcagtggctactggagttaaaagggctaatccgaatttagtaacgataacgtatcaaggcgatggagacatgacggcgatcggttcggctgaggctttgcatgccgcaattcgcggggaaaaaattacttcaattatgataaataatgctatttatggaatgactggaggtcaaatgtcaccaactacgttgattggacaaaaaacatctacatctccctatggtaaaaaggcagaagaagcaggatatccagtgcggtttgttgagacgttagctttacaggaaggagtagcatatgcagctcgaactgcagtaaataacattggaaatattttaaaaacaaaagcagctataaaaaaagcattacaagcacaaatagatggtaaaggttattcaatagttgaaatattatcgacttgcccaaccaactggggtgtatcgcctaaagaagcactaaaatggattgaagaaaaaatgattccagtatttccgttaggtgagtttaaagaaatttaaatgaggtgatgattgtggaagcgacaatttttgctggttttggtggccaaggggtaatgaggattggacaattattaacttatgcaggcttaaaagaagggaagggagtaatctggtatccggcttatggttctgaacagcgaggtggcacggccaactgtactgtaattatagacgaaagaagaagccaggtagtttcgcctgtagtaaaatatcctacatcgttagttattttaaatgaaccgtcattgctcaggtttgaggcaagattaatggcagggggtaaacttttttacaatagctcgttggtgaaatcaaagcctaagcgggaagatattgatgtatatccaattcctgctaataaaatagctgaagaactcggcaatgtaatggcggcaaacatggttatgctaggtgctatggcagctattacaaaagttgtagatattgacagcttaaaaaatgaattgacaactatatttaaaggaaaaagtgaaaatattataaaattaaatgaactggcattagaaaaaggtagggaagcagcattgcaattataaaataaaaaattttgagggggaagtgtttattatgcctttaaaaacagtaaaggagtaccttaatagcttaagagcgatgaagtttgaagtttattttaggggagagcggatagaaaatccagtagatcaccccgtaatacgtccttcagttaatgctgtagctatgacctatgctttagcgcataatagtaagtacaaagatcttgctactgcttattcaccttttgttgataagtatgtaaatcgttttactcatattcatcaaagcactgatgatttgttaaaaaaagttgagttgttaagaacaattgggcaattaactggggtttgtttccaacgttgtgttggcatggacggtttaaatgccgtttatgctgtaacgtatgaaatagatgaaaaatatgggacccaatatcaccaaaggtttataaattatttaaaatatgtgcaagaaaatgatttagttgtagatggagctatgacagatccgaaaggtgacagggggttaaggccttctgaacaggaagataaggatctttatttgcgggttgttaaggaaacagaagaagggatagttgttcggggtgctaagttccaccaaacaggagctattaactcccatgaaatattagtcatgccaacaatctccttaaaaggagaagaagaaaaaccctacgcagtatcttttgctgtaccttcggattctccaggaatagtctatgtatatggacgtcagccatcggatttaagaagtttgtacgatgctcctgaggattgtggcaatcctaaatttgcggggcaagaagctgtggtaatttttaatgatgtttttgttccctgggaaagggtatttatgtgcggtgaagtggagtttgctggaaatcttgtcgagtattttgcaagttaccataggcaaagctatggtggatgcaaagttggagttggtgatgttttaattggagctgctgctaatattgcggagtttaatggggtagataaagcttcgcatattaaagataagattgttgaaatgattcatttaaatgaaacgatattttcttgtggtgttgcttgctcttgtttggggtataaaacaagtgcaggtaactatatggttgatagattattggcaaatgtttgcaaacaaaatgtaacacggatgccctatgaaattgcaaggctactgcaggatatagctggcggactttttgtgacaatgccgtcatggaaagacttagaaaatggtaaggttggagaattgttgcagaaatatttggtcggcaagaaaggcgtaaaagtaaaagatcgggtaaaactaatgagattaatagaaaacttaacattaggacgatctgctgttgggtatttaccggaatcgatgcatggtgccggttcacctcaagctcaaagaattatgattaccaggcttgctgatatagagaaaaagaaaaagtttgccttgcggttagctggaattggtgagcaagaaaatgagcgattggagtgaacattgattgggatctgtacgcataatagcttatatagataagacggtagtaaaaattgtaggatttaaaattgatagaattaatttaatggaaattgaaaaaaaattaatagaaatattaaaacgaccggtgcgtgtaattggtgttagcggagaaagtttggaatttgatgtttatgaattgcctccggaacaggtttataggaatgaacgtaatattattgaggctattgcaaatgaaggtatagagggggttgaagtggcaaaaattgttaaagccgagcaggttccggaggttaatcttgatgatttaatattaaaacctgatgaagaatataattgtccagcggaaaggtggttgcgatggaaaaagctggaggaagagaaataaaaagttataacttttatgttgactttgagcctattgtggcgctagttaaagatacggtaattcccaagatgtataaagtcaggcaaaagtttgatgtaccggtactaaaaaatcctgttgaaaaattaaaccaagaacttcgcaataaagaagaagtcatgaaaaagttaaaaggaaaaagagtatgtattgcggtaggtagcagaggtatagcgaatattgcggattttgttgcagaaacggtaaaagtagttaaggattatggtggagaaccgtttattattcccgctatgggaagccatggcggggctaccaatgaaggacaaaagcaggttttagaagagcttggcataactgaagaaactgtaaaagcgccaattgtttcgcatttagacgtagaattagtagggaaaacaagggaaaatgtccctgtttatgcaagttgtgatgctttaaacgctgatgcagttatcattataaatagaataaaacctcatacatcttttagcggcgatattgagagcggtattataaaaatgatagtaatagggcttggtaagcaaaagggagccgaagtgtgccataaaatgggtttttatcgcttttccgaacggttgcaagaaatggctcgggtaattttaactaaagttccagtggttttaggaataggtttaatagaaaatgcctatgatgaaactgctgaagttaaggcgttaacgactgatgagttttttgttgaagaacccaaacttttaaacctggcaaaatcattaatgccgaaaattttagtaaacaatttagatgttttaatcgttgatgaaataggtaaagatatcagtggagatggaatggatccaaatgtgacgggaagatttgcttctgattatggaaaaggagatttaatcgtagatagaatagtggttctacgtctaaccgaacggacagaaggtaatgcaaatggtattggtgtagcagatgttactacattaaaggttttagaaagtactgattttacgaaaggatatataaatagtattactgctgcaataccgcgtaccgttcgtttgccaatggttatgcctaatgacgaaatggcaattaaggcagcaatcaaaactgctaataactttgattatgtcggtgaagacactagaatagtacgcattaaaaatactttaaatgtagagcaaatttacatttcgcaagcacttttgtcagaagtaagagcaaattcatcattagaaattgttgatgggccaattgactttgcttttgacgaagagggaaatattttaacaggatggaaataataaggagtggttgtgagaaatttaagatgaaagagtggttatgttgtttgttttttcccttaatattcagttaagtccttccatttcatttcttacacttggatatggaaattacaatgttggaagtaaacacttaccttttttgtgtgcaataagtaaattgcgaaaacagatagaaaaggaaaaaaatgcagtggaaatgataagggatcctgttgcgcttgattattggttagccaagcaaagtaaatttttagcaatagatggtattgaggtagtggctttaagtttaaataatccattaattaaggagccaggtggaggtgtaataggttcaccgtttaaaaaactgcagcctgcccggggtgaaattgagtttttaaaaagtgatattggaattttaacttttcctgaaggtcctggagtagcacttattggaatagataaaagtgactttgaaaactttcgaaaggaattaggtaagcttaaagaggtaaagtataatttttgtcgaattttagatttaatagaaaaaactaaagttaaaacagcgcttttcatttctgatggatgtggtttagtagaaactggtggtggcttttatattaggaaattcaatattagaaaattttttttcttaccctggggcagagtgagtggtgaatatgaattggaattatatgtgtggcaatgttaatgaggaaggggttaaaaaatatttaaaggagttaagcaataaaaaaaatgtagtaccggtatttgttagtgtatttaatttaaaaggagagttattagctttttactgtaaagtttgtgaaaattgcaaattcaaagaaagcccctttcctttagagcatgaattactaaatatgtgttttaatgatgagttaaaaattatagtagagtcaattattgaagaagtggacaggttggatgatttagtaattaaagttaagacagtaaaaataagtagcttattaaaaaaaattaaagaactttcattcttgcaagaagaactggaagctattatcgaaagctcgtatgatggtatttacgtttcagactgtactggaaaaacattaaggataaacaaagcttatgagagaattactggtataaaaaaagatgaagttattgggagacgacttgatgaattaaaggctgaaggttatttttccgaaattgtttacaagcaggtagtgaaagaaaaacggcctgtaacaattttgcaaaaaataaaaaatgaaaaagaagttgtggtaacgggaaatcctgtattagacaatagtggtgaagttaaacgtgttgtgaccaatgttcgtgatatttctgagttaaacatgttacggagagaacttgctgaagttaaagaaaagtcaaagcattatcaacgaaaaattgtagaacttcaagaaaaattaactctattttgtcaagctcagcaagactttaaaggttttattatcaaaagtcctctaatgaaggatgtaatatataaggcattgagagtagcaaggactgatactacagtcttaataattggagagtctggaactggcaaggaagttattgcccggtttattcattttaatagtttacgtaaagataaagcgtttttacctgttaattgtggtgcaattcctgaaaatttaatggaatctgaattttttggttatgaacctggtgcttttactggtgcccttaaaacaggtaaaatggggttttttgagttagctcagggaggaacgctatttttagatgaagtaggagaacttcctttgcatttacaagtaaaattacttagggcattacaaacgaaagaaataatgcgtttgggaagtacaaaacctataaaagtagatgtacgcattattgctgcaactaatcgcaatttagctaaattggtggaagaaggtaagtttcgagaagatttatattacaggctaaatgttatatctattgaaatacctcctttacgaaagcgaaaagaagaaattattccaatggcaatggaatttcttactcgaattaatgaaaagtatggtagtgaaaaaaaatttacaagagaagtattagaaatattaaaagaatataaatggcctggtaatattcgggaattggaaaatgtaattgaacatgcatatgtggtaagtcaggatgaaattaacgttgaagatttgcctatacatttggattcactttacggggaacctggtaacattgctttaattagaaagacattacaaaatagggaaaatatcactttagatgaagcaattagtttagttgaaaagaagttaatagaagatgctttgttaaaatatggtacagaaactcgagcagcaagtgttttaggtgtaaatcaatcgactatatcgcggaagattaaaaagtacaatattgatgttaaaaaaataattgaaaaaaataacgaaaaagaattaagttagtaattgtgcatttatttatgcaaaaataaataaaatgcattcatgcctaaaaacattaacgtttttgtaagattttgctttttcattaaaaatacaaaaattaaaaatacatagatttaaatatggtttttttatgtcaagccatctttttttaaatataataccttataccttaaaaagatggcataaaatttgctaaaaaatttagaacgtcgaaagatatctcgaaatgggaaaagttttaaagttacaaaaataaaaaggcaaacaaaaattctctaaaaaaaataatgagagggaaagaaattatggacttaaaagaaattagggcaaccgccagagaaaagctcaagggattttgccgggtttgcccggtatgtgacggtcgggcatgtgccggagaagtaccgggaatgggaggagtaggtaccggaaaagcttttcaggaaaatttacgggctctttcccggtataagttaaatttaagaacgattcacggagtaaaagaaccggatttaagctttgaactttttggggttaaggtaagcatgccggtttttgctgctccgattaccggaaccacttacaacatgggcggagcgttaactgatgaggaatatagtttagcggttgttgaaggtagccttttagctggaaccttagcttttaccggagatggagccgatcccaccatgtacggttcggggttaaaagcgattaaaaaagtggagggtaaaggtattcccattattaaaccaagagcgcaagaggagataattaaaaggattagagaagcggaagaaacgggagctattgctgtaggggtggatattgatggagccggattactaacgatggctttaaaggggcagccggtcagtccgaaaaccctggaagaagtaatggaaattgttaattccaccaggcttccgtttattttaaaaggtattatgacccctgatgaggccgaattagcggttcaggccggggcgaaagccattgtggtttccaaccatggtggaaggacgttggatgaaactcccggggctgccgatgtcctgccggaaattgctgccagagtaaaagggaaaatcaccatcctggccgatggaggagtaagatccggtgtcgatgttttaaaacttttggcgctgggagcggatggagtattaatagggcggccgataattgtggcagcttttggcggtggtgccgaaggagttaaaatttacctagagaaaattaaaaaggaactaagggaagcgatgcttttaaccggagttgcgcgggtgaccgaagtcccgggaacaattatccggaaggagcagtaagatgggaaattatgttgtggggtttcatcttaatataaaaataacctagaaaaaataaattgaatgtaattattccaactcaggaggtttaaacatgacagaaattttaaataaatttcgtggagtaattccaccgatgttaaccattttcaaagaggatggtacctttgattgggaaggcaataaagctctaatagattttttaatcaatggtggagttcatggaatatttgttttagggagctctggagaattttctcatctaaatgctgaagaaagaaaggaatttgccaaatttgtggtagattatgtagcaggccgggtacctgttttagtaggtaccggaagcagtaataccaaggaagttgtggaattaacgaaacatgccaaagaaattggagccgatggtgtggtagttgtttctccttattattggggactttctgaaaaaaatttataccagcattttgcaactgtggcgaaagtagtagatatacctatagttctttacaatttccctgatttgaccggtcaaaatctttctccttctcttgttgcaaagttagcaagtgattttccaaatattgttggtattaaggatacaattgatagtatagctcacataagagaattaattttacaggtaaaaacagttagaccggatttcagcgtattggcaggatacgacgaccacctattcaatacattggctatgggtggagatggtgtaatacctgggacagctaattttgcgcctcatatacctgtaaatatttataataattttgttaagggcaatatagaagagagcatgaattggcaccggaaacttttaagactgccgcgcatttatagtcttgataagccagcaattagcttattaaaagaagcttgcaagctttgtggtttacccgttgaaagttatatacggcaaccagcggggcgtgctgatgaagcagcagtagaaaacctaaaaactttgcttagggaagcgggtttaataaagtagttacacaacctccttttagcatcttttctgtttaaaaggtgtcaaaaggctgtttttggatatcttatagtagtctttgacatctcctgggattttttaaagattttttgtgaataaggaggaaaatcaatgagtcagtcattaattgcgttaaccgtattttttgcaacttataccttaattatttctgaaaaactacaccgggctatagcagcgcttttaggcggtactttattaattgttttgggcgttttaagtcaggaaaaagcaattcaccatattgactggaataccttgggcctattaatcggaatgatgattattgtcggcattaccaaaaaaacaggagtctttcagtatttggcagtaaaagcggttaaatgggccaaaggggagccagtttatattttaatagctctggctaccgttaccgcctttttatcggcatttttagataacgttacaacagttttactaattgttccggtaaccttcactataactgaccggctggggataaatcctattccctttcttatttcacaggtgttagccagtaacatcggcggtaccgccactttaatcggtgacccgcccaatattatgattggcagccaaactcatctggatttcctagattttcttaaaaatttaacaccggttattatagttatccatatcgtaaccatgtttcttttttacttgatttattataaggaatttaaagtacctggggaattaaaaaagaaattactggaattaaatgaattagatgaaattaaagattttgcccttttaaagaaaagcctttttgtcttaggcctcgtcattcttggctttattttgcacggtgcacttggtttagaatcggccaccatcgccttatttggtgcagcacttttattaaccatcacccgggacgagccggaggaagtgcttttaaccgtggaatggccttccatcttctttttcctcggcttgtttattgtggtaggaggccttgtggaaacgggagttatcgaccgggtagcccgctggagcctggaagccaccaaaggtaatttcactttaactgggatgttaattctctggctttcggctataacatcggcatttgttgataacatcccctttgtggccacgatgattccgttaattcagaagatgggtgctttagccggcatgacaccacaggctttagagccgctgtggtgggccttatctttaggggcctgcctgggcggcaacggtacgataatcggtgcttcagctaacgtaattgtggcagggttagctgagaaaaacggctatccgatttcgtttattagctttatgaaattagcctttcctttaatgttagtttcggtagtaatttccatggtttatcttctcctgttttacttttaaaggaaaaacatataaatttttcaattgaaaaaattagctttgaacgccttatgaaaaaggttatttgagtaggatttttattaaatggttaaggaggaaaattatggataaagtagatttacaaacagcggcagaagcgctctggaaagcctgtcaagaaagaaaagcattagaacagcctttaacggaaatttatcctgatattactattggtgatgcttaccagattcagttaattaatgtagacaagaaaaaagctctgggacgtaaagttgttggtaaaaaaataggtttaaccagccgggcaatgcagcaaatgttaggagttcatgagccggattacgggcatgtaactgatgacatgattggcgatgaagaggttgctatttctcgttccaaattattgcaacccaaaattgaagcggaaattgcttttgttttaaaggacaggcttgtaggtcctggagttactttaacgaaagtattgcaagcgacagcaggagtaattccagtatttgaaataattgatagccggattaaagactggaagattaagattcaggatactattgccgataatgcttccagtgcgatggttgttttaggaagtaaattaataccggtagatcaggttaatcttaaatatgttgggttagtattagaaaaaaatggagagattattgataccgcggccggagctgcggttttagggcaccctgcattagctgttgcctggcttgccaataaactttccgagtttggtattgccttggaaccgggggagattattttatccggttcgctgactaaagcgtatgaagttaccggtaatgaccattttgttgccaatttcgggcctcttggttcggttaaagtaaaatttactgattaacgattaacacccataagtagaagaaaattttaataatttggcatggaaattgctttgtattattggcaaataaattatattacacatttatttagcacaaaaagtgaaagtaaccacaagaacataacttaaaaatgaatacactttaggtataaaaagttacaaaaaattaaggacacaggttttcaattatgctttcaggaaaattatgcatatatgaataaaattttctttagttttatctataaaaaaaataaaaaaaggaggagttcatatggattttaggttatctgaagagcacgaattattaaggcaaacggtaagagagtttgctgaaaaagaagttgccccatctgcagccgcaagagacgaagaggaaagatttgaccgggaaatctttaagaaaatggccgaattagggttaacgggcattccctggcccgaagaatatggcggggcaggaatggattatcttgcctatgttatcgctgtggaagaactttcccgggtttgtgcttctaccggtgttacattatccgctcacgtttcgttgggaagtttcccaatttataaatatgggacggaagaacaaaagcaaaaatacctaaaaccgctggctttgggcgaaaaaatgggtgctttcgggttgaccgagccttcagcgggcacagatgccggttcattaaagacaacagcggtaaaagatggagattattatgtattaaacggatccaaaattttcataaccaatgggggagaagcagaaatatatgtagtttttgcaactgttgataaaaataaaagacacaaaggaatttctgcttttattgtcgagaagggaacacctgggtttaattttggtaaaaaagagaagaaaatgggcattcgttcttccccgacagttgagttaatttttgaaaattgccggattccaaaggaaaatttacttggtgaagaaggtcagggatttaaaattgctttatctaccttagatggcggacgcattggtattgctgctcaggcggtaggtatagcccaaggagcttacgaagctgcagtgaaatatgccaaggaaagaacccagtttggcaaacccatagctgaatttcaaggagtaagttttgttttagcggatatggcgactaaaatccaggcggcaaggttgctggtttatcatgctgcctggcttgaatcaaacaatctgccctatggcaaagctgcatcaatggctaaactttttgctgcagaaacggctatggaagttaccacgaaggcggttcaaatttttggaggctatggctatacccgtgaatatccggtagaacggatgatgagagatgctaaaatcaccgaaatttatgaaggtaccagtgaagtgcaaagaatggtgatttcatcgtatatcctcaaggaattttagtgctttaaagggtgaggtaaatgttattaaactatcatgccgaatatagaaaaaaattaacaactgttgagcaagcactggaagtaattacgaataattgtaatgtatttgtatcccttggtgcagcagaaccattaatgctcttggacggtttgggaaaaagagttttagagcaagatttaagaggtattaaagtctttcaactccttccagtacaagattctttgtacttaaaaccagagttaagtgagcgcataatgcatatatcgatgtttgccggaaggccggtgcgcgaattaataaatcagggttttgctgagatgattccttgtcatttccacgatgttccccaaattattcaggattatttagatgtcgatgtttttatgacaacggtttcgcccatggatgaacatggcttttttagcctgggaacatcggtggattattcgcttgcagccttaaagaaggccaaaaaggtaatattagaaattaaccccaatatgccaagaacctttggccagggaattgttcatatatcggaggtagattttttgattgaaagtgaaaggccgctgcctgagctttttccagaagaactaaaagccgaagacttacgcattggtgaatatattgctgaattggtcgagaatgagtcaacgttacaattgggaattggaggaatacctaacgctgtagctaaatttttaaaggaaaagaaaaacttaggaatccataccgaaatgattaccgatagtatggtggatttagtagaagctggagtaattaccggcagcgcgaaatccttgcatccttataaaattgttggtacatttgccttaggcacgaaaaaactttatagctttttgaataacaatccaatggttgaaatgcatccagtttcttataccaacaatccgtgtgtaatagctcagaataaaaagatgatttccatcaataccactttggaaatcgatttatgggggcaatgtgcatccgaaagtattggtacaaaaatttacagcggtactggtggacaagccgattttgcccagggtgttttacattccccgggcggtaaagggataattgctttatactctacggcaaaaaatggacagatttcaaaaattgttccaacattaaaacctggggcaattgtaacaacttctaaaaatgatgttgattacattgttaccgaatacggtgtagctaaacttcgaggaaaaacttatcgggaaagagcaaaagctttaataaatattgcccaccctgattttagagatgagttaaagtttcaagccaaaaagttaaatattttataaaaacatgaggagggagattaggtgaaactggtagtccttttaaagcaaacctttgacaccgaagccaagatagtattaaaggacgggaaaattgacgacagcggggtaaccttaatcattaacccctacgacgaatttgcggtagaagaagcactaaggatcaaggaaaaacttgggcagggggaggtagtggtagtatcggcggggagtgatagggctcaggaagcattacggcaggccttagccatgggagccgaccgggcggtactggtcaaaaccgacggcctgcagttagatgaaatggtggtagccgaagtactggcgaaagtgctgcagcaaatggaatacgaccttattttagccggctggcgggccattgacgacagttccgcccaggtaggggtacgggtagccgagattttaggcttaccccaaattaaccttgtcaccaaattagaagtaggggaaggcaagattaccggccaccgggaaatcgaaggtggtaccgaagtggtagaagtgcctctaccggcccttgttaccgcccagcgggggttaaatgagccgcggtatccttccatgaaaggcatcatgcaggccaagaaaaaagagttaaaggtcataaacgccgcagacctgggggtaaatgccacgcccaaggtagagataaaagaaatctttcttcccaaaggcaagcaggcggggaaaatcttcaccgatgagccggcggtagcggtagccaagttagtcaaagccttacgggaagaagccaaggtaatatagggggtggagctaatgggtaaagtatgggtagtagcagagcaaagggaaggtaagttaaagaaagtaacctttgagatggtaactttggcccggcaaatagggggagaggttgaaggggtagtaatcggaaaagacgtaaaaggcctggcttctgaacttggggaatacggagtagggaaagtatatgtagccgaccatccggatttagagcagtacaccaccgccaaatacacccgggtactggcggaattaatcaataaagaaaagccggaagtagtgttaattgccaactccgcccaggggcgggactttgcaccgcggacagcccagcgggtaggagcggggcagataagcgacatcaccggttacgaagaaggagtctttgtacgacccatttacgccgggaaagcttataccaaagtgggggccaccagccatccgttaatagtaacggtacggcccaacgtatttccggcagcggaaaagacaggcgggcaagcagcaattgaagaagtggcggtcagctttatgccggaagatttaaaagccatagtaaaggaagtagtcaagcaggtatcgggacgtcccgaattaaccgaagcggatatcatagtatcgggcggtcgggggatgaaaggaccggagaacttcaagctgttggaagatttggcggacgttttaggggcagcggtaggggcttcccgggcagcggtagatgccggctggcgggagcaccggtaccaggtaggccagaccggtaagaccgtatcccccagtttgtatattgccgtaggtatttccggagcaattcagcacttagccgggatgggcagctccaaggtaatagtagccattaacaaagacccggaagctaacatctttaaagttgccgattacggcatagttggcgatttgtttgaaatagttccgcttttaaccgaagagtttaaaaagcttttaaaatcgtaaaggaaggcatttttgccttccttctctaataaattttgtttagaaaaaattgcaaacaaaaggggagggattagggtgaatggaattccccagcgggaactttactggaatataaaccacacagccaagtttttaatgtacccgttgtttttaatcgccctggcaattttcgcctatgggatgtaccagcggtatcaatactggaaaatagggcaaaaagccagtgttaagtgggatttcggaagattcttaaaagaaacgtttttccaaagaagaatcttaaacgaactgtatcccggcttaatgcattttggtatcttctggggttttactgtcttgtttttaaccactttaatagtggcaattcaggcagacttcgggattaaagtatttaccggcaacgtttatttactttttagctttttagccgatgtaggtggggttgcagcaatcattggtattttaatggctattatttgccgctatattataaagccagatcgtctcgataacaagcctgatgatttaatttcattgcttttaattttaacaattttggttaccggttatatcgtcgaaggaatccgcatggcagtggccggggataactgggcggcctattcgccttttggcaatttagtggcccagctatttgccggagccgatgaaggaatcctcaggctgtggcatgttattctctggtgggggcatatgcttttagcctttggctttattgcttatattccgtattccaaattaattcacctcttcactgctcccatcaaccaggctttggcggatccccagagtgccaagaccttccccttaattgatttggaagctgaagatgcagaatcctttggggtatcgacggttgaagagtttacccagaaacagcttttagatttggatagctgtacccgctgcggacggtgtcaggataactgccccgcttatcttacgaaaaagccgttatcgcccaagaaaatgacccaggacctgaaagaggctctaaacgaaagagcaccggtgataattgccagagccaaagccgaactggtcaaaaaaggattgggggaagaagcggcaaccagtgaagtggaaggtgcggttacaagggcattaatcggggaggtaattgaagaagatacgatttggtcgtgtactacctgccgggcatgtcaggaagtctgtccggtatacgtagagcacattccgaaaacaatagagttaagaagaaatttagtcctaatggaaagctcctttccgcaggaagtacagcttacttttaggaatatggaaaataacggtaacccctggggtgtgggctgggccagtagagcggactgggcggaaggtttggatgtgccaatcctgggagagatggaaaaccccgaagaaatagaatatctctactgggttggctgtgccggttcctttgatgaaagaaacaaaaaagtctctcgggccttagttaaaatccttaaagcagcagggattaagtttgccattttaggtaccgaagaaaaatgctgtggcgactctgcccggagaattggtaatgaatatttataccagatgcttgcccaggaaaatattgaaaccatgaataattataaagttaagaaaattattaccgcctgtccacactgctataatactttgaaaaatgattacccgcagtttggcggtaattacgaggtgatccaccacagcgagctaattgccaagcttctttcagaaaataagataaagttaaacagcaccgataaccgtcgctttacctatcacgattcctgttacctgggacggtataaccgggtatttaatgagccaagggaagtattaaagaaggtaggagtaaaattaaccgaaatgagcaggaacagagaaaccagtttttgctgcggcgctggtggtggacggatgtggatggaagaaactttaggggaacggattaacgttgagcgtacgcggcaagctttagctaccaacccggagggaattgcggtaaactgcccgtactgccttaccatgcttgaagatggaataaaggcatttgataagaccgaggaagttaaagtttacgatattgcagagttagtggctgagaagcttaattaatttttatattcgaattaaaattatgccgttttgcataaataattaaattttataatccaccaatactttgggtctgttccgctgaaataccataagcgggatttcagaccttttttaatgtatttttttaataacaaataaatgctggtataaaaattgcttgtacattcctcgtaaaacaagagaattttatcttaaaatattctaaactctacttataatgggaaattaacttctatagaataaaaaattttaatagggaagtgatttatatggcagcaaagtttatttataggataaaaaaggtacaacgattaatgactgagagaaaaatagatattttagtggtcgtaaagcgagaaaacataatatatttaaccggactaactcaaatagaaaatatggcagtattaattccgatagaaggtgaaccgtgtataattgccaactggttggatgctgactatattgaggaagagtctggattaaaaacttttagctattttaaaccgagagaaaatttaggagataagattgccaagcgtataaatgcctatggatttaggaatgtaataatcggcttagaaaaatatttcatttctaatacggtttttgaaactatcaaaaaagctctaccagaagcaaaatttattgatgcatctgatttgttttataaggtaagagcgattaaagaaccaagtgaggttgaaaaaatcaagcaggcagcagttatggtatgcaagggaatggaaacagctttgaatcttatacgtcccggagtaagtatgttagaacttagtaaagaagttgaatatgccctgcttaaaatgaattcaaatagaataccatttcgaattcaaatagtttctggtgagcgtggactattaaactatgctgcctcaagttgtaaatatattaaggatggaaatattgtattagtttttcttgaggcaatctatgaaggatattatgcaaaaatatgtcgaaccatagctgttgggaaaatacccttggaacaggaattgttatttgaaaatttattggaagctcaagaaaaagcaattgcagcattaagaccaggtgctaaggcttgggaagttgattttacagcacgaaggatttttaaaaagttaggacttgaaaatcaatttatggatataattggatatggagttggattacgtccaattgagtatttcccgattattggtagaaaatatcatgatcttattgaagctggaatggtaatagaattattttcacctaaaatttatgtaaaggatagaggtggcccaagaattacagacttaatatatgttggagaacatgaaaatgagatattaaccgcttttcccagaaaattatttagagtataaaattcttatttttcaaatgtttcgctaattggcgtaatataaattaaagtttgtgagtggaaagtttttagcatttctgttataaaggaaactataataacagtagaagtcaaaggaaatatagtactaacgttaacaatattcaacaattaataagtcaaaaaacagccaaggacaaaaaagcaggtgaggtattatgtccaacatttcagtgcaagtaaaagtcgacaactttttattaaaaaattcatcgagattgaaggcttgccacgaaatagtggaagttccagaacaatctactatcagcactcttcttgaaattataggattgaataaagatcttataagttttgttactgttaacggggaacgcaaggatttagcttacaggctgcaagaaaatgatgtggtggccttttacccttatatttctggcgggtaaaattatgaagggttacttagaattcagaaaggagggagaaaataaatgcagggtttttatgggaaaatactaaggattaaccttaccgataagtcttaccgtgtggaagaactcagtgaagagatattgaaaaaatatttaggcgggaaagggttggggtcatatcttctccttaacaatgtcgctccaaggatcgatcccctttctccggataataagcttatttttactgcaggtccggctactggaacaggaatgttaggttccagccgttatggcgtatttagcaaatcgcccttaacaggtttatatgctgaatcatattccggaggaaaagtagctcctgccatgcgaaaaacgggctatgatgcgattattctggaaggagcttcttctgagccagtgtatttagaaataagtgatagtactgtaaagttccacgatgccacccatctttggggcaaagacacctattatactgaaaataaagttcttgaagaagtaggcgttcctggggctcaagcggtggtcattggaccggcaggtgaaaatttagtactttttgcctgtattgaaaacaactactggcgctcggcaggacgtaccggcctgggtgcggtgatgggttccaaaaaagtcaaggctgtagtttttcatggtcaggcccaaggtgaaattgccgatcctgagttattgaaaagcttgattaaatccattagccagaaagctaaagataatccgggagttaaggcttatcaaatgtatggtactacccagatggttagaataatgaacggagctaaagcctttccaacgaaatactggtctaatggtacctatgagcactgggaagatatcagtggagatagtttaatcaccaattttgaggtcaagcccaggagctgtcccaattgttttctggcttgtggcaaactgactaccgtgaaagaagggaagtacgcgggtttaacggtagaggggccggagtatgaaaccatttatgcctttggcggtttatgctgcattaaccgattggatgaaattttaaaattaaatgacatatgcgatcggttgggcatggataccatcaccgctggtaatttagctgcctttgctattgaagcggttaatagagggaagataaaggcagatttacaatatggaaatgctgatggcattgcccgactattggaagatattgcttatggcaggggcattggggcgatcctggctcggggtattaaaaaagcttcagaggagtgggaaatggaagatgtggcaatccatgtaaagggcttagagccggcaggatatgatcctcgagtccttaaagggatgggtttagcctatgcaacttcaacaagaggtgcctgtcatttgagagctacattttataaagctgaactaagcgggatgattgacccggcaacaatagagggcaaagccagattgtttatagagtttgaaaatcgcctaacgatatttaatacccaaattttgtgcgtatttttccgggatttaatccagtggccggagcttattcaactaattaaggcaactaccggctgggaatacacccagcaggaattagaagaaatggccaataggattgtcactttaaccagggtgtttaacagccgggaaggggcaacaaaagctcaggatacgttgccaaaacgtttcttttcggaaccgatcaatgaaggcaaaaatagtatttccgaggaagaactatcttatatggtaaatgagtactaccgtttgcggggatgggatgaccaaggatttccaacctcagagccatgtttcttttaaacctacctttaaaattgtttgattaaatggtaaataacggagagaagtttcttgactaaaagctacaggtttttccaagaaattgtgttttttattaaaaagttgcaatctttttaataatttttttttgtttttatctatttcttcttgtttgcagagggaaagaattgttaattctgccggagccgttagtaagccaagaaaacgaagttgtcgggatggtgcaagcttataaatccggtatgggtatgagtcagcaagatagtaacccgaaaagttaaaaataggaactggcccattggcattttcgggtaaaatggatttaatactggccaacaagtgttgtaccgaagaggtagtagtaaaactaaaagttggagataattcactgacttctacggagttttgcacctgaaaaagtttaaaggcttggccaactttaaaaagagctaaagcgtaatggtagccaaacagcacggcagcaccccgggctatttggtacaaaggagcaagctcggaaactttaccgcaagtttgcggtaaaaaattatcggttacacaaaccgcttcattttctacccaaaatatcccgggagaatacggaataaagaattcccttatttgttgaagataagggttaatggtagcgataaaagcagcagccatcagtaaggctttttctctttcccgaaagcccaaatgcggataattttgcgattttaaaattactgcaggagtgaattttgtaataacgcgtaaagctttattttctttttctggataaaccatagcaaaaggtgaaataagggaaaccacttgagcttttttaatttgctcttccctggcttttaaggtcctaataagcttttcgggggttacttgcaaaatttctacttttttttgaatgcctctgggagccgaaaaagaagtattgaaatgttctggaacaagacgtaaatgaaaaattggtttcaggttactctgattttctaaagaaaagggaggagtaaggtaaattttgtggacatcctgctttgataatcccaagtgggtaaggcagttttgtaattcaactaaaaagctttgcgcggagaactttccttcatataaatggtgcctgcccgctccagcaataagagtcccggattgaccattgaaaagtactcccaatacaattttcacgaaaatacctccttgttgcggtagtggtttggatatagcctttccaagggcaggtaggtagtgcggtagccgaagcattgtggtcccactacatctaaagcttttttgattctaagccttagcggggccggaaggcccaggagtgctaaacgctgtccttcataaatttcgttgttatttaccggcttaagttcgttcaaatcaattgctgatattaaatcaggtacgcttgcagcaacattaccgtttttaaaggcgagcaaattttcgtattgaaaaagaagttgcagttcttcgcctttcggtgaagttaatgtagcagatttccattttgccaattcataggttgatattttttttacaattccctggaaaagctcaattacgggaccgtaaaaggagttagaagtaacttccaagagcatagtaattaactcccggtaattatcagcctgcaggaaacattctccaatttcgcgcgcaaaggtcaatgtgccaggaagcagaactcgctttaaaacggaaccggggtgaggaaagcctgcaaagtaaccaacgcctccctgctggccaattatctggcgagtatttagctctaaaagaaaagtatcttgtttatcaagaaaatagtgtaagtgataattgccatcaattagcactaaaggtgctgccgttaagttttcaaggtgataggtggtcatttgtagctcaggaaaggctcgacccatgctgtcgccgtcaacaaccggtaagccggtttgcagtgccgctaaaaggggataaaagatattaacacctgcaccttcaacaatggtgattcctttaaacttaaccccggtgtgtttttcaagctcttcaattatgatacccgcttctactcctgaaggtaggttttcttcacacaattccggcgaaccaaaaagaccggtcccgcaaaaaaaatcattttccggcaattcttcaagggataacaaaggaatactgcggttttgcagtgctttttgcagctcgattgctaaaaggtgactttttccgccaccgccggaaccaaggaaaatactaccgtaccagagcggttcgagccagtcacgggtaatttcctgcatattttcacctactttagacggtatttgttaagccagcgatagagagttgctaaactaacacccagttcttgagcaattaaccttttggcctgggtagaatggccgtattcggctaaaagaatttctaaacgctcctttaattttctactttcaagatttgggaatccaggattaataactttaggttgcggtgtactgaccaatgaaccgtttagtaaatactttggtagaaaaggcggcgtaatgatgtcgccttcacaaagggacacggcgtaggcaactacgtttttcaactcccggacatttcctggccaatgataatttttaagaatctgtacggcttcaggactaaaaattttaaaaggtttattttgctccagacaaatattttttaaataaaagtccaaaagcaaaggtatgtcatctcgccgttcgcgtagcggtggtatatgaaccgggaatacatttagacggaagaagagatcttccctgaaaagttttgcatcaattaattcttgtaaatttttattcgttgccgcaataatgcggatatcgactggataggaaacagtagctccaattctttctacccgcctttcttccaaaacccggagaagttttgcctgtaattgaatcggcatatcgccaatttcatcaaggaagattgttccaccattggcaagctcaaatttgccgggcttgccgccccgacgggcaccagtaaaagaaccatcttcataaccgaatagttcgctttccagaaggttttcgggaattgctgcgcagtttatggcaataaaaggccgatctttccgtggacttaagtaatggatataacgagcaaaaagttctttacccgtaccgctttctccctggagcaggaccgtgttgttagttattgcaatttgcctgacaagttttttgatttctaaaaaacgggggtttttgccgggaataataaaaatagagtccttggaaaagtacgagtcggtttcttccggttggattggttctgttttccaagccaatattcccgccatcttgccgttttttgtaaatgcacggtagtaaaagtttccttccgtcgtttcgatcaaaccctctggttctccagcctggtttaattttttccaaaggtcaaaagtagaaattgaaataggagaattactttggcttacgattacttgacctttcctgtcaaaaagaaaaatatttgtgtccaactggcttgccaggaattgcaaagcatttttgaccaatgaattgtcaacttcttgctctaaggcttgcaaattttctaaaacaatcaaaagaaatttaagaagcaaagcaggcgttatattcgcgttgttttcacgttttttggggaatgctacccaaaaaccttcatctttaagattaaaggttaggattaaatcgtatgggcaagtagctgcttccgggcaagttggtgtacagggtgttgacaaaacacgataaccaacctgtggacgtggtattaaagaaaggcatttttttggaagatcggtaacaagtccgaaaatttctttaagtgcttcagtaaagtcttttctcatcattttttatcaccgctatataaaatgagaaaaattaataaaaaataagaatacttaagaaattgtaagaaatatcaggtatatttttattttacaatcaaaaaaggtctatgacaaggatagtttttcggggaaaataacgaatttataacctgaaagaccggtaaaattgttggcataaaacttgctaaaaaattaaaccagtaatatttaaaaaataaatctacaagggaggatggcaagatggtaaaaggtgaagattatgccttagcaagaattcccatggaagaacggcggccgatgtgggaagttttcatgattcggtttggtgctgttgttactttatcgcagtttatgctgggagcagcgcttggatatggtttgaccctaaaagatgcgttatttgctacgatccttgggtcggtgctacttgaaattattagctttttaaatggggttgctggagcgtgggaaggtctttcaacctctcttttaacccggtgggccggttttgggaggttaggatcaagtttaattggattaattgtggggatttcatgtattggttggtttggaattcaaaatacgatctttgctcagggattaagtcaagcgtttggtggggcagtaagtaccaagattatgtcggtaattaccggaatattaattaccctgttagttgtatacggttataaaatgttaagctatacagctaacattgcggttccaggttttttagtggcagtgggtattgctacctatcatttattaagcaaatatgaccttaacacgctgctaacttcgccaccccctggtccagctttgaatttcggtgttgcagttactatggttgccgggggctttatggtgggcgcagtggttactcctgacctatcaagatacaaccgcaacgccaaagatgttttttggatgacgcttcttagtatttttgccggagaacttttaataacttttatagctgtgttaatgtcccatgcggtaaaaagtgctgatgtgataactattatgttaaatttaggtggctggatttcagctgctttagtaatattttccacgattaagattaatgatttgaacttatatgctgcatcgttaggaattgctaatttccttgatgctgtttttagagtgaaaataagtagagcagttttaacgattattataggcttattaggaactttgggttctgtcttgggaatactggataaatttgttaactttttagttatccttggtattgcagttccgccggtaggtgggattatggtggttgattactttattttaaaaagatatagaaaagagctggaagaaagccgtgcgtatgggcgtttgcccagagaagttgaagattggaatcccattgctattgttagtttagttttagcttttctagtgggttatttttacaaaggaggcttaaatcaagcattaaattcattaattgccggaatgattttctactttgttttaatgaaattatatatagctttctcacccgccaaaaatgcaaaatttattaaaaaatcagaggttggggaggtataatttatgaccaaaatcgatgtacaaatggttgaggacattgcagtaggtgcagctcttcttggaaccggaggagggggagacccttatgttggcaagcttatggctattcaggcattacaaaaaaatggaccagtagaacttattagtgttgatgatgtgccagatgatgccctggttgtccctgcggccatgatgggagcaccaacagttttggtggaaaaaataccgtcgggtaaagagatcttcaaggcttttgacagcctgcaaaattacttaggtaaagaaatctttgcggttattcccattgaagccggtgggcttaactcaatgattccgattactgtggcagcggaaaagaaactgccactggtggatgtagacggtatgggacgagcttttcccgaattacaaatggttactttccatttatatggtgtctcagccactcccatggtcttagccgatgaaaaggggaattcgttacttttaaatactatcaataacttctggaccgaaagtcttgcccgaaatgccactgtagttatgggtggctcggtaatgattgcaatttatcctatgtatggcagagatttgaaacaggcgggaattcggaaaatcgttacttactcggcaaaaatcggccgggcaatccgggaagcccgcaaaaatggcgaagatcccattgaagcgctcttaaaagcaaccggcggttttgccctctttaaaggaaaaatttccgatgtgcaaagacggactaccggtggttttgttcggggtgaagcccatattgacggaattgaccagtataaaggggaaagtatgataattgacttccaaaacgagaatttaattgcccggcggaacgggaaggttgtagctacagttcctgatttaatctgcatagtggatgcccatacagcagcgcctattactaccgaaggtttacgttatgggcaaagggtagtggtcatcggtattccctgcgatcccaagtggcggagtgaaaagggtattgcaaccgttggacctcgctactttggctacgatgttgattatgtacctgttgaagagctcattaaaggttaaaggaggtcggaaaaaatggaatatcggataggcattgatgttgggggtaccaatacggacgcggtactggttgatgaaaatatgaatttagttgaaagcatcaaagtaccaactacaaaagatgtttccaccggcatatatgaagcgttgcatcgggttttagaaaaaagtaaagttgaccggaaaaatattaaatatgctatgctcggtactacccatgctactaatgcgattgtggaacgcaaacgcctttgcaaaactgcaattattcgtattggccgtccggcaacggaagcgattgtccccttagtggcatggccaaaggatttagttgaggcggtaggaaatcattactatttaattgccggtggtcatgaatttgatggccgggaaatcagtcccctggatgaagaagaattaagaaaaattgcccgggaaataaagggcaaagtggaaagcgttgcggtggtttcggttttttcaccggtaaacaaccagcatgaactaagggcccgggaaatactgcaagaagtgcttggcgatattccaatttcgctatctcatgaaattggttcaattggtcttttagaaagggaaaatgctactgttttaaatgctgctttggttgaagtcgctcggactacagccagtggatttaaagaagcattagcgcgggaaggagttaccgatgccaaagtatttctttgccagaacgatggtactttaatgtcaattgattatgcgatgcggtatcccattttaaccattgcctgcggacctaccaacagtatccggggtgctgcctttttaagtaacttagaaaatgctttggtgcttgatgtgggtgggactaccagtgatatcggtatcatcgctcaaggctttcccagggaatcttcaattgcagtagaaattggaggagtaagaacaaacttcaggatgcccgacctgatttccattggccttgggggtggcacgattattcgggaagaaaacggtgaggtgaaaattggacccgatagcgttggctaccggataaccgaagaagcagtagttttcggcggtaagaccgttacagctaccgatatagccgtgcgcctgggattggcagaggttggtgataaagaaaaagtaaaggatttaccgttagaatttgctcaaaaagcctaccagaaaatgcaggaattggttgaagaagcgattgataaaataaaaaccagcaaagatcctcaaccgctcattcttgtagggggaggcagcataattgtaagcgataaaattaacggcgtaagtcaggttgtgcgtccgcaaaattttggtgtagccaatgccctgggggcagctattgctcaggttagcggtgaagtggaccggatttattcattaagcgaaatgagcagggatgaggctttaaataatgctaaacagctggcaataaatgaggctattaaagctggagctaatccggattccgtgaacattgttcatgtagaagatattccgcttgcctatctgcccggaaatgcggtgagaatccgggtaaaggctgccgggaatttactttaaattaatataaacggggggatttttaatgaaaattaaggtaataatgccgattacttcagatgtttttaatgaggaaatcagggaagagtttaaacattatgttggaccgcatgacagctttgatgtggaaaacttagattatggcccggcatccattgagagtgaatttgatgaagctatggccataccggatattttaaataaggttaaaaaggcccaggaagatggctttgatggtgttattatcgattgttttggcgatcccggcgttaatgcggccagggaattggtagatattccggtttgcggtggctttgagccggcaatgcaaattgccttaggccttgggaaaaacataggcattgttacagtattacccaatgttgtttccatgcttcaagatttaatagccaaaatgggaatagagaaacgggtaaaatcaatccgttatgttaatattccggttctggatttgggagataaaaagaagttagaagacgctctatttaatcagagcttagaagcaataaaaaacgaccatgtccaggtggtggtattgggctgtacaggaatgatgggtatggctcataatttaatgaagcggctaaaagaggctggctatgatgttccagtagtagatccagccttttcagcggcgatgatggtaaaaaattatgtgtacatgggattaaagcacagcaggttaacgtatatgacacctccggttaagccctataagtggtgggagaagtaaaaaatttaaccccttttaagtagattaatagtctacttaaaaggggtttttatttatgtttataagtctataaaatttgcaaactaaagttcatacttatccgctgttaattttggtaaagttatagtaaaataaagaagccggtaagatcaacgctggaggcaataaaaatattatgacaacggttacagcagcaataataatacacaaggggaaagtcttaataacccgccgaaaacttaatgataaatacctgccgggaaaatgggaatttcccgggggaaaagttgaacagggtgagacgcccgaagattgtcttgttcgggaaataaaagaagagttggaccttaacatcaagattacccaattttttggtgaatcgatttatgagtaccctttttttaaaataaaattattggcttttttagcccagccagtttcagggaaaataaagctaaacgatcatgctgaagcgcgctgggttgaaattaaggatttaaatttttatgattttgcgccggcagacttgccttttgtggaaaagttattgaaattaacaacttaagtcctgcctggttttcagcgttttatgtataaagttttgcttattgacagtaaaacctaaaagatagtaaaattaagttcagagttaatggcaatttatagaaaattcttaaaatggaggcgggagcgtgaaacttttaatcatgggccctccgggggctggaaaaggaacccaggcggaaaaaattgttaaagagtttggtattacccatatttccaccggcgatatgttccgggctgctttaaaaaatcaaacgcccctgggattaaaagcaaaagaatatatggataaaggtgagctggtacccgatgaaatcgtaattgctatggtggaagaaagaatatcggcaccggactgcgcaaaaggctttcttttggacggttttccccggaccataccacaggcggaagctctggataaaaagcttgccgaaatgggaataaccttagatggtgtgatcaatattgaagttccgcgggaagaattaattgaaaggttaactgggagaagggtctgtcgccagtgcggagcaacctaccatgtgaaattcaatccgccaaaagttgaaggagtttgcgatgcttgtggcggagaattataccaaagaagcgatgattctttagaaacagtaagcaaccgtttggatgtctatgaagcgcagaccgcacctttaaaagattattatgccaaaaccggtttgttgaaaaatattgatggtacaaaatctattgaagaagtattcgcttcaattaaaaatgctctccaaaagtaaactctcccttttggggagagtttttttaaaggaaggtaaagtatgccttacagtaaaattgccaacttctacgatcttttgttaagcggagttcccggcgattactgggtccaattaattgaagatttactaaaacgctggaattatgaagtgaaaagtattgcggaattaggctgtggtaccggtgtaattttagaaaagctttcccaaaaaggttataaattatatggagtggatattagccctgaaatgcttgccgttgcccacaacaagaaaataggaaatacaaaattattttgccaagatatcgtaaatttagaacttccggaaaaagttgatctaatctttgcttttcatgattgccttaattatataaatacaacggacgatttatatcagtgcttttctcaagtaaaaaataacttaaacgaacagggcttattttactttgacctaaatcgtttagaatggcttttggatttagaaaatttacctggcgaacttcatttagataacttagtactaaattggaccggcaaatttaacaataataaattttttattaaacttagaatttataaccaaaataccggtgaagtttcctacgagcagcacgagctttccctcttttcgccggaggaagttttaaaaatgcttgcggacttaaatttttcggttttatcggtaaaccatacacctaccaggagtttttatttagctgtaaaaggaggaagtagtagtgaatgttgatatagcttatataggtggatcaagtaccttgggaataggatttccggaaaagtttctaccccctgatgttaaatttataaaagaagaaacttttacaacaccttatggtccatctcccaaaatatatttcttagaaatcggtacaaagaaagtagttcatgtaaaaatgcacggctggcgtcccggggtttctcgaagagatgcctctctccaggtattctgggtttttcaacagttgggagtaaacaaaatattttctgaaggcggggtaggggctgtaaatcatttgttagaattaagggattacgttattcctaccgattaccttgattttaccatgcgtaaagatgtccatctaacttctaattaccttttaattatgagaaaacctacctgcccggaaataaatcgcgcattatttgaaagtgctaaaactcatgccaaaggcagagtttttcagcgcggaatttatgcttgtaccgatggtcgccactttgaaagcgttgcggaagttgcctttttgaaaaatgccggagcagatgtaataggtcagagtatggtcccggaagtttatcttgcccgggaaattggtgcctgctacggccgaatcgatttggtagttaattatgccgaaggaattattaaagagtgggaacacgaggaattaaaagatatttattataatgatgctcttacaaatttgcaaatagttaccgaggcaattttaaattttaacccgcaaaatacctgcgaatgccaggattttcgcaaggaaacattattaaaacttgaatgaaatttccatttccttgcaggcaggtaattttttatcgtcgtcgaattttataaacaagcttcgaaagcttgttatttttttaaggagaggtttacgatgggaataaccatcaaggaagtttccaggatatcgggagtatttggccaacaaggagaagaaaaagtagccgaagtactaaaagagcacctgcctgatggttataaaattataaattcttaccgtttaaattatcaaggtgacagctgggatattgaccatattgtcattggccccaatggtatttttgttattgaaaccaaaaacatgcggggccgggtttttggtggcgccatgggcaactggtggcaggaaaagtgggcaggagggcaaaaagaaaaaattaagattggcaatcctgccgctcaggtaaaccattatgccaaacttgtcaaagagtttttacggctttatttccctgaggaagaaaccagaatcttggtttaccctgtagttgtctttgctcacgaagaagctgacttttctaagcttcgttttacccgtcctggcagaattggtaaaaccaaaatccttagtttatatgaacttccggcatttattttaagcagggaagaggtttcttacgattcagattttattgataaagcgataaatttcttaattcccgaagatgaacgggaaaaaaccggtatgtttaaaaccggtctttattaccaaaaccttcaagaacagttttcccggcgctatcggttagaagatctgatcggcgagggaaatttcagcaaggtttactgggcatacgataataagctggatcgggaagtagcggttaaagaaattaatttaacagatctaccgggggatatcaaagataaaatctataatgaagcccagttaatggcaaaaattaatcatgaaaatatcgtgaaactttatgataccttttattttgatgacaaaatatatctgataattgaattggtgcaggggaaaaccttagttgaatatcttgaagaaaagggcggaatgctttccgttaagaaagctgtaaatataatgattcaaattgccaaagccctttcttatattcaccagcacaacattattcaccgggatttaaaaccggaaaatatcttaatttctaccgacgatattgtaaaaataacagattttggtatagctcaactaaacgaagaagaaaaagaagaaggctttatcttgggtactccggtagttatggctccggaacaaatattaaaaacgggtattgaccagcgaacagatatttttgctttgggatgtattttttactatttattaaccggtcattatccgttttctggaacaaatttttccgaattaagttataacatactccattttgatcctgaacctattcggacttacaatagtcattgtagtttagaaattgaaaaaattattttaaaatgcttagaaaaaaatcccgaaaaccgttatcaaaaggttagtgaactacttcaggacttgattaaatatcaagagcaaaaaaaccttggtttattttttaataagaaaacttttctaaaaatagctttggtagttttaggcattgcttttttgtatctttttaccttaggtacaagcatgcaaaatcaaggtagtgctcctatatccttaaacgaaattttaaataaagagcaaattacccttaccaatgataatttcaatcaagtttttgccaataattacctggcaggagctaaagttaaaataacaggaaggattcttgatataattggcgcccaaaacggtcgcaccttgtgttattttttattagaaccggcttcgttaaaggataataaactaacaatagccttaaatcttgatcccttttccatttttaatggtactaaatattaccaattagaaggctttttagcttattctcctttagtcgaaaacggtgctgccaaaccggtggttattgtcgaaagatataaacctcttgagccctggcatctttttgaccctccaattaaaacggtagaagttaagcaaaccttaaaacgaaaagataaagaaattatctttgaaaaaattgaatttggtaaaaacgaaaccagactctttattacattaagaaatctttccaaccatccggtgaattttaatttattagaacccagagccagtcaaaaagatcgcttttacgtagaagcgttgtatcaaaaccgggattatccaaaactaaaagaccaattaggacctaaagaaattgtcaggggaattatcgtgctggaaaaaatggattaccagattaaagaggcagtattttttctcggcctgactatggctggagaagaaccatatatttttcatgtgaggtggggagatgaaaatactgggaattagtttttccgccagggataagggtaataccgacatcctggtcattacggcgcttcggggggcagcgtcggcaggtgcatctaccgaatttcttaaagccaaagatttaaacatcgagtactgccggggatgtttaagttgcatttacaaaggaaaatgtccgatagacgatgacctttataagtttattgaaaccgtcaaaagcgctaatggcatagtagctggagctccaacctatctttttggtcctaccggaaaagtaaaaacaatgattgaccgctccctgaccatttctccttttttagaagaaatggaccctgaaaaaaggctgggaataaccatcagcgttgccggcaatcctttatggaatcctatgggcagtgaaatcttaaatcaatttcttttaagttacggttttggtctttatgattttcttgccggttatgctcccggaccgggtgaagtcttattaaatgatgaattattggaaaacgcctaccggctcggtaaagagctggttttagccttaagaaaagaaatagagcccccgaaagccaaggaaaatcagtgtccttactgtaaaagtcggttgattaaatttgaagattcgaaaatttactgtgccctttgtctggctccggcagaacttcatgacggtaagttagtttttgctgaaaattatgaacccttttggaccagaaatcatcgcataaatcatattaacgattggatcataccttcaagggatcgttttttaaccaaaattaaagatataaaagaaaaagcaaaacacttcaatctttaaaaaacagaaaaacctcgctcctgcgaggtttttttttaatggcaggggagacaggactcgaacccgcagccctcggttttggagaccgatgctctaccaattgagctactcccctttatcaattgcaagattattataagaaaaaaaaataacatcgtcaagaagaagttttcaggtagaaatttattcctatttgttatacgattatagtgtaataaataaaatatattataaaacatttttttggaggtaaaaaaatgaaaattggcgttatttgcggcgggctttcttccgaaagagaagtttctctacgtaccggcgacgcgatttttagagctttattaaaaaagggatacaacgttgtaaaaatcgatatggacagaaatattgccgaaacattaaaaaaggaaaatatcgattttgcctttattgcccttcacgggaagtacggggaagacggagccatccaggggctacttgaaattatggatatcccctatactggctccggaatacttgccagtagtttagcaattgataaaataatgacaaagaaaattttaaaagccgagggaattccgacaccaaactatattgcttttagctttgatgaaaaccccaattttgaagctatcagttctgaaatactgcaaacattgaaacttcccgtggtaataaaagctccccgcgaaggttcaactattggcattgagtttgtttttagcaaacaagagctaccgaaagctattaaaaaagttttagaaatagataaacagcttttggttgaagaatttattgaaggggtagaagttaccgcttcagtattgggcaattctaatcccgttgttttacccttaattgagatcgtcagcaagactcgtttttacgattacgaagctaaatataccccaggattaagtgaacatatcatacctccaagaatagctccggaattaagtcaaaaagctattgaatacgcccggaaaacgtataaagctttaggttgccgcggatttgcgcgagtggattttatgattgatgtaagaaaaaatgaagcctatgtcttggaagtaaatactattccgggaatgaccgccaccagtttatttcccgacgcagcaaaagctcagggaataagctttgaggacctggtggaaaaaatacttatgctcggtttagaggggaggcaaaaataaaaatagcatgaataaattatttaaaataatctcggaaattgacaggctcggatataaagcttactctcgccttaaaggtagttacacttttccgcaattttcgttaagttttcttaaaattcaaggagacccctttgcacctccaagtattgtaagaataactttaaaagaagaacagcacaaatacccgaaacagtatttaaaaaaggaactcgaagttccgttgggcgattttattttagaacgcttctctaaaggattatcccaactacccaaaatccacggttctggaaatagcggagtaattttcgttaataccaacggccagcagcttttaaaacgagcaagtttcaaccttgatggaactgctatcgaattaaatttttatttcggtttacctgctaacggcagaaaaatcaacggacaggcattaatccaaatgcttgaagggcttaaagatgttgtccagaactttctagtatttaaaccagcttatgcagaaagtcttaaaaaacaaataaatttgtatcaggatcaggaattcctccgttcttttctccagaaaaacaattacattgcctttattgctgacgggtctatattgccccgggcttcgggacaatcggaaaaaccattaaaaaacgctgttccctttaaatctccggaaagcttacgcattaccgtagatttacctaattccggaccaatttctggcctggctattcccaaaggtgttacggtgataatcggtggtggttttcatggcaaatcaacccttttaaaggcactggaaaaaggtatatataaccaccgccttggcgatggcagggaatttgtcattaccgataatactgcggtaaaagttagggcagaagacggcaggataattaataacgtagatatttccccctttatcaacaaccttccccaggggatagatactaaatgtttttcaaccttaaatgccagcggaagtacatcccaagctgccaatgtaatggaagccattgaagcgggagctaaagtattattatttgacgaggatgttagcgcaaccaattttcttttaagagacaagctcatggaaaagttagttgttaaagaacccatcacgccgtttttaaaaatgtgtagaaatctttataaggatttagatgtttcttcaattctggtagttggcagtctttcggattatcttaaaattgccgatcgcgtaattttaatggaagaatatataccacacgacgtaactgccagggttcactccattaccggttttgactcaaatacgacagatataactctctccgttaggtcgcggaaaatcaaaaaatggaataaatctttttctaaaattaaggctaaagaccagtttactctttatttaaataaagatttatacataaaccttcgctatcttgaacagctttgtgattacggacaagctaactttttagcaaaatttattatgtatttaagcgaaaagaaaataaccggagaattgagagatatagtttataacttttggcaggaaattaactcccagggttttaaaatacttggggtagagccaaatctggccctgccgagatggcaagaaatggcttttattataaatagaatccccgatatttttattacatattaaggagagtgaaagagatggagttcacgtgtataatttgcgggaaaaaaattaccatagatttaattgtcgatgaagacgatgacctggtggttaagccttcaaatttgcagatctgcgaactttgcaaaaaaaagttaaaaaaagaagcggaagatagcagtaaaccggtaaaacccataggataattacaaagaaggagggatacgaaatggctgtgggtattttaaccggtggtggtgattgcccgggcttaaatgcagtaattcgggctttagtgaaaactcttcaacaaaagcttcccgaagagaaaataatcggctttttagatggttttcgcggggcaattgaaaaccgaagtgtgcctctaacaacgaaagacgtggtaggtttactccctaaaggcggaacgattttgggcacttccaaccgggataatccttttaaatttcccgtatctgttaacggcaccttagaatttcacgatgttagcgatactgtaatcgaaaatttacataaaaacaatattgaggtgttattcgtcattgggggtgatggttctctttctattgcccacgaactctcccaaaagggtgtaaaggttataggaatcccaaaaactatagataatgacctggatgctaccgattttacctttggctttgacagtgcggtaaggaccgcaaccaaagctcttgatatgcttcacaccactgctgaatcccaccaccggatcatggtattggaggttatgggacggtatgccggctggattgccctatattcgggactggccggaggtgcagatgttattttaattcccgaaattccctttaactgggatgccgtttgccgaaaaattcagcaaagaaaagccgaaggaaagcatttttccatagttgtagttgctgaaggagcctatcccgaaggtggggaaagggtaattgcaagatatgttaaggaaagtaccgatccggcccgtttggggggaattggccaggtagtagctgaccatttaagccgctgtacgggcttggaaagcagggtaacggttttaggtcacctgcaaaggggtggaggtcctacaccctttgaccgcatcctggcgactcgctttggggttgctgcagtaaatacatggcttcagggtaattataatgtcatggttgcctttttagggggaagggtaactacggtgcctttaagcgaaggaataaaaaaattaaaattagtccccgttgattcagaattaattgtaaccgctaaagcaataggtataagttttggagatgaatgattgatatgtaaataaatgtttactatgcgcacacatttatttacagttttaagttctatttttgctcttttagccctaattttaaaatggcattaattttgctaaaagttttaattgtaagaaatttttttaaaaattatagggaggggatttatatggattttcgtttatccgaagaacacgaattattacgacaaacggtaagagattttgccgaaaaagaagtagcaccttcagcagccgaaagggacgaacaagaaagatttgatcgggaaatctttaagaaaatggccgaattgggattaacaggcattccctggccggaagaatacggtggggccggcatggattacattgcttatgccatagcagtggaagaactttcccgggtttgcgcctccacgggagtaacgttatccgcccatgtctctttaggtagtttccccatttataaatacggtacggaagaacaaaagcaaaaatatttaaaaccactggctttgggagaaaaacttggtgcttttggtctcaccgagccttctgccggtagcgatgccggttccctaaaaactactgctgtccgggatggcgattattacattttaaacgggtcaaaaattttcataacgaatggtggggaagcggaaatctatgtagtttttgctaccgtcgataaatctaaaggacacagaggaatttccgcttttattgttgaaaaagggaccccgggcttttctttcggtaagaaagaaaagaagttaggcattcgttcctctccaacggtggagttagtatttgaaaactgcagaattcccaaagaaaatcttttaggagaggaaggtcaggggtttaaaattgccttatctactttagatggcggacgcatcggtattgctgctcaggctgtaggtattgcccagggagcttatgaagctgctgtaaaatatgccaaggaaagaacccagttcggaaagcccatagctgaatttcaaggagtaagttttgttttagcggatatggcaactaaaatccaggcggcaaggttgttagtttatcatgctgcctggcttgaatcaaacaatctgccctatggtaaggcagcggcaatggctaaactttttgcttcggaaacggcaatggaagtaactacaaaagccgtgcaaattttcggaggctatggttatacccgtgaatatcctgtagaacgaatgatgagagatgctaaaatcaccgaaatttatgaaggtaccagtgaagtacaaagaatagttatttcttcgtatatcttaaaggagttttaattggtataataatcctgtataagactaaagcagaggaggagcctaatgccagcaacaccttcagcagaataccaaaaaaaactggtagatgtagaccacgccctttctttgataaaagataacgataatattgtggtttcccttggtgcagcagaaccattacttcttttggaaggtttaggtaaaaaagctttggaattaaaaggagttaaagtttaccaaatactgcccgtccattctccatcttacttaaaaccagaattgagcgataacataaggcacatatcatttttcgctggcaaaccggtccgggagttaatccatcaggggtatgccgaggcaattccctgtaactttcatgatgttccccgaattattcaggattatttagatgtcgatgtttttatgacaacggtttcgcccatggatgaacatggtttttttagcctgggaacatcggtggattattcgctggccgctcttaaaaaagccaaaaaagtaatagttgaagtaaatccgaatatgccaaggactctgggacaaggaatagtgcatatttccgaaatagattttttaattgaaagcaagcgcgagcttcctgaacttccttcggaagatctcaaaccggaagattaccggataggtgagtttattgctgaactggtggaagatgagtcaactctgcagttgggaattggtgctatacccaacgcagttgcgaaactcttattaaacaaacgcgacttgggcattcataccgagatgattactgacagcatggtcgatttagtagaagcgggtgtggttacaggacgggctaaaacacttcatccctataaaataattggtacctttgcctttggttccaaaaaactttataagtttttaaacaataacccaatggttgaaatgcaccctgtttcgtataccaataatccgtgggtgattggtcaaaacaaaaaaatggtttccatcaatacaacaatagaaattgatttatgggggcaatgtgcatccgaaagtataggcacaaaaatttacagcggtagcggcggtcaggcagactttgcccgtggggttttgtattctcccgggggtaaaggtataattgccctttattctacagcaaaagacggacagatttccaaaattgttcccacattaaaaccgggagctatagtcaccaactcaaaaaacgatgttgattatgttgttacggaatttggtgtagccaaacttcggggaaagacctacagagaaagagctaaagccctaataaacatagcccatcccgatttcagagacgaacttaagtttcaagcaaaaaagttaaatatattgtaattaattctttcagggggggatttaactttatgaaattagtagtccttttaaagcaaacctttgacaccgaagccaagatagtattaaaggacgggaaaattgacgacagcggggtaaccttaatcattaacccctacgacgaatttgcggtagaagaagcactaaggatcaaggaaaaacttgggcagggggaggtagtggtagtatcggcggggagtgatagggctcaggaagcattacggcaggccttagccatgggagccgaccgggcggtactggtcaaaaccgacggcctgcagttagatgaaatggtggtagccgaagtactggcgaaagtgctgcagcaaatggaatacgaccttattttagccggctggcgggccattgacgacagttccgcccaggtaggggtacgggtagccgagattttaggcttaccccaaattaaccttgtcaccaaattagaagtaggggaaggcaagattaccggccaccgggaaatcgaaggtggtaccgaagtggtagaagtgcctctaccggcccttgttaccgcccagcgggggttaaatgagccgcggtatccttccatgaaaggcatcatgcaggccaagaaaaaagagttaaaggtcataaacgccgcagacctgggggtaaatgccacgcccaaggtagagataaaagaaatctttcttcccaaaggcaagcaggcggggaaaatcttcaccgatgagccggcggtagcggtagccaagttagtcaaagccttacgggaagaagccaaggtaatatagggggtggagctaatgggtaaagtatgggtagtagcagagcaaagggaaggtaagttaaagaaagtaacctttgagatggtaactttggcccggcaaatagggggagaggttgaaggggtagtaatcggaaaagacgtaaaaggcctggcttctgaacttggggaatacggagtagggaaagtatatgtagccgaccatccggatttagagcagtacaccaccgccaaatacacccgggtactggcggaattaatcaataaagaaaagccggaagtagtgttaattgccaactccgctcaggggagggactttgcaccgcggacagcccagcgggtaggagcgggacaggtaagcgacatcaccggttacgaagaaggagtctttgtccggcccatttacgccgggaaagcttataccaaagtgggggccaccagccatccgttaatagtaacggtacggcccaacgtattttcggcagcggaaaagacaggcgggcaagctgcaattgaagaagtggcggtcagctttatgccggaagatttaaaagccatagtaaaggaagtagtcaagcaggtatcgggacgtcccgaattaaccgaagcggatatcatagtatcgggtggtcgggggatgaaaggtccggagaacttcaagctgttggaagatttggcggacgttttaggggcagcggtaggggcctcccgggcagcggtagatgccggctggcgggagcaccggtaccaggtaggccagactggtaagaccgtatcccccagtttgtatatcgccgtaggtatttccggggcaattcagcacttagccgggatgggcagctccaaggtaatagtagccatcaacaaagacccggaagctaacatctttaaagttgccgattacggtattgttggcgatttgtttgaaatagttccgcttttaaccgaagagtttaaaaagcttttaaaatcgtaacttaaatgtaagtgaaatgtagagaaatggaagaggagattggctttaattatacttcttggggtgtagaccaacaactacacccccatttttcaactatgaaaaatgttttagagggggagaatggtaaatggaagaagttgtaatagttagtgccgttagaactcccattggcagttttttgggtagccttgcccaaactccggcagtggatttgggagcgcttgttattaaagaaagtctaaaccgcattaaccttgcgccccggtttgtcgatgaggttatcatgggaaacgttttgcaggcaggattaggccagaacccagcccggcaggcagctataaaagcaggaataccccaggaagtacctgcttttacagtaaacaaagtttgcggttcaggattaaaatccgtcggactggcttatcaggcaatagcaacaggtgatgccgatatcgttgtcgccgggggaatggaaaacatgtctttagcaccttacgtcttgcccaaagccaggacaggttaccgcatggggcatgataccctgatagattccatgattaaagatggcttatggtgtgcttttaccgatgtgcatatgggtattaccgcggaaaatatagccgaaaaatacaatataacccgcgaagaacaggataaatttgccctgcaaagtcaggaaagagctataaaagcaattgatgaaggaaagtttaaagaagaaatcgttcccgtaatcatcccccagaaaaaaggagaacccctggtattttccaccgatgaatttcccaaacgcggtacatccctggaaaaacttgccgctctaaaaccggccttcaaaaaagatggtaccgtaactgccggaaatgcctcgggaattaacgatggagctgctgcggttgtagttatgtcagcaaaaaaagctcaagagttaaatattaaacccttggctgttatccgcggttatgcagctgcgggagtagatcctgcctatatgggtttaggcccaatacctgccacccgcaaagcccttaaaaaagccaatttaaccgtttcggacttggggcttattgaagcaaacgaagcttttgccgcccaggctttagcggtaattaaagagctcgaattaaatccggaaataactaatgtcaacggtggtgccatagcgttaggtcaccccataggagcctcgggagctcgaatattggtaaccttattacatgagatgcaaaaacgtaatacaaaatacggtttagcaaccttgtgtatcggtggcggccaaggatttgctttagtagttgaaaaagtttaaaagccggaaattccggctttttttctttggtttaaagtggtaaaattttgggtaaagaaaaaggaggttataactatttttttagttagcgcttgtttagttggtttaaatacaaaatatgatggtactaacaatttaaatccccgggtactggagtttttaaaagataaattatttattcccatttgtcccgaacaattaggtggtttgccaacaccccgcttaccggcagaaattatttcgtatcccgaacttaaagtaatcaatatcaagggtgaagatgtaacaagtaactttttccggggagctcaggaaaccttaaaaattgctcaattttatgaaaataaattatccggtatcatccttaaagaaaaaagcccttcctgcggcgtaaattacatttacgatggaagttttcaaaaacggttaattccaggaatgggtgttaccgctcggcttctttttgagcatggttttaaactttttaccgaaaaaagtatagggagggaggcggatggaaatctatcgtggcaatatttttcgccccccgagtgaagcaaatagcgttattttacaagtaacggtgggatgcagccataataagtgtaccttttgcggaatgtataaagacaaggtttttcagataaggcctttaaaggaagttaaagaaattatcaacttttttaagctaaattatccctttgccgaaaaagtttttttagccgatggcgatgctttaagtgctcctaccgaatacctaatcgaagtattaaagatgttaaaaaacagctttccccggttaaaaaaaataagcagttacgcaggacctaaatcgcttttaactaaaagtgccgaagaactgcatttgcttcgagaacacgggatatcacttttgtacctcggtcttgaaagtggttcagatacggttttaaaaaaggtccaaaaaggattttctgccgaagagataatcaacgggtgtcaaaaagcaaaagaggcaaattttgaactttccataaccgtaatatccggattgggtggcaaagagctctggcaagaacatgccctatcttcggctgaggtcgtttccaaaataagtccccattttttagctaccctcacattaatgttagtacccggtacaaaactatacaaggatgcagaagaaaaccgctttcagctcctttcgagcaaagaaattttacaggaattaaaattgtttttacaaaatttaaacttatccaatacggtatttcgcagtaatcatgcttcaaactacttaccattaagaggagtacttaatcaagaccgcgctaaacttattaaaattattgatgaagctctcgaagaaaaaggaatttggccattgcgccccgaatatcttagaaggctataaaaaggagagttgtaatgataaaagcagtattttttgacttagatggtactttgttggacacttttgatctgatatatgaatcgtttaaacatgtttataaaaattttctaaataaagatatcaccagggaagagatttatccctatttcggcaaaccactcatttattcctttgaaaatttagatccggaaacaatcgaccaagtgatagctgcttaccgtgaatttaatttacagcatcacgatcaaatggtaaaaccttttccgggggcaaaagaaactttgaaaaaattaaaacaaaggggtaaaatacttgccgtcattacatcaaaagtaaaaagtactgctataagaggccttaagttatttaacctggaccgatatttcgatctcgtagttgctttggaggatactgaaaaacataaacccgaccctgctccggtgttatacgctctaaaattttttcaattaaagccagaacaatgtttaatggttggcgatagtcctcatgatatggtaagtgcccaaagagctggagttaaaactgctgcggtaaaatggagcgttttaccttgggaggatttggtaaaaacaaaaccgaattacattttaaattcttttgacgacttgttaaaaataaccggggtggagtaaactgtggcgataaatcccataaatcatttaagtcttttaaacattcttgattcaattcataatgctattgtagccatcgacgaagaaggaaaggttattatttttaataaagccagtgaaagagtttttaactatcctgcaaaaaaagctttgggaaaaaatataaatgaagtcttgccgtttagcgggcttaataaggtgctgaaaactggcgaatcccatattggtcgcaaatttaaaattggggataacttgtatgtagttaaccgaaccccactttattacaagggtaagattattggtgctattggggtagctcaggaaattaatgaactaaaaaacattgccgatgaattggaaaatgttttggctttaaaacaaactttagaaaccatcctcgaagcgggccaggaaggatacatggttctggatttagataaaacggtcacccacgccaataaagcaattgctgacctctttggcctaaagttaagcgatatcgtcaataaacctattaactccttaaccgcaaatcctttcttttgtgaattaccagaatccgccgacgatataaaaacagaagttgtagaaattaacggcaggcaagtggtagcttttaaatacccgatagtaaaagattacaaactttatggaggagtaatcaaagttatttttcaagaagtcagtgacttattagccttggctgaaaaggttaatcaattaaattccgaattatcgtattataaaaacgaattaactaaatatacgtcaaaacaatttaccgaaaataaaataatcggcaatcatccctctattgtacgcttaaaagaaataattaaaaagatagctccttataacaccaccgttttaatccggggggaaagtggaaccggaaaagaattagttgcccatgccttacacgtggagagcggaagaccgggtagctttataaaggttaactgcgccgcaattccggaaaatctcttcgaagcagagctttttggttatgtcgaaggagcgttcaccggagctaaaaaaggaggacaaatcggtaagtttgaattagcaaataatggtacaatatttttggatgaaataggggatatgcccttaactatgcaggctaaacttttaagggtactgcaggaaaaagaagttgaacggctgggagaccgaaagacaagaaaaattaacgttagggtaattgccgcaaccaatcaaaacttagaagaacttattaaaaagaagaaatttcgggaagatctttactaccggcttaatgtaatttcgttatacgtaccagctctaagggaaaggattgaagatttacctttattaataaaatatttcatagaaaaatttaataaagaatacggaaccaatgttacgggtatttctccggaagttatggatatatttatgaattattcctggccgggaaatatccgagaacttgaaaatgtcctggaaaggtgttttaatttagttgagggcaaagtcatcgaaaaaaagtatctaccaccgtatattctgggagaagaactaaaaaataaagaatttccattaggacaaagtcttacaaatttacttgaggcatatgaaaaagaattaattaaggcagctcttttaaaagctaaaggcaataaaagtaaagcggccaatcttttgggaatatcccgccaatggcttcacaaaagactaaaatattttaaccttttaccttaaaaaatttttggaaaggacgtaaaagacaatgttcagcgaaactgaaaaagaaacaacaaaaagtttttcctggaaaaatgaaataaaagaattcatttcagcagcaatctgggcagtaattttagcgtttatcattaaaacttttatctttcaactgacttacgttccaaccggttcaatgatacccacaattttaccaaacgaccgggtcgtagttttgaaattctggtataaaattaagcctatagagcggggacaaatagtggtttttgatcctccgaattcagcaaattcaccgccctttataaaaagagtaattgggcttccgggggaaacattggaaattaaaaataataccgtttacatcaacggtaaaccgttaaaggaaaattatttacctgcaaaaatggaaatggaaccctttggaccttttaaaattcccaaagatgcaatttttgttatgggtgataatcgccaacacagtgctgatagcaggtattttggtgcggtaccgataaaaaacataaaaggtcgggcagttttaacctactggccgcttaaccgggtaaaggtcttaagataaccagaaagtctggttatcttttttaaagctttttagtttacataatacttattatgggaagttattttttaaacaaaaaagtggactacaaagttagtccaccattaaagatattttttaagctcctcctcaatctctttaaaatccaggttatttagactgtccttatcactatcatttattttttgcataagaacattaccgcttctttgttttttacgaataaagtaatttacaaataaaccaccggctattaacccgataccgggcattatccaggctaaaaagttaaatcctttagcagttggcgccgccagccgttcctggccatctcttttaacgtagtaacttaagatttccgcctccgtctttccttcatttagcattttcttaacttcgttcctaatagtttcagcctgttgacactcgcattcatagattttttgtttaccacaaccacataaacagaccattttactggtaatttctttaaaaaggtttacatcatacgcaaaggctgtagtatttaacataatcatcaagcttaacataagtatcatgatgaaaaaattttttcttaaaaacattttttcacctccttaaatgattataccacattttgtagtatgtttgacaaaaaagaaaagcaacaaccaccgttgcctcattttttttctggtgccatatgaaactctcgaaaaaaaggcgtataatccaccttcatgtgataattaggagttggccagccaaattgctggcgctgagccaaacgaaaagccgctccgtgttttttcatttcaaaccctacactactgcaaagtttttccggctcaagagcttccagatataacaccttttcttctacagcactctttattaactcctcacccggtaaagaccttactaacagggctgaagtgccgctgaagttatctccaattgtcggagaagcccagtaatctcctacagcaatgtcggcaagttcactactccagtcgatacacatttcacaccggtcccttttgtaattgggcattaacatatgataaacataccggtgacggtcaatagtaatggttttatcactatgaagctttaccacaaaatgtcccggccattctcctccccggtactccaaattagctatttcttccatgtcatctacaccgcaccactccaccaaaatatgccgcgtaccctcgaaataaaactgagaagcacaaaacaaacctattgctaatttaattttccccgctatatccctcggtatatcataatactgcatcttacgcaccgcatgaatatggcagggaagcccaacaattcctacgcgctggcatcccgcctttacagcttcccggaagagcatattaacaggcactacggcgtattttgattgggctgcatctataatttcttttttgctttttgctaacttggcctcggtaagccaaggtttttctttattaaaaccagccacaatggcacagtcaattattcctttttctaatgcatacaccaagagcgccgttaccactcctccacttgcaccctttattcggataatttcttccccagcatacccaacatagcttccgcgatagaatcccaggtctgtcaaagtagggttacgattgctaccaaaaaaatgtttttcaaattccaaaagcggcacatcgcttcccgggcaaatgcgaaagcaaatcccgcactctgaacatttgtctctgcaaaccggcataggttcgccgtacacccgggtcatttcaagcgccccattagggcatactccaacacagctgccacaacccgtacataagcctcgccgaattactaaattttctaattggggaaatcccgttttcattccttttattttcccccactttttttaggaattgctataatattaccccattttgaaaactattcagttaagatttcctgtttttaaaatttcgttttgtaaattttttggaaataaagggattatttcatacacaataggctttaataccgcttgccacgcttccttttcttccggagttaaatcatgaatcttaatattttgatcatttcgaatacgggctaaatcttcagcattttgttctaatgctatttttctttgccaagcagtaacttcctttaaggtgtctaaaaggatttttcttgtttctttgtccaagctgttaaaataatccctgttcattaaaaccgcatatcctaagtaaccgtgattggaaacagttacatggctttgtagctggtaaaactttttggagtagagatttgatggggtattttcactaccatttacttttttattttctaaagctgcaaatacttcattaaaggagaggggcaccggaattgctcctaattttaaaaactgcttttttaaaatagggctgtccataatacgtatttttaaaccttgaaagtctttcaaattttctaaaggccggtcagcggtaagaattttaaacccattatcccagtaggccaacacttctatccctttttctcgcatgctttttcttaatagttctcctaccggcccatctgccaattgatgcacctgctctaaatcgttaaagaaaaacggaagatcaaaaaccccccagcgttcatctaatccagttaacttggaggtcgcaggggcaataatctggacatacccctttttcaatgcttccaactcttcgccatctttataaagagtgccattgggataaattttcatttctatccgtccaccacttcgttgataaatcagatcggcccacaggcgggcagcccgccctttgggcgaagcatcgcttaccacgtgagaaaaggttaaaactattttttctttgggactcgtctgttcaaaatcaattgcttttggcgcacatccctgcaatcccaagaaaagcaaacttaaaattaataataaacctcgcaccatctctcctccaaagtctttttttaaaattatactcttttaaatctacccttttaaagatttaaatgccgggaaatcccggcatctaatctttcattaagaccctgggaatgtacagggatatatccggccaaaccattagaagaatcataactaaaatcatgattacaataaacggtattaccccttttactacctcttccaatttttccttggccatattgctcaccacaaaaaggtttaagcccaccggtggtgtaatcattgccagctccatgtttaccgtcattactatagcaaactggattaggtcaatcccgagatgttttatcatcggcaacaaaatcggtagcgtaattaaagtaatggaaactgcttctaaaaaggttcccatgataaaaaacattaagtttgttgccagaaagaaagtaaacttggttaaattagcgtttttaatccattctccaacaatattgggaatttggttggtaacgataaacaagccaaaaaccatcgcagcagctataaccaagtagatcatagatacggtattaatagtatctaccaagattcctctaatatcttggagttttaactcgcggtagataaaaaccgaaacaaataaagcataaaaaagcgaaagcactgctgcttcggtcggggtaacaataccagagtaaatacttcccaggataaataccggtaaaaacattccgggcaaagccttaaccgttgcttttatccttgtcgcccagtccgctttttcagctcctttaaagtttccccttttagcataaattattgcacttaataccagaacccccgccaggaaaagccccggcaaaaggccgcccataaaaagcttaccgatactctcttccgcggtaattccataaattacgagggttacgctgggcggaattaaaattcccaaagtacccgctgccgcaataagtcccatactgtatcgtttgggatagccactttccaaaagtgccggcagcattattgagccaattgctgctgctgtagccggacttgatcccgaaattgccgcaaaaaaagcacaggccaagattgtaaccaccgacatcccgccgggcaaatgaccaatccaggcttttaaagcttcaattaaatacctggcaatcccgccccgggacataataaccccggcagccacaaatgccggtattgcgattaggggcggggaaagaagggaagcaaacatacgctgcacgataaaatataaggtaaactttccgcttaaatataaaataatgactgcagccgtacccaggcttatcgcaatcggtacgtttaaaagaaaaagcaagataaaaatcgcaaataacaataacgttagagttcctacatccattttacagccccacctcctttgattggatcaacttctgccaggtgtctttttttagcagtagaaatactttttcaacaaatcttaccaccatcataaagcctgatattggcaaaaccagggatacaatccaaagcggggtttgactgtctgccgaaccctggcctaaaactttgtaggtaactactaattttataccgtaaattaacattagaattgcaaaaaatgccccaactgaattggcaaaaatacttacaattcgctttccttttggtgaaagccggtcatacagtatatttactttaatatggtgatcatcacgcaatgcagtagcaaagccaatcatggcgccccacactattaaatacaccgaatattcgtctaaaagggctattggtttaccaaaaacgtaacgcaaaagcacatttacaaaaataagcgtaaggcctgagtataaaagtccgccacttaagtaatcctctaagccctcgtagatttttatccataacgatttttcccgcaaaacaattccctcctttgttagtaaaaagggcacatccgttgatgtgccctactcggcatttctcgcagcatccatgatctctttaccaataattgattcatattttttataaagcggttcaaaaactttaatgaaagcctcccggtcctgtggagttaaataataaaactcaagcttgccgctctttttaaggttttccatgcttttctggtttaactccgttgaaagcttaatttcatattcagtagcttcggccagagcttcttccaaagcttttttaatatcttcaggcaggctatcccagaaggtcttattggttaaaaccacataatccagccgtccatgacccgaaaccgtgagatatttttgcacttcagcatacttttgggtatcgatgttattaaaagtattttcctgtccgtctaccgttttgttttgcagggcagtataaacttctccaaaaggtatagtctgggagccggcgcctaaaagtttaaattgctcttccaaaacacctccggattgagttctaaatttaagccctttaaaatcttctggtcttctcaagggacgtttagaattggtaaaatgctttgccccgtttggccaccaggctagaccaatgatacctttatcctccaggctttttaaaagcttttgacctgcggggccctgataaaacttaagtgctgcttcttcgctcttaaacaaaaagggaatatcaacaatttgaaactgcggatttaaacctaccagtttggttaccgaaggtgcaataaattgaacgttatttgcgattaacgcttctaactcctccttatccccgaaaagctggctcgatggatatacttccacctttacttttccaccggttttttgctccgcaagctctttaaattttaatgccgcctgccccttgggagtagtttccgccactacgtgggaaaacttgataacaataggttcggttttcttttccccttcctgtttgcttccgcacgcaactaacgcaaataccaaaaacaggactaatacggcaataaaaatatttctgctaaactttaacaacaaagccacccccttaaaatgattttatatttttaatataagaatttttctaaatatttaaaatattttactcgtaaagttaattttgttctttttgttcagcgaagataataataatttaccggtctgccaatactaccatatcgtatttcctttccggcaagaccttccctttctaagtattccaggtatcttcgggccgtgacccgcgatattcctgctcttttggccacttccgctgctgccagcggttcccttgtttcttccaaaagagacaaaatcttttttaaagtaatatcattaagccccttcggaagctcacccccagcacttgatctggcaaaaagacggtcaatatcttcctgttgaacacttctcttccggcctatttttaaatatttatttttataggttaaaagtgcttttacaagccgctcttttttgaaaggcttgataatataatctaccacaccgtaccgcaataattcagctactatttctccttgctgagctgcagttatggccagcacatccaccgaaatattttgccggcgaatttcctttaacaatgttaaaccgtcaatatcgggaaggtaaatatccaggatgagaagttctggagagtggttttttaaaaagtttaaaagttcactaccgcttttaagagctgcaattatttcaaaaccttctacttcctttataaaattcttatttatctccaggaccatggggtcatcttcaacgataaccgttttaatcatttttctcacctcctactttgattaaaaaaacggttcctttggaagttgatctaattctaattttgccataaacatcctctaaatgcctttttacaatgtaaagtccataaccacgattttccccttttgtagaataccctggctcaaagattttatttttttcaacttttattcccggccctgtatcaagtacaagaagaaaaaatcttcttttattcgcctggattttaagataaaccttttttatttttcctgataccgccgcttccagggcattttccagaatgttgccggtaatctcaatgactttggtactgtcaagtttggcaggatatccttcaacaaaacttcgccgattaaccaaaaattctacctttaattccgatgccctggcggctttccccaaaataagcccggccagagccgggtccttaattttttttgttaaaaatgttgtaagcgcctgttgcgtgtccgtcaaacgaaaaattaggtccaacgcttcgtccaccctacccagttgaataagaccggcaatagaatgaagacggtttaagttttcatggttctgaacccttaatgcttcgacaaacttttttactccggtcaattcttccgctaatttttggacctcacttttttcccgaaagactgcaaccgcacctataaccttacccttaacctttaagggcaaccggctggaaattaactgcttgccgcctacaaaaatttcacgattatacaccggttgccccgttgccatcacttcaggaagcctgctttcaggggcaacttctccgatatttttacccaatacctcttcttgccggagatttaaaataacttgagccgccggatttaccagggtaatattccccatccgatcgatagccactattccttcgttaatggtatttaagagagcatcccgctgttccacaagactggcaatttcttccggttctaaccccagaatttccttttttatttttaccgctaaaaaacctgcccctattgctccaataaataaacccaaaagagttgctaagtatattccttcccggacactttttaaaagctcccaccaggtaggaagcagtattcccaccaccacaaccccaatttgctctgtaaaagattcatttttgacaggaacaaaagccctaaccgctatcccccttattccttttgcctcagaaatatattcgttatcggcaaaagccggcccttcatctcctccggaaaattttgagcctaccctttccggaagaggactggaatagcgtatacgattcatatccagtacaactatataatcaacattggtcgcccggcgtattctttcagctaccggttcaatctccttaaaaccttccggcctgcccaggtattttttaactgtagggttttccgctaccgtcctaccaattgccagggcccgcttgccgagttccttttttaattccaccgctgctttataggtaagaaagaatcctgaaaaaaaaaaccgaaaaagctgcaaccgtaaaagctaataaggttatttttgttgcaagtttaaatctcctcattattcttccctcaatattttttaatttagagtttaaaattcgttagaaaatttaaaattccttgtgactataagattcacttagattaacgcataaaaaagcgacccctttaggagccgcttttttccaaaagttcaagggtatgtttaaagacatcatccgggcttatcttaattcttgctattccttcctctaaagccgcttttgccacttcgcgagcaactgttgatgcaactcttgcatcgaaagctttgggtaaaatataatcttcattaagctcattttcggcaaccaaagaacttatagcataacttgctgctattttcatcttttcggagatatctgtcgcccttacatccaatgcaccccggaaaactcccgggaatgccaaaacattatttacttgattggggaaatcggagcgaccggtagctacaatcctggcccccgctcttttcgcttcatcggggtagatttccggttctggattggccatagcaaagacaattgcatctttattcattgacttaaccatttcttccgttacttgttttgctttggaaagtccaataaaaacatctgctccctttaaagcatccttaagggttcctttaatattttcagggttagtgatttgggctaattcttctttgtatttattcattccttcttgacggccccggtaaataattcccttactatcacacattattaaattttttactccgcttgccataataagcttggaaactgcagtcgctgaagcccctgcaccattgaccactactttaatctttgaaatatctttattaactatttttaacgcatttattagagccgccagggtaacaatagcggttccatgctggtcatcatgaaaaatgggaatggatgtttctttctttaatcgctcttcgatgtaaaaacaattaggtgctgcgatatcttctaaattaatccctccaaaagtaggctctaaaagttttactacctcgacaattttatccggatctttggtatcaaggcaaattgggaaggcatcaaccccggcaaattctttaaagaggagtgccttaccttccattacaggcatggcggcataaggtccaatatctcctaatcctaaaactgcagtaccgtcggacactaccgccaccatattccagcggctggtatactcatatgacaaatccttattttcagcaattaacttacagggctctgcaactccaggggtataggctaaagataagtcttccgcagttttagcaggtactttcgactttacttcaatttttccgcgaaatttcttgtgtaattctaaagctttagctttaaaatctgccattttaaaacctcctttaatttaaattaaacagtaggctcaggagcttttattcctccccgagcaggcttttccttatttaaaggaattaagcgggctttaggtttgcggccggtgaaaaagaacgaccttttaaaaagctggatagccaaagcagggtcaacgcctttaggacaggcttcagcacatgcacccgccatatggcagcgccataaaccttttggattatcgacctgaacttttctttccttttccccaaaatcgcgattatcagcattatatctatatgcttgggccaaagcttgcggtccgggaaaatccggcgtagttcctaccgtagggcaagccgccagacaagcaccgcattttatacaataagcaaattgcaggtattcttcaagttctgccggtgtctgggaatattctccggtaggatttataaattcctgctcgttttcaggtattacatatggcttgacatttttatgtttttcaaaaagcggagttaaatccggaactaaatcttttatatttttataattaggcagtggagcaatctctattacgtcagtcccgagggataaagcttgagtttcacaggcaagtcgcggctttttattaatgtacatcgcgcaggaaccgcaaatacccattcggcacgaggctctaaaagccaacgtggcatcaatattttcttttatatagtaaagacaatctaaaactgtcatgccttcttttacatcgaaagtataatcttgaaaatacggttgtacatcttttgcaggatcatagcgccaaattttaaaccttaccttcaattccccctaccccccaatgtaagaatatattacaacataactacctaaaactaaagctaaaaagccaattatccctattaaaccattaataaatttaagattttgcggaaaatattccaaaagaatcgttcttaagccatacattccgtgatataaagcagctactaaaaggataagataactcaccagccaaaaggtatcctgtccccgggtttttacgttattgtaatccaaggggtcgtttacgcccaaaatattatcaagatgcatgtatcccagatgtattccaagaaacaccagtaaaattaaagcagctactatgaataaaaaccacaattttgattcactcaccaaaacccctcctttttaggccaaatatatatcataaacacttataacaattcctactaacgctaaaatcattaggaaatacattaaaggtcgctgttttaaagttgaatatttatagggatactcctgacgttcaggtttgccgataaagtaaccaaattcggtaagtataagccgtaaaccgtttaatccgtgaaaaacacctgccactactaccaggaattccccgaatttaaatattggactatcaacggttcccatagcctttgcccatgcatcgggacccccaagacgaaaagaagttaccacaatatgcagcaaaagatagataattagtccaagcccggaaatccggtgtaaagtatataaatatctttcaattccgaattttcccgcataaaagttacccttgatgcccaaacgattgtcatacatctaaaaacccctcctattagtactttctttccactggtttccaggtagtaatctttaccggcaggtattcaagccgtggcccctcaggagtataataagctaacgtgtgttttaaccagttttcatcatccctgttgggataatctctacgggcatgacctccgcgggattcttttctttccaaagctcctaaaacaataatttccgccaaagttaacatattttccatttccaggtatgaaactaagtcggtattgtaatatttactcttatcttccagtccgcaatccttaaaccgctgaattagctcccttaccttgttaagggctgcagttaaccccttttcatcccgatatactccaacgtttttatccatgatttcccttaactcttttcttattgtatataagctttctttatttggtttattaaatatttcgttaattctggcctcttccctcaagaccatttctgtcggtaattttggaaaagctttttgcttctttacgtactcatatgctttgcctccggttatacctccccataccagacattcagcagtagaatttgtacctaaacggttagctccatgaatagaaacacaggcaacttcaccggctgcatatacccctggcaccggagtttgtccatcaatgtcgacatgaatgccgcccattgaataatgggctacaggccgaaccggaagaggtttttcaatcggatcaattcccgcaaattttatggccacttcccggattagcggtaaacgttcattaattttttccctcccgaggtgggttaaatccagtaaaacgtaatccaaaccatcttcccgggtaaatcctctgcccgcttcaatttcctgcatttccgaacgggaaacaatatctctgggagctaattccatcattttttctgcatatttccccataaaacgctcccctaagttattaattaaataccctccctctccccgagcagcttcggtaattaaaattcccgaaggaacaagaccggtcggatgaaattgcacaaattccatgtcttttaacggcaaacctgcccggtaagctatcgccattccgtctccggtaacagtgtatgaatacgtggtgaaaccatagatgcggcaggcgccaccggtagctattattaaagctttggattgaaagactaaaaattctcccctggttaaatctattgcggtaaatcccctgtactccccatcttcaatcaatagagatgtaaccattacttcatcataacggtgaacgttggaaaagcgctgaagattatcatacattgtgtgaacttcaaaaaagcccgttttatccgccgcaaaaaccgctcgcggaaacgagtgaccgccaaatggtctttggtcaatttttccgttttcccggcgggcccaaggtattccccagtggtctaatttcaaaatttcttggggaattaattcgacaaaacgccaaaccgcatcttgatctgctaaaaaatcacttcctttaaccgtatcccaggcatgcaattccggactatccccttcgtcaatccggagagctgcaccggttccgccttcagcacaaaccgaatgaggtcttaaaagctgcgtcttactgacaagcgcaatatccaattctcccttggataaaaaagcagcctccaacgctgccctaagtccagcaagtccggagccaataattatcaaatcatgttttagaacgttcacatccatccccctcttttttgtaaatttttattctttccggaatttctccggacctacctcgtataaattttgtccccgagcatcaataaccacaattgcaggaaaatcaactacttctaagcggtaaatagcttcaggacctaaatccggataggccaccacttcacttttaacgattgtttttgaaagtaacgctccggctcccccaattgccgcaaagtatatagctttattgcggacaatcgcatcttgcacttccttatttcggagtcctttacctatcatcccttttaagccataatccaaaaggcgcggagtatatttatccatccgcccactggtggttggtccagcggaaccaataaccctgcctggttttgctggtgtaggacctacgtaataaattatttgcccttttaaattaacaggtaattcttcccccttttctaaaagttcatacaactttttgtgagcagcatcacgggcggtaaaaattacaccgttaattaaaacttcatcaccgatttgtaatttctcaataacctcttcgctcaaaggtgtagtaatcttaatcatgctctctcacctctataaaataacagtttcatgacgagcaacatgacaatttaagttaactgccacgggtaagcttgctatatgggttgggtaagtttcaatgtgaactgctaaagctgtaaccctgcctcctaatccctgaggcccaatccccaaattatttatcttttccaatagttctctttccagggagttgtaaaaggggtcgggattttgagtgccaacttcccgtaacaatgctttctttgctaataaggcagctttctcaaaagtacctccaattcccacacctacaattattggcggacaaggattagagcctgcttgacgaactgtatcaataacaaattgctttactccttcaactccatcagcaggctttaacatttttagctggctcatattttcacttccaccgcctttaggtgctaccgtaatttttaccctgtctcctggaacaatatcaatatgcaccactgctggagtattgtcaccagtatttacccggtttagaggatccttcacaattgattttctcaagtatccttcactatatccctctctaaccccttgattaattgcatcgtgcaaatccccccctaccaagtgtacgtcctggccaatttctaaaaatattaccgcagtaccggtatcctgacaaattggtaattcttcatctttggctatttgagcattttcaataactctctgtaatatttttttaccaacttcactttcctcattgttcgctgctacctttaaagcatttaaaatatcggtacttagttcctgatttgccttcactactaaagtttttacggcatttttaatttccttaacatctaaattacgcatctatccatccctccctatcggtactttaagcaattatgatgccaacgattttcaggcataaaaaaaacaaacatgcttctattttttaaaaattataacttttattttaatttttaaaattacaaattatatcgctttatcttattgtaaaggcttgcaagggaaattcccagtttttcggcaatcattttttttgccgataaggaccttccatatttctccaatgccatacttataacctctttttctatgtcccccaattttttaattgggaaacttttttccaaaaccggaggttcattagcttttgaaaaatagccatagaaatgatgctcgtctaaatactcatcatccaccaagattattgttctctctaaaagattttctaactcacgtatatttccgggccatggataattttgaaatagctcctgtgcctttggcgttaatccttttacctttttgccaaagcgccgatttaatctaccgataatattttctgctatcagcaaaatatcttctttatttctctttcttaacggtggtagttctatatcaataacttttaaacgaaaatataaatcttccctaaactttctttccttaaccattcgctttaaatcgcgatttgttgctgcaataacccttacatcagtagtaatagtttcaatacctccaaccctttcaaattgcttatcttccaaaactcgcaaaagcttggcctgtaaaaataaatttaaatcgccaatttcatctaaaaatatcgttccctgatgggctaattcaaactttcccatcttggttttggttgccccggtaaatgcccctttttcataaccaaacagttcactctctaataaattttcaggtatagcagcacagttaattttaacaaaaggttttgaggaacgactactttccatgtggattgcctgggcaaacatttccttaccggttccactttcacctaacagaagaaccgtggcatcactttttgcggcctttttcgctatttttttggcctctaaaagtttttcatcctttccaataatatcgttaaaagtataacgacaaccggaaagctccgaaagcttttgactaaagctctctaacatttcctgagttttactgagttgttcgctaattttcagaatatccgtaaccgtttgaaataccacagctccaccgcttaattttccatcgataaatatcggtacagcatttgataccacttctgctttacttccccccactaaagttcggtgcccgataaccggtttcattaacttaatggcctgggctaaagctccatagggggaaacttcgaaaatatttttgccaattctttcttccttttcgataccagttatgcgggtaaacgcttgattgatgtatttaatttcgcctttttcgtcggctatttcaattccctcctggagagaatctaaaattttcagaagctcttcccgcattttctgggcaagcactaaatcggtaatctgacttaaccctttattatcggcaataaaaaaatcaggatttgccatcaccgcttgttccacattctggactttgactattggcaatccctttaaaaactccggctccaattctcctaaataataaatcgtcactgttcattcctccgtttttaattttataaatttttattctataaattataagtttttcctgcaaaataatttcgaacttatgttttcaaaaacctaaaacattattataataaacttaaaagctaccaaaatgaggtgatttttgcgtgaaaaactcccttctttcgcaccaggaaaaaaaaataatctcatttataaagcaatacctcaatgagaatggatatcctcccacaattcgagaaatctgtcagggtgttggattaagctctccctccactgttcatcaccacttgaaaaacttggaaagcaaaggctatctgcaacgaaatccaaccaaaccacgagccttagaacttgtagccgaaaaagcaccggaagagcttttatcaattcccttattgggcaatgttgctgccggttatccaactttagccattgaaaatgccgaagaagaaatgcaaatacccaagtccctatttccggaaaaagagttatttgctttgcgcattaagggagacagtatgatcgaggaaggaatactgccaggagatgtgataattgtaaaaaagcaagaagtagccgaaaacggtgacatcgttgtcgcttatttagagggagaagttactgtaaaaaaattctggaaagatagtgtgaatggagtgattaaattaattccagcaaattcaaaatacgaaccgattatcataaaccgggaaacaaaaatattgggtaaagttataggcttgttaagacgatattaaataagccagcaacttttgctggcttatttccatatttttaaagcttcctttaacaaatcctggtgcagttccgcaggtagttccagccaaaatactttatccttactttggtagtagtaatgcactctacccatgccataagttttaaaaacctttaaaccctcaatttcaatcgcctctggatagctgaaaggacttttacctatagccgcttttatcttccggtccataagatcacacaagtaagctgcctcctgtactgaattggcctttgaaatccaaattcgggcttccttttaatagtttttataggtaataacttcagctgctttgatatcaattagttttccatgtaagtcgttcacggcggcaattgctgcatttcccttgatatcttctacccgatacatttcagcaaaagtttccggtgctaaattaagttccaaatcttttttttcaaagtaattaaccacaaaaaaggcaccaagaataatcccccaaaaaattcccaatgccagtattgctcttttcatggtttaactccttttatctaaagcctcttttattaactccaattcccgtttaatttgcttttgcctttgtcccaagaccacagtatagagaaaaattaatgtccaaataataaaatacgctaaagctaaagcagttaatttactcattttcttacccccctaaccgtaaaatttttcattgactatatcctttaaacgatttaactcccggtgcagcaaattaattcttgcgctttttactaacaagtaaatatataaagctgtaaaggcaaacaggcttataaaaaaggctggcttcatggcagggtccaaaccgcccgatggattattaaaaataattggatgaaaagtcttttgccaccagcgaccggcagcaaaaaccaggggaacatctaaaaagccaataatgccaaaaattgctgcaaaacgtgccgttttttcttcttcccccgccgcaagccttaacactacgtatgctaaatagataaaccacataataattgcagtagttaatttaggatcccaggtccaccaggcattccataccgttttcgcccaaataggtccggtggtaataacaatagtagtaaacacaactcctatctctgccgaagccaggctgatcccatcccagtaataatcccttttaattaaaaacataatactccctacaaagaccacaaaaaaggctaaaaacgcaacccaggcagccgagacatgaaaataaaaaattttttgaacgatccccatcattttctcctcgggggcaaccacaaaaaccatgtaaattgccaccgaaagaactacgtatgctaatagtcccaaaaaataatcccaaactctatccctctccatcttaaccaattacacctccagtaagatttcaaaaagcattaaaggtaccacaataaacagtaagtcataaacccccagaattttaagccaaatactccattcgctaaagggaagattgaaaaaaacacctttagttgccgccacacttcccaaaataaccggaattaagaccggaaagagtagtacaggcagcagtatgtcacttgcccgggtattagcagccaaagcagccaaaaaagttcctatggctacaaatcctaaactaccaaaaaataagataatcaaaaaaaagccaaatttttggggaacaggaatgtttaaaaagataaaaaacagaggtaaagttaaaatttcaataatcagtaagaaaaccaaattacttaacatttttcccaaaaaaattacactgcgatccaccggagctaacattaatcccaataaacaatcctgatttttttctataaaaaaggaacgatttaaccctaaaaggcctgaaaagaaaaaggttatccatattattccgggaaaaatatcgtttacaatctgttttttaacatcaaaagcaaaattaaaaattaccagcattattaaggcaaaaactaacattacacttagcatctctttggaatgaaattcagcttttatgtctttttccacaatagctaatgcctttttaaaaaaggtcatgcagaaatcccaaccttttttcggtatatttcttttaaactctttaaatcataaagattagcttcatcgaaaaccagttgtccgcgatttaaaattaatatccgatcgctaagttcgaccccttcttcaaagttgtgggtaatcattaaaatggttcgttttctttgctttaacgtttttaaaacattgtttaaaatatctatagcttgctggtctaacccggtataaggctcatcaaaaaggacgatttccggatcgtttaacaaacagcgggcaatagctaagcgctggagcatgccccgggaaaaagtttttacctgctggtaaaagctaagttccaagcctacctgttgaataacttcccttaccctttcttcaaggttttttaccccatacatttttccgtaaaagagcaaattatcccgggccgacagggaatcatacagaaaggaattatgggaaattaccccaagctttttccttaaagcaacaccaccttcatttacagctattccgttaatttttattacaccagaagttggcttcattaaaagagaaagaattttaaataacgtacttttgccagctccattgggtccaagaactgttataaactggccatcttcaacgttaaaacttatattttttaaaattaccttgtccccgatctttttcgttacattcttcacttcaatcatggcctacacctattcggaaagttttttaagctctattttgatcttttttagctgttctttataattatttaaaagttcctgatattcttcttcagttacctcagccttaccgtacttttcttccaaaagctccactttggccaaaatttcctgctcctgggcttttaattgttttactttttccaaaaactcctcatcatctaaagactcgtgtttactccggtaaagcattactaaagctaccactattcccccaataaccaaaagcaaaaagacaagccacaggtgaggatcggtattaccaaggggtgaatttttccaccgttgtatatgctccggactatgaaatttcaaattagtagtttcttcactatagatttgaggtgctttttgccagttcccctggccggctgtaaggtttaaagttatcttggtattttcctttaaatttccagttgcgtagacatcaaaagacttaccattgatttctaatacaccttgaggagttaattctccgctgtttatggtaaactccccgggcgttgttaaaacggcaaaaacatcacagctatagggaaagtaaaggattaaactttttttatcggcaaaaggtaaagagtaatttatgctaagctttaccgcagtaagtcccccggtagtgagacccaggccatctggaaagcggatatattgctcttcctttatcccgcttacgtttaaatcggtaaaaccctgaggcaaaggaagaaaaacttcaacaacctttccgttgtgctgttccttgtagccttgaggtatgtcaatttgaagaatttgctgaacgttaagattggaaccgttttttgcaagaaacaagtgattcaacctgaccaccggtttttccccggcaaagacagaagtgcaaagaccaaacaagaaaaaggtaattataaagaaaaacttaaaagcagcaaaaaatttttctttcatctaacccctccgttttttgttgcgaagtctttgaagttcttcttcaatttctttctcaatgtcccgctcaacctgcactttatcttccaatttggactgttttttatctcctaaaagttcgttgtaagcttttaggattaagcttgcttctttggcataacggctttttaactcctcataatcttccttggcaattttccccatgtgataatcaaactcaatctcgcttagggttttaaaaattgcttctttatccttaagtagcttttcttttaaagatgcggttttctttgtttcatcggtggattttacaaagaaaggataaattaccaaaaatccacataatgccaagagcaaaatatcgattactatggccattattctgcctccttagctaagcttggtccacctataactctgggccccatctccgcccctttacccggccagagggcaaaaacagtaccaaaaatgaggaaatatccgccaatccaaatccaggcaattaaaggattgactttaattttaaaaatcgccgtatcctgattttcccagccggctaaaaccacatacaggtcttcctttaatgaaccttttattgccacctcactggtggggtttggttcattaggataaaagtttttggaaggaacaagacgggtaaggtacttgccgtcttgatagacatcaatatcggcaactacggcatcaacattgttcattcgtacctctcttaaccctttaaattcaatagtataatttttaattgtaactttttcattagttgttaaagttacatttttttcaatatcatacagggacgagccggtaataccaatggcaatcaagactaaaccaatatgaatgatataaccgccgtatcttctccggttctttgcaaaaaggtttattaaagccttaacaaaattttcaccggtaagtttaacccttgtcttaactcctttaaaaatttcatataaagtggcaaaaagaacaaagaaattaataaaataggaggccaccgcccagggttttctaactcctacgataagcaagtaaatgataaccactaacgctaaaaacaagggaacggtaaaattacggaagatacgcgaaactgacgcttttcgccaggcaattaacgggcaaattcccattagcaagataaaagccaggaatatcggaacattcactgtattgaaaaaaggagcacctactgttaccttttcaccggttagcagttcagaaaaaagcggaaaggttgtcccccaaaaagtagcaaaagctgctcctactaatagcaagttatttaataaaaagctactttcttttgaaataatcgattcaaattcttttccttcccgcaagaaattaagacgatcaattaaaaggtataaagagccaactaacgccaacaacgtaaataccaaaaaataacggcccaaactctggtcggcaaaagcatgaaccgaagataaaactccacttcttgttaaaaacgtgccaaataaagtcaaaacataagttatgctgataagaaaaatattccagacttttagcatatcttttcgttcttggaccattactgaatgaagaaaagcacttcccgtaagccatggcatgaaagaagcgttttcgacagggtcccaggcccaatatcctccccagccaagctccacataagcccattccattccggtcaaatttcctaaacttaaaaacaaccaggccagtaccgtccagcgtcgggtaactttaatccattcatcccctggatatttggcaatcaccgccgccatggcaaaagcatagggtacagcaaaccctacatagcccaaataaaccgctatggggtgaattaccattcccggattttgtaacaggggattaaggccatttccttcaaccggaggaggattcaagattacaaaaggtttggatataaaagataacacaaataagaaaaataagttattaatattaagaatcgtcaaggcaattggtttaatgcgaggtactgcgttatttaaagcaatggccaaactgtacaaactcaatacccaagcccataataaaagggaaccttcatttccagcccataacgcggaaaaacgatagaaaaggggcaagtccgaactggtataatgagccacatattgaatagcaaactgcccgcttaaaagaaatatttccagaattacaatggcaatggttgtatttatagcaatggcaattgatgcaccttttacactctccgctaaaatagaattgtttgaccgtatggcaattatgccggctactactgcataagcacttagtaaaaatcctaaaaccagtgcaaaacttccgacatttgctaaaaataagttatccatctcgcctgcctcctgcatttattgttgttttttttcatattttgacggacatttcactaaaagagtatctgcttggaaaaccttaccatcgtatttgccttccacaactatttgggcttccggatgttcaagattatcaggttttacatcattatatacgacgggtaattgagttttttccgagcctttgatcggaatcattataaattttaattctaatgctttggcattccaggaaatagaaccgggtagcaccctcccttcaatccgcattttttggtcaacagcattttcataaactatcttataaaccgcctcatcaacttgcagggaataactggtaccggacgaggcgaaagccgaaataaaaagaaacgctatggcaataacaataataccgcttcccaccagaattttggtcctttgattcattacgttaaccctcctgttctaacgcctttttaagtagctttcgatactcttcttccgttattttcccttcaataaacatcttttttaatacttttttgtttacgacttcactttcgtttttatttttggaatttacaaggtaaaaagcaataactgcaccaattactaagatcattaaaataattatagtccccacaataaggctggaataacttgaagaattactgtttttttgattcgaactttgctgagttttcgcctgttcctgtaaacgatttaaggcagtctgataatcttccttgggcactaccggagtggtatcatttcttacataagaaatagcaaaagaaagagctctctgattgtttaaagtaaaactatgaagctttaaaccctcgtgggtttgggttatcagttcatttttaagagacgttttaaaaaacccagccccgggaggttctaaaatctttacgcttaactcacttatggtaaacggaaattgtatatttgtttctactttcttttccggcgatgaaagttttccaaaatgaaattggataaatagattcattttctcctgtggctttaaaacaggatttaacattatttttaacgccagctgtttatctttattttctaaattaaacggaagatagctaagttctccagtttccctgacaaaagcaactttgtcaacgctggtgtccgccggaagaagaaaacttaattctttcacttcggaatttccttcattaaagataataccggaaaaggtggctaagatatttcccgtctggtcgtattcaggaaaaaggttcacctcaaaatgcttcgaggtaaccgtttcctgcgagtaaaccgggcttataaaaaaaatcacaaaagcaagtaaaagaaaaatagctaacaaaaaacgctgctttgacatttaaccactccccaaacgatattcatgattttaagtattaagtattatagaatttctttatgatatgataatttcgacaatgaatcagaaatcccttttttactttaaaaaataatttaaagaaaatttctcgtaaaaactctcaattaagagcatcccatactctaaagctatacccccctgaaaataaacaacatagggtggaataaaaggcccatccgctgacaaatcaattgatgaacccgcaacaaaacttcccgaagccataacaatcggagagtcataacccggcaataatgacggctcaatcgttacaaaattatcaatcggggaatactcctgaaccgtttgcacaaatttcagcattttttccttatccctaaaaattaatgtttgaacaatatcacctcttttggaaaaagcctcaggcaaaacctcaactccagttttctccaaaaaatacgctaaaagtacggcaattttaagagcttccccaactacttttggcgcaaaataaaatccctgtaaaatatcccgggcaaaccccaaggaaggtccaacctctttacccaaacccggtgccgtcaaccgatatgccgcttgctcaattagttctttttttccggccaaataacccccggttggagcaatgccggcaccaagattttttattaaggaaccagctattaaatctgctcccatttcaatgggctcacagggttcaaccatctccccgtaacaattatcaactaagaccacaaggttagaactatactttttagcgattttaattatcaattttatttcctcatttaaaagagttggtctaagatcatagccacgggatttttggatgaaaagcatcctggtatttttctgaatattgttttgaaaaattacttctaattcttcgggattagttgtaaagggtaaaattttataagttataccccattcctttaatgaaccttgatttttaccccgtttgcctataacctcttcaaaggttttataaggattgccaaagattaaaagctcatccccgggccttaagacggcaaaaagtcccaaagtaattgcatgggtaccagaaacaatctgaggtcttaccaaggcatcttcggctccaaaataggaggcaaaaaccgtttccatcttatcccgagccgtatcgccgtaaccgtatccggtagtaaatacaaaatcggagtagctaattcgcgcctccctaaaagctttttgcaccttttgagcattttggtaaacaaccgtatctataagttcaaattgcgttttaacgtcctgcggaattttcagcatcgccttcttaactcctttacttaaagattaagggctaaaattgctttttccaaatcttccttttccaatactaaaagatcttctttagttaccttacttttacctaaaagccttacggcctgtcgccttattgccttttcaataatatttctaattaaacgagcatttccactactttttttgctttggtcaaggtgctttaatttatattttaaataaaaagctgcctcagaagaaaacaggtattcccaatcttccaagaacttttcagcaataaaaaaaagctcctcatcggtataatcgggaaaggttatctcaatgggaaagcgggatttaagccccgggttttgctctaaaagataattcatctcatcataatacccggctaaaataataacgagattgtcccgataatcctctgcccccttcactacaacatctattgcttcccggccaaagtctttgtcgccaccccgagctaacgaatatgcttcatcgataaataagacccctcccaaagctttttttaactgttcccgtgtttttaatgcagtatggccaatatactcccctaccaaatcagccctttcaacttctattaagtggccttttgttaggataccaatttctttaaaaagcttacctataatcctggcaaccgtggtttttccggtaccaggatttcctttaaacaccatatgccagctaacgttatttgttttaagcttttcctgaactctttttttgtgaatttgagctaacgcatatatttcaaaaaccatctctttaacttcaatcaacccaaccatccgatcaagctcttttaacaaagaagatacctggtcaaatttttcaatttcggtttttgagggagaagcagtattgatagaatttattaatgttactttcataaccgtccctcctcttggatcgggaataaaactcccttttttctaaaaaattattaaagaggaggttattaatatgaaaaaacttttcttttcccttttttttatcatcggtttttggggagcaaattttcccgtttatgttaatttgaactctcaacctcaattaattgtcatcgatcccggacacggtggaatcgatccgggagcagttaacagttgggtaaaagaaaaagacctcaacttaactgcctctttatatttaaaacaatttttagaaaatgccggcgctattgtaaccttaactcgaaacggtgattacgatttaaaagacctctaccctggacccggttcccgccaattcaaggacattgaaaaccggaaaaagtacattgaaaacctaaacccagacttttttatttcaattcacgttaattccgggaactttagaaaaaagtattttggtcaagttttttacggaagaaaccccataaatgccgaatttgccagtattatacaggattctctcaataaaatttacaatgtttcaaaatcaccccaaatcgcagatttcctaattctttctgccagtacccccggagtattaattgaaataggttttattgatgataaacggttacaaaatagcgattttttaaaaaaggtttgtcaagaaattgccagttcaattataaaatgcttaaaccaaaaaaagcagatttctcaactaaaaggcgaatccaaattgttaattattattgacgacttcggaaataacagcgatagtctggtggattttttaaaacttaaactgccctttactgctgcggttatgccctttttaaacaatacacatcaagaagccaaagccctttaccagagtggaaacgatattataatccacttgccgatggagcccaaaagctataaacgttcctggctaggaccaagaccaattatggttaatctaaccccacaagaaataacttcgctattaattgcagcattaaaagaaaatccttgggcaattggaataaataatcacaccggttccagagcctgcgaagatgaaaaaatagtaaaaacagtccttagtttttgtcaaaaaaacaatttagcgttcattgacagtcaaaccacgcctaattctctctttcccctcttgggcagtgaatttggggttgtggtgttaaagcgagatattttcttggaagttaacggcaaagaggaaaaaaacatcattgaacaacttaaaaaactacaaagcatcgctcaaaaaaagaacttgggtatcgccattggtcacgttggttatgaaggcggaaaaccaaccgccaacgcccttaaaaaagtactaccggaactgcaaagacaggggtttaaaatatgtacgttaagcgacctcattaaaaaacacccctaagaaggggtgttttcttcatttccacctttagccaggtaagtattaactggtctttggggaattatggtagaaattgcatgtttataaatcatatgctgttttccttcactttccaaaattacagtaaaattgtcaaacccttttacaaaacctttaagctgaaaaccgttaattagaaagatcgtaacccccacattttccttacgtacctgatttaaaaaagcatcttgcagatttaattgattcttggacattggtttccctccatctctctttatttaaattaaaaattctacaaaaaattgtttactcctgcctcggtaattattttttcagtaattttttctaagctttctttacccgaatcaaaccattttatcctggggtcccgccgaaaccaggtgagctgccttttggcaaatctgcgggtatccctcttaatcaggtaaattgcttcatccagggttatttttccttccaaatactgaacaatttctttatagccaagagcttgcatggcagtactttctttaaatcccatttgcaaaagtctctttacttcagcaatcagccctttttcaatcattttatccacgcgttcatttatccgctggtacagaagggctctatccattgtcaaaccgtagtaaagcaagcggtactgcggtttggattgttttcccctctcccaataataacttataggtttaccagtatgttcatacacttctaaagctctgataattcgccttaaatcgttggaatgaattttttgtgcggctactgggtcaattttttccaacatctggtgaaggtatgaacttcctttttcttttgctgcctgttccaattttcccctgaaaacaggatcaaaggaaaagtcagtaaaatcgtaggggtcaataaccgagcgaatatataatcccgtaccacccacaataattggaatctttccccgttcattaatttctttaattaatctcctggcctctttctgaaacaaagccacactgtatttttgaaaaggttctaaaatatcaattaaatgatggggtaccccctccctttcttccggcaaaacttttgccgttccgatgtccatgtatttgtacacctgcattgagtctccagaaataatttcaccgttaatttttttagcaacttttatccctaaggctgatttcccaacggcagtaggcccaacaattataattaatttttcgctcataactgtacctcaattaccccaaaagcaatttcactgtcttttcccgctattattttatcaaaaaacggcaataactttatttcctcctttcttcccttaaccacaaccctctttcgcgcaacactacaagcattccttaacacttcttcatttatatagtccttagcagcaacatttcttaaccttaaaatatgggcagattttcctgttgtttttttaaacattggatcaaaatagacaacatcaaaacttttaggcggtagttttactaaaaaatcagtaaaatcaccatgttttactttaatttttcgcattggatttattaaatcagggtcttcatcatatgttttgagcccattggaagttaacaggtaaattatcttacttttttctaaacctaccactaagccatcttttactgcatattgagcaactatactgtcctgagcaagccctaaggtacaatccaaaaccgacatcccgggaaccagtcccattgcttttatcataacatcttcttgcccttttttcatccccttaattctaatttttgccattccgggatgaaaatataacttggacatatcagaaaaaactaattccaagtttttttttgttaccactaaaaccggcatatctcgggcaatttccattaagcttcttttatttctggcaacatagggaaaaccagaatcgagcgctaaacttagcgctttttttatttgttcctcagtcggatttagacttgtggtaattattgccctctccataaattaaattatctcctttttatctaaaaaactttttatttatttcagttaaagataattcataaattgttggcctcccgtgaggacagctcaaaggataattggttttaaataactcctttaccagattagtcatttcgctgtacgttaatttttcaccaaatttaacagcatttttgcaggcaaaaagttttagggctttttcccgaaaactaacctgctctttttgctccataatttcgtataaatactcttccaaaacattggcgatattattttgaggaaaatcctctggaatttcccgaacaagatattcacccggaccaaacggttcaatatgtaagccaatttccaggaagttttggtaattttcctgaagaaaagcttccaattcgggagaagcttttatcctcacgggaaaagtaagcacctggctgtaaaagggatttaatttagtttggtatttttcgtataaaattcgctcgtgagctgcgtgctgatcaattataagtagtttatcatttttttccacaattatatactttaaagaaaactgccctataacctgaaagtttaattccttcgcaaagtctttatttagagaaaaagtcagattgtcgcttgtggaaaaaatatcttctttttccaataatttgtcactattaccagaaaactcttcagcaaaataagtaacctgccaataatcattgtcttcacttttagtatttgtttctcttgcaggggaaaaagattttagggaagaacttttagcatttaccaacttatttctgattatcgtccgaacatccaaatagattttttgttcatccataaacttgacttccaacttctggggatgtacatttacatccacccaggtacccggaacaaccacttctaaaaaaacaagaggctttaaaccagttggaagtaagctttcataagcatcgtcgatagctttagttaagattccgcttttcaccaaacgtttattaacagcaaacacctgtaatttacggtggggtttccctgcaggtggcaaggcaattccaccttttataaaaaatccttcacccagtttttcctctaacataagcaaattgcctttttctaaaccccaaaatcgggccagcaaccccaattgctcctgaattcccgccgaactgtaaatcttttttccatcaataaaaagggaaaatttaaccccggggtacagtattgccattttttctataaattgcctaataagtcctgcttccgtttgtccggactttaaaaattttttgcgggcaggagtattaaaaaaaaggtcggaaacagtaacaacggtaccataagccataccgacttcggttaaatttattacttccccggcatgggctattaattcatagccattattttctccccgaactctacttttgattgatattttacttaccgccgcaatactatataaagcctctcctctaaaaccaaagctctctaaataataaagatcatcaaagcttgctattttactggtagtatggcgtaaaagggcatctggcagttcctctggcggaattccaataccatcatcttccactacaattttccctaatccaccttcttcaatataaacatttatattttgggctttggcatcaaggctattttctaccagctctttcaccaccgaataagggcgttctactacttcgcctgcggcaattttttttattacttcatcaggtaaacgcttaatttttggcattttatttttcccccaaagctttttgccgtagttcatataatttatttaaagcctccaacggtgtcatacgaatcaggtctaattcaattaattcttttattacacccgaaggctctggcttttcctcaaaaagcgataactgaaccggtactgtatctttaacttttagccccttatcctcgaaccttgctaatatttcataggccctttccaccacttcccgcggtaagccagcaagctttgctacatagatcccgtaacttttatcggttttgccgggcacaactttatggagaaacttaacttcttctcctttttcctgaaccaggaccgtaaaatttttgactccaggaatttccccttctaagcccgttaattcgtggtaatgggttgaaaaaagcgtccttgctttgatttttttttgaatatattcaataattgcttccgcaatacttataccgtcataggtagatgttcctctaccaacttcatctaacaaaattaaactccgggatgttgcatttcttaaaatattattacattcaatcatttctaccataaaagtactttgtcctttggccagatcatcggtggcaccaattcgggttaggattttatccaccaatccaaccctggcatattccgcaggaacaaagctaccaatctgtgccaaaattacaattaaagcagcctgtcgcatgtaagtacttttaccggccatattggggcccgtaattaaaagaagcgaattttccttggtgtcaaggtataaatcattgggaacaaaattggcccggccaacactcttttcaaccaccggatggcggccattttttatttccaaaaccggttcagcggtaatgaccggtcgcgtaaagtcatactcaattgcggccaccgccagggaaattaaaaaatccaaaagcgcaacagcacttgcagctctttttaaatcttcctgatattttaaaatttccgagcggatttcacaaaaaagctcatattccaaattggcaagcttttcacttgcacctaaaataaggttttcataatgttttaattcttcagtaataaacctttcggcattaaccattgtttgctttctttgataatcagcgggtactaagtgcaagttagctttcgttacttcgataaaatagccaaaaactttattgtaattaactttcaatgactttattcccgttctttccctttctttcttttcgtaattaattatccaatcctgcccttcctcccgggctttccggtactcgtcaacggttggattatatccgttttttataataccgccgtcttttggtgagactggagggtcatcaactatacttttatcaattaaattataaacctcacgcatttctggaagatttttataaatttcggcaaataaaactgacttattttttacatggttaatgctgtttttaatatgccatatttggggaagagattgtttgattttaattaaatcttttggatttattgttccgcaaactaatttaatggaaagtctttctaagtcatataaattcttcaggttctcccgtaagttttctctcaattcataatcatttaccaaaatttccacagcatccaagcggtcagcaattgcttttaaatttaacaacggttttgtgagctcttcctttaattttcgagcgcccatagcggtctgggtaaaatcaataattcccaataaagaagaagaattgtcttcacggtttcgtaaaatttccaaatttttccgagtactttcatcaaaatataaataactatcaatttgataaaactccggttgcccaaagatacttaaaaccgctggttcaattctttttaaataactaattaaaattttataagcttcttttgacgcttcaggacctttaaaagcaatttcaatttcttccgccggcaatttttccaagtaattaacaataccggtaatatcttttaacagaaaattatttttaaaattttttaataccaccgcttcagtgggtgccaaccggcgaatttcgcttgccaagacttctattttaccttcatcaacagacgttattcccaaatatcctgtagaaacttccgcaaccgccagggcaattaacccatctttttctgccagggcaataatataattattggtcttctcttgcaaaaaaaactcttcggtaaccgttccgggagtatatattttggtaacttcccgcttcaccagtcccttggcttttttcggatcttccacctgttcacaaattgctactttatatccccgggataaaagcttggcaatatagccctgagccgaatgatagggaaccccacacatgggtaccctttcttcctgtccagcatcccggccggttaaaacaatttccagctcccgggaagcaattaccgcatcttcaaaaaaaagttcgtaaaaatctcccaaacgaaaaaataaaagacagtcgctgtattgctttttaatgtcaagatattgcttcatcatcggcgtaaagctcatattaaactaaaaccccttccaggtggaataatttaccttcggtaatttttacctttactaactttcctactaaatcctcatttccattaaatactaccagcttattagttcgggtccggccagctaattttgtttcatcggtcttgctttttccttccaccaatatttcgtgaatgtttccttcctcatttttgtttaattctaaactaatcccattttgtaattcaatcagttcctgaattcttctactttttacctcctcgggcacctggtctttcatttcagcagcaggtgttccggtccgcttattatacacaaaggtaaaagcactatcatatctgacctttctcaccaaatctaaagtttgttcaaaatcttcttcggtttctccaggaaagcccacaattatatcggtagtgaagcttactttgggaattttggcccgtatcttttccacaaggtttaaataatattcccgcgtatatccgcgatgcattgcttttaaaattttattggaaccggcctgtaccggaagatgaaggtgttcacaaatcttccgggaagaagccatcacctcaataacatcgtcagttaagtcacgaggatgggaagtggtaaaccgtacccgccaaagtccatctatcttctcgatatccgctaaaagttcggcaaacataggctttccctttaaatcttttccgtaagagttaacgttctggccaaggagcgtcacctccctgtagccttcagccactaattgccttatttcctgtaatatatcttcctttttacggcttctttcccgaccgcgcacataggggacaatgcagtaggtacaaaaattgttacacccatacattatcgttacccaggcccgcacgcccggctctcttttgaccggaataccttctacaatttgcccttccgactgccagacctccaaaacccgctcgtgcttttcaaaaaccctttctaaaattttcggtagttcaggaagattatgggttccaaagataaaatctaagtggggaaatctttctaataaacgtttggcaactttttcctgctggggaatacatcctccaaccccgattactaaatcgggattttccctttttaattttttcagttctccgattttagtaaaaactttattttccgcagtttcccgaacactgcaggtatttatgattattaaatcggcagttttttcttcaggactcggcacaaatcccatactttccaaaatcccggcaattgtttccgaatcatgaacattcatctggcaaccatgggttattatatagtagcttttctctgccatttttattgcctccaatcttctttttctcataaaaagtatagcaaaggaaaatcctaaaataaaggtaatctaacagaaaggaggatgaaggtgggcgacctgcaggaagagtatattactttggccttaagcgaaggtattcaaaatttagaacaaacctgtcggatttatcaaaccataatttcaaagcattccgataaagtaattcgggaagccgctcttagaggtttagaaggaaaacaaaaacaaataaaaaatcttttagaaattgccaatgcctataactttaaagtaaagcgggggattgaatggaactaaaagatcttttgctaatggctttaaaggctgagaggcaaaactaccttttcttggccgaaatgaccgttaaaattaaacaccccgaattaagaagtttattttccgaactacaagcggaaacgttaaggcagatatttcttttagaaaccctggtcgaagaaaaactgagttcacccccggtagttaaaaaactaatttctttatttagaaaataacacatcgtcaatataatactttacggcagttactacaattaaggcaacgatatttaaaccaaaactataccagtagctccattttaaatgtcggtaaacaccaaaaatttctgctaacctctccactccggtaaaaagcagggaaattaacggaatataaagccaaagccaacgttccctcggcttaaaaccccaaaagatgatacccagtaaaaaaccgttaagtaaataaaataaaggcaaattataaaaactgggcataccgtaaaaaacatataatcttaacttaaccgctgtgtagtccacaataaacatgagcaaaatggtaataagacccgttaagtaagaaattttttttctcggtcttaaaaatacgacaataatcaataaattaaataaaaagtacaagtaccagaacatctttacctcctggtgagcgagggattacttatgaaagttgcgataattggtgccggtttagcgggacttgctactgcttttcaattagacaggtataaaataccttacatagtttttgaccgtcgctatcagccgggcgatcctacccctcacattgcggtaagtttaaaagttataaaccgccctgttaaagatattgtaagctatttttataaaaaatatgatttaccccttgtcccttatcgaaaaattacaaaaatattgatgaattcaccaggaaactttgcaacagttcgcggcagtaatctgggctatttttggctgagaggacattttcacaactctttagaaaaccagctattgaggttaatcaagggagaagtaagatttaaatcaccccaggatccagaacatttaaaagatgctttttctcacgtagttgttgctaccggtagtccgattatcgctaattcttatggtatatttcataaattgtttgacggatgggtcataggctcgaatatttcagggaattttgatccagaagagttagtaatgtggattgataccgactatgccaaaaacggctatgcttatttaaccccctttgatacaaaaaacgcttccttatgcctcgccataaacgacataacagaaaatcagctcagccactactggcaggttttttggcaaaaagaaaaattaccctataaaattatcgaaacttttacggtaaatcacatcgtgggctaccttactacaaatcagcttaataatatttattttaccggcggggctggaggattaatcgagcctttcttgggttttggtattttttattcaattatttcaggtattttagttgcaaaagccatcaaagaaaatttatcctatgatacattattaaatcccataaagcaagcggttcggcagttcgatattcttcgcatcggtctaaataaattaaacaacaactcctttgactttttaacaggattactttcttttagacctttaaattatcttctctatcacctgccctttgattccgtaaaattgataagttacctgtttgctaaaggaggtttaaaacgttgaaggtagctatcgttggtggaggatttgctggacttttaacagcctgcctgctggaaaaaaagaaaatagattatcttctttttgaagaaaagcgaatttggggaaaaagcttttcttatcccgcccttattttaaaaagggattatcaaaaattacctaaaaacattaaaaaacttttaccaaaaccaagtagttttgcttctaacgcccaggtcttctggcacggaaacatagggcagggacttgaaaataagcttatttcttatcttcccagcaaaaaagtaaagcttttttctcccgttgacattctttctttaaaaaataaatttgatcttataattaacgcaactggaaatccgttaaacacccgcaaggtaggcctttggcaggattggggaactatgcactttcgagccggcttttacaccacattaatgaatcccccaaaaaaattctttaaaaaaattcccggaaaccatccaggatttatcttaaatatgccgatagatcggcaaagtggcgttttagtgatgggaattcaaggtataacattccgcaccttacctttttactgggattttgtacttgtcaaagatagttttaacgtacactttgtggaaattaatgattggatgcaaaattttggtttggcaaggccttttaatttccaaaatatttttttcgtaggcttatcagggatatcatctccccagtggtatcgtaacgattattttgcaatactgtcggttttaaaagcattaaattttttgttgtagctttttattttttgtcaggaacaagaagaaaacaaaaagaagcggaattaatacagaaaaaattaaagtaaaatacgttaattctcccaagtagctaaaatattttcccatattctcaaaaccgtaaatcgcagaaattaaggccaaaacgcttaaaggtagaatatgaagttctgctttcttaacatttattacggctttgaacagttcggctaaccccagatataaaaaggttagctttaaaaccccaccaattgaccacacccctaacatgacactatccaaatgttttaaaaaatcagcgatattgactatcctaaccatttctaaagctaccagttccattttggccgcacatttgaccccaaacaccgctacccccaatactcctccaaaaagggcaatacaaataaaaaaataacccaccacaagcaagcgaaataatttttccggcttactataaaaatttatcgcaaaaaaccacaatagcaacgtatcaccaaaaaaattaataatttcaatactacctttgattacggggaatattcccctaagtaaaaacggcttaaaatttccaaaatccgcctttgttaatgcataaccagcaacaagaattagggcgaatatcccaaagggagttaaaatttctgtggcccgggccattgtttcggtaccagataagaccccgtagaaaataaccaactgcattaaaattccaattactaaaagcggtgtctggggtaaaaataccttcactaattctaaaaattctctatacacggtaataattaaaataaaataaagataaaaataagcaaaaaggattgctttaccaagtgttcctcttttttttaagtaacttgttaaattatcagggtaaattttacatccgatataagcataaatccatgccagaaaaacactaaaaataaaagccaaaattattgatagccaagcatcgggaccaacttccttggcgattacgcttggcataaaaatatcaatcgctgataatatcaggataaactgaataaaaagtagctggattccggtaattttcattttatcttccctcctggcatattttaaccaaatccaggaggatttttgcatacaggtgtcgaaatttggaatttgaggtgatttaaatgcccgaaccggtccaaattaaaggaactcccaaaggattactggtaatgttaaacagccaggattttgctcttctaaaagcatccttaatagaaaaaatggaaaaagccaaaggtttttttaaaggtgcaaaatatacaattatgtacaatgacgatattagtttaaccaatgccgaaaaagaagaattagaagccatctgcaaccgttatggtttaatcgccgaatctttttccctacctatgtctaaaaccggtgaacttttaaagaatatcgccacttctttagaaacagtagagggagaagaatgtgaaatcgtacttaaaaactttcgtagcggccaaacttatttcagtaataaatctcttctcatccttggcgacgttaatccgggtgccgagattatatcgcacggaaatatcattgtctggggaagcctgcggggaattgctcatgccggttatcccaataatgaaaaagcccaggttatcgcaataaacctggtaccagcacaaatccgcataggaaaattcgttaccagagctcaagaaaatcctggtaatcgaccctatcccgaaaaagcaagggtagaggatggccaggtaattattgaaaaatattaaaaagctatgaaatttaaaaaccaaaaaagcccgattaaggttttagcatcttttattttgttactgtgtaaaagctcctttattttatcaatttctataaaaacagttttaacgatctcatcctcatccggacgaggatcagttttttgtaattccttagccagataaagatacattacctcgttggaaaatcccggtgtagtataaaaggtggttaagtgctgcagcttttttgctataaatcccgtttcctcaagtaattcccgataggccgttacttctggagcttcatttttatttaattttccggccggaagttctaaaagccgttctttaaccgggtagcgatactgttccacaaaaacaattttgttttcaaaaataggaataattgttacagcacccggatgcagtaccacttcccgggtagatattttcccgttttccaaaagaacttcatctttaactacggttaagatattacctttaaaaagacagttagactttatagttttttccatttttttgcctccttattttattaatttaagaaccgcaagggaagctaactgcaccaaatcctcaatttccaggtaaagacgtgcccgagcgtcaaataaaatattagcattggccggaaattcttcatcttccgcccaaaaaacaaaaaataaatcaaccttgggaaagacctttaattgaaaggaaatatctcctttattataaaactttgccccaagctttttggccttttcctctaataaatttggcgcctggccaaaggtttttataagtaaatttacagtccgttttcgaaagggctctaaatacaataaaccgtcctttaattctgcaaatccaacccaggtgcccaaaggcggtaggtctatggctttggttaaataatgcaacactaaaattttttcttgaattgaaatttccggaataaattcagcttcgggccaagtaatggtaaccttatcattaaaatacggcaaaaaaatttttttatcctgtaattcagctccggcatttttcacaagaagttccggattacttttgacatatttttcccgtgcaatttctaaagtaagatccaagcgataaggtacccccatttttacccactcccttttttcctatattataacataaaaaaataaccaccttttggtggttatatagcttttgcttttctgggcattcctgattttttctgtttttgtgaaataaaactcaaacccatttcttcttcgatatccattattctgacaagtaaatttaatctttcttcattttcggcaacagcccaccgatccaaaagacgcgttcttaaacttctcaatttatcgcttttgcgcatatttttctaccctcctgtgaaagtcctcacatttactttttatattaaacattatacttaaaattcctgcaagaatggttaaatttttttaaaaattttattattttataatgaattttttaagaaggattttggcttaagacgccgtatatagatatcttatggggtattctctaaaatccagctgcaggaaggaatggttttatgaatgcaccagttattggaattgctcgaaccctaaactattatgcttattatcctttttggcagggtttttttgacagcttaaatttaaaaaccgttgtttcttcaccaactacaaaagaaattttagaccaaggggtaaaagacgccttggccgaagcatgccttccaattaagcttttttttggacatatagcaactttaaaaacaaaagtggattatctttttattccgagaatagtaaatttaaacaggaaaactgtttactgtcctaaatttcttggacttccggatatgattaaatattcttatgaaaatcttcctccggttatcgacatccgggtggataaccgtaatttaaaagatagtttactaatctcatccttaaaattggcttcattctttggattttcaaagttacagggttttaaagcgtatcgggaaggaatcaggcggcaaaacctttacgaaaatttacttcaaaaaggttacctgccggtaaatgaagttaacgttaattcaccaaaattattctctgtaaaatcatcgtttaaaattgctttactgggttacccctatctcgtctacgataattatgtaaatcttaaaattttagaatttctacataaaaacaacgttcaggttctaactgccgaacaggtaccctggccgattagaaacaaatatgccccttttacaaataaaaagcgccttttctggacttttagcgatagagtattaagtagttttcagtattttttaaaaaatgtccccgacttaaaaggtattattcatttaacagccttcggttgcggtcccgattttatcgtcgaccgtataatggaaatagacgctggagagcagcaaattccctatttaactttaaccatagatgagcatactggagaagcaggactcgtaacccgagtggaagcattcttagacatgataaagcgtaaatcccggtaagaggtgatggaatgaaaactctaagaattactttcccttacatgggaaactatgtccacgcttttcgcgggttgttagaagatttgggttatgaagtggtaatgccagtaaaaccttccaagcgaaccttagatttaggagttaaatatgcaccggagttttcctgccttccctacaaaattgtacttggtacctacttggaaacactaccaaaaggcgttgaccgcattgttaccagcggtggtgtcgggccctgtcgagccggtttgtatgccagcctgcacgaaaagattttaaaaaaaatgggttataacgttgaatttattgtgttggagccaccacttgttgatttaaaaggtttttacaagacggtacagaagttaaattacaaaaactactctttatggtacatatataaagcaattaaacgaaattggcggaaaataaaggcactggataccattgaacaaaaagccttatttttaagaccccgggaacttaaaaaaggtagtgtttcagcaaagtacaaagaagtcctgcagtatgtcataaatgcctattccgaaaaggaaattgatgaagcggaacaagaagctttaaaacagttggataaaattcccgtggatttagaaaaattagtggttaaagtcggaatggtgggcgaaatttacgttttacttgaaccaagcagtaactttgaaattgaagaaaccatcggccacttaggggcggaagttaagcgttctatgtttttaaccgggtggacccgggataataccttacccggaaaaagcgaagagttagtcagtgttaaagccgcagcaaaaccttatcttccagaattaatcggtggccacggtcaggattcgattggaaacgccattctttatataaaacaaggatttgatggcttaattcaacttgctcctttcacctgtattccggaaattgtggcccgaaccatcttaaccaaaattagtcaagaacataatttcccgattttaacctttttcttggacgagcaaacgggcaaagccggaatggaaacccgtttagaagcatttattgaccttttaaaaagaaaaaaacttcaaaaacttagcaaaagctaaagggggcaagataaatggacctatatcttggaattgatgtgggctcggtaagtacaaatcttgttttaattgatgaagaaaataacgttcatgaaagcttatatttaaggaccagaggacaaccaattcgagtaataaaggaaggaatgcaaatccttaaagaaaaatatgaaaataaagtaacaataaaaggagttggtactacaggaagcggtcgctatttagccggcgttatcgttggtgccgatatagttaaaaatgaaattacggctcatgccatagctaccaccacttttgtccccgaggtccagacaataattgaaataggcggacaggactcaaaaataatcatcatccgggatggcgtagtaactgattttgctatgaataccgtttgcgctgctggtaccggttctttcttggaccagcaggcgtcccgtttaaatattcccattgaacagtttggcgaattagccttaaaatctaccgtcccggtgcgtatcgccggtcgctgtacggtatttgccgaatcggatatgatccataaacagcaattaggatacaaaatcgaagatatcatcaatggattatgtgaagctttagtaagaaactacttaaacaacgttgggaaaaataaagaaatccttcctcccatcgttttccagggaggtgttgccgccaaccgtggtattcgggaggcgtttgcccgcgctttagggcaggacattatcgtaccaaaacattataatgttatgggagcaataggagctgccattttagccagggaagcaaccaacgggcaaaaaaccaactttaaaggttttgccattgccgattataattacgaaactcgcagctttgaatgcacttactgccccaaccattgcgaaatcgccgaaatttccgaggaaggaaaagttattggtcgttggggaggtcgttgcccgcgctgggaggtaatttaggtaaaaccactgtaaattttgcccccccttcgggattattccgggcaaagatttgccccccatgggcttccacaatcgatttcgttatggccaatccaagcccgaagcctttactgcttcgggctttatctactttataaaacctttcaaatattttttccaaatcttgctccggaatccctggaccggaatccttgacgtgtatttggtaatctttttccccttcaataacttcaaactttaccttacctcctgctggagtgaatttcaaggcattgcttaagagatttcctaccactcgtaaaagcttgcttctatcgccaacaacctttccatcctgaacatttacttccagctcaagttcgattcctttttcgaaaaattgggttttaaatgcattaaaacaatcctgggcaaaattagctaaatctattttttcaaattttagtttttctctcccctcttcaatactggctaaatctaaaagctcatttgccatagcttttagtctttctgcttcctgtaaaatattttttaagtgctcttctcgtattttttcatctgttactataccatctaaaagtgcctcggtatagccctgtataatagttaaaggagttcgtaactcgtgggaaacatttgccaaaaactcacggcgattttgttctcttttattataagcaattatatatttttctaactgagcagccatttggtttatcgtttggactatgtcccccaactcatccttaccttgataggaaatccggtgactaaaatctctattggcaattttttgggcggcagttttgatttgcaccagcggttttgtaatggacgtggataaccaaaaggccaaaatcgttgccaaaataatcccgataattgtggaaaaaatattaattttaattaactcaaaaaaattaccactaatttctttaaccggtgcctgaagtaaaatggcaaataacactcgatcttgtaatatcactggaactcccgtaaataaaacatcctgttttaataacttactctctactctaaccgcaacttttttcccggaaagtaaattttttaccagctcctgcggaataatatcggcagcccacatttgacagctattttggggaaaaccggcacgaccggtacaaattattactctacctacagcatcggtcaatgtaatattagcatttaaatagcttcccataatctccatttgatgaaatattttttctatatctctttcggccactatatattcggcaagtttttcacccgctcgaaataagttttcctgttgctgcgaaaaatatttttgccccatataaatagtagtagtccataaaatagaactggtggcggcaaccaccagcaatactaatgcaagccaaaattttaatttaagagaattaatcaccgtttttcacctcaaacttgtaacctaccccccaaacagttttgatataggaagctgcctcttgcaacttttcccgcaaacgggtaacgtgagtatcaaccgttcgggcttcgccaaaataatcatatccccaaacattggcaagcaactgttcccgcgaaagagctttccctcgattagtaaccaaatataaaagaagatcaaactctaagggtgttagcactacttcttctccattaacctttacttctctggcctccggatgaatttctaaaataccctgctttataaccgaactcgcctctttttctgggataccagaactcctccgtaaaaccgcttttacccgggcaaccacttccctcggactaaaaggttttaccacataatcgtcagcaccaatttctaagcctaaaattttgtcaatctcttctccccgcgcggtcagcatgattataggaaccaacgaggttttacgtatttctttggcaatctccatcccatcaatctccggaagcatcaaatcaagaataattaaatctattttatgctcggaaaaacgctttaatgcctcttttccatcctgggcttccaaaaccagaaaaccttccttttcaagataaagccgcaatacttcccggattttttcttcatcatccaccagaagtattgttttcattttatttaaaacctccctttcaccaacttctgctttcattataacataatccggatattatttacctcagtttctcttccacggaatttctaatattttccttctgtttaaaagtccaggacattctggtaatggtttacaaaaaatctattgtctttttgttcgataccaataaaatcaactcgcggttgcagatgatacagaaaattttcatgaatataaacctttattgctttttttaaggacgctttctttttctcatttaccgtttctgagggagtaccaaaagaaatatccgaacgaaatcttacctcaataaaaaccagaaactcaccatcctgggcaacaatatctatttccccaccgcgaatttgataattccgcgtaagaattttatatcctttttttcttaaatactgttccgccaactcttcccatttttgccctaactctcttcgattcatttttccctccagtagtaaaaaacggaaagccaaaaggctttccgttacttcatgaaaatcatggcagcttgttgagcaattttagccagcggagttgggtaaacccctaaaacaattgttaccgccatagttattaatagggtaaagtaaatggaattgggaagagttattggagtttggtcttcgggttcatcccggtataccactaaaaccacccttaagtaataatagacggaaaccatgctcataattaaggccaacaaagcaagccaaccccagttcttaataatggggtagaacaggtaaaacttaccggcaaatcctgccagaggaggtattcccgccatagataggagggaaacaaccaaaaccgccgccattattggagaacgttgggaaaggcctgcaaaatcgcgaatttcttcctttccggttacattttcatatactgtaactaccgtaaaagctccaattgttgcaataagatacacacttaagtaaaacattatagccttaaagccagtaaaatccgttgccaaaaatccaactaaaatataccctgcttgagcaatactggagtaggccaacattctctttaaattggtttggggaatggcaaccaagttacctacaaccattgttaaagcggccaaggttgccagtaaacctacccagtgttctctaattcccggaaatgccaagtagaaaaacctaaagaagatggcaaaagatgccgctttggaaccggtagccaaaaaagcagtaaccggtgtcggagctccttgatagacatcaggagcccacatgtgaaagggcaccgccgatattttaaaggcaaaaccggcaagaacaaaaaccatagccaaaacaaaggccggacttattccattatttgttacaattgccgcaatatccacaatatttaacgttctggttagtccatagaacaacgataaaccgtacagtaagatggccgaagaaacacctgccaaaattaaatattttattccggcttcggctccaattgccgaatcccgcctataagcggcaagaataataaaggtaattgtcattagctccagacccaggtaaagcgtcagaaagtccgttgctgaaaccaaaatcatcatacccaatacagcaaacactgcaaagacgaaaaattcactgtaataaccgatcttttccatatatcttggagcaatggctgtaacaaaaacaccagctaacaaagacaaagctttaaagaaaatagcaactttgtcaacctgatacattccttcaattgccattccggtatgtttccaggcaatgggcatgtaaaggaagattcccaataaaccaatagtggtaagatagcctatacctttttgcagattgcggggggtaattaaagctaatacaaagagcaatatccccagggataaaactaaaatttccggaatcagcaagagataattgatattaacactcatttaaaacttcccccctatcgccattgttgcaccaagtttggccaggataggagcgacaccgctattaaccatatccatgattaaaaacggtagcacgccaccagcaactaagacaaaacctaaaacgaccaaaggaaccagttcggcacctttaatatcttttaagtggtcatactcttcccgacgaggaccaaagagggaataagccaaggcacgtaatacataaagagcagttatgataaccccggcaatagcaattaccgccaggaacttaggaatcattgcttcgtttttccagattccaacaaaaaccgtaaattccggtacaaagctaattaaccccggtagtccgagggaagccataccggccataactaagcctatagctaacttaggcgtttgatgggcaaggccacctaagtcaggtatatagcgggtatgagttttttcgtaaacaaaaccgatcatcgagaagaacagagccgccatcacaccatgggcaaacatattggcaacagccccgtttattccaatgatgtttaatgaggcgattcccaaaagcacgtatcccatgtgacttaccgaagagtaaccgacaacgtattttaaatccttttgagctaaggcaattaaagccgcataggcaacgttaaccgttgccaggatcgcaataatcggcgcccagtattttgcaccttctggaagtaaataaagagcaatcctgatcaagccgtaaccacctatctttttcaagaccccggcgtgaatcatcgatactgccgttggtgctccggcataaccatcgggcgaccaggaatgaaatggccacatcgataaaagagaaccaaagccaaagagtaaaaagggaaagattgttatttgaaaatctttgggaaaagcaacttttcctaatgcttcaatattcattgttggataacccagcaaatcgctgctctttacaaaaattgatattaaaccaaaaaggagaaaggcactacctattaaaaggtaaatagtaagcttcataccggcatattcttttgtaactcgcttggaacttccccaaatcacaaccatgatataaattggaataaccacaacttcgtagaacagcaagaagataaacaaatcctgagctataaaggtacccataacaccggcaattaatagtaaaaacagcacgaaaaattctttgggccggttattcacattccaggatgcaaagatagctgcaaatccaagaagattggttaacagtaacatcggtaaactcaaaccatctaccccgaggtaaaattgaacccctaaatccggaacccaattatacttttcgacaaactgaaagccgcccttggataaatcgtagctgaaaaaggcaaatactgataaaaacaaagctacaaacatggcaaaagctgccactgatttaatcgccttgtgttcatctttgggaataaaggcaataactaatgccccaatgatcggcgccaaaagggttgcagtcagtaatggaaaatgcattatttcccacctcccaagaatagcgatgcaaaggaggcatcaccaaaagcaaagtataaagtgatgacaacaattaccataaatattactaaggcataagtttgcaaatttccggtggttgtataacgcagtaccgctccggaaccacgggtaattgcccctataccattaacaattccatcaacgatatataggtcaaaccagtataaaattttccccatgccgtccacaaccatttggttaaaccagaggtagatttcatcaatgtaatatttgttgtaagaaagcttataaagaaccccaaatttttcggcaactttatccgggtcaatagcttttttcaggtacattaaataggcaagatagataccggccaaagccaccaaaaccgatactcccattaaaacataatccggttcagcatggtgaaactcacccattctcacccagtagccaaaccctttttctaaccagggaagcccgacccaaccccctacaatggaaaagaatgctaatattaacaaaggtaaacgcatattccagggagcttcatgcggatgattctcaggcttttccggtccaaaaaatgcggtaaagacctgtctaaacatataaaacgcagtcaaaaaggcagttaccagcgctaaccaaaaaagcggcgtataaatacccggagcttcatgggctgcttctttaactacaagtaaaatctcatccttactccagaatccggcaagaggtggtattccggcaatggctaaagcccctatgacaaaggtccatgtagtccagggcatctttttatacaaaccacccatttcgtgaatatgggcttttccgtgaagtgcatgaagaactgacccggcacccaggaacattaaagctttaaagtaagcatgggtcattaaatgaaacatggaagcggttaagcttgctgcccctaaagctaacatcatgtacccaagctggcttatggtagaataagcaagaattcgcttcatttccgtttgggttaaagcaatggttgcggcaaaaaaggctgtaaaaccaccaattatcgccacaacatgcatcgcggtaggtacggctttaaagaggaaaaggattcgacctaccaggtaaacacctgccacaaccatggtggccgcgtgaattaaagcactaacaggtgtgggaccttccatagcatcgggaagccagacgtgtagcggaaactggccggatttaccaattggacccaagaataaaacaaccaaaaccaaggttaaggttcccgctgaaacataattctggaagttaacggctttttccgcaagttcgggaatgtttaaggttccaaaaataagttgcagagacaataaaccgatcaataaaccaaagtcccctacccgggtggttataaaagcctttttagcagcttcccgggcggaatctttgtaaaaccagaaaccaatgagcagatatgaacaaagacctactaattcccagaaaacaaacatctgcagcaagttactcgataaaacaagccccaacattgatgccgcaaacaacgaaagataagcataaaaactcgaaaatcccgggtctccttccatgtaaccgagggagtaaatttgtaccagtgaggcaaccagggtaactacccacagcatcatagccgaggtaggatcaagcataatccccacatctatcctaagacccggcatggaaaaccagcgggttgaataaaccatggatttctcaattaattcgggttgagtataaacaccatatactaccgctacggctaaaacaaaggaggtaagaatcattaaaatggaaaaggttgaacttgctttgggccatggccatagcaaaagggctatcaccgcaaacgaaattgccgggaggagcggaattaaccatgcattgtgcattgcaaactctaccattttttcacctacccttcaatagctaccattttaagaaattaaattcatccagggaaatagtttctttatttctgtacatagatattactataccaagacctaccccaacttctgcagcagcaaccgcaattacaaaaagggccattaactgtccgtaaaaaccatcaacacctatatatttgtttatggcaattaaatttaaatttacggcatttaacattatctccgttgataccagtactgtaatagcatttttcttggaaagaacgccaaataggccaattgcaaacaacaccgcacttaaaagcatgtaatgggctaaggtaatcatttctgcggcttcacctccagagccaagataatggcaccaataagagccactaaaagcaagactgccgcaacttcaaagggaattacaaacttcccaaacattaaatcagccagtttattaatggccatcggatcaactaaaggacgttcggctaagttccagggggttttaacaactacccaggataatcctataaaaaccaagaagctgataattgctccggggatggttaagcggttaaaaaggttggtttcgtgtaaatcacttcttttggttaacatcaccgcaaaaacgaccattattgagaccgcacccgcataaaccaccagctgaactcctgcgagaaaacccgcatctaacataaggtaagttactgccatcaagacaaaagttgcagctaaaaaaagcacgctgtgaacaatgttacgcataaagacaacccctaaagccgagaaaataagtaagaaagctacaatggcaaaggctataacctctccattaagcattttcgctcccctccccggtcgttatctcctctcttttaaaaagagttaattttatgtcttctatccggtactttgctaattcgtattcctgattaaaaacaagagcattagtgggacaggcttcaacacaaagaccacaaaagaggcagtatttcatctccatttcgtaggaagcaagttttcgcttgttgttttcatctttaatgctccccactttgattactttatttgggcaagcctgctggcataacccgcaagcaatacatttttcactgtggagggtaaatgaaccatgaaaccttggaggcagtttttccttgtgttccggatattctaaagtcaccggttttttccataattccttaaaagtaattgcaagtccctttaataaaccagtaccatttaactttgtcatttttatcaccacctaatcatccggtaaagatacaatccaaagcccgtaataaaaatattggctaacgagaccggtaaaaggaatttccaggcaaaatttaacatctggtctatccggatccgcaagaaagtccagcgggtccacatgtaaagtgtaatcacaaagtacattttgatgataaaccagagccaggaagggataaatgtccatccaaagggagcattccacccgcctaagaacagggtagtaaccattattgccccaatcatgaaattggtatactcagccaagaagaaaagtgcaaagttcatgccgctgtattcggtataaggtccggagataatttccgattccccttccaccaggtcaaaaggtgttcttttaaactccgcatttacggcaatgaagtatattaagaaaccaaccggttgtaaaaagataaaccaaaccttttgctgtgctgcaacgatatcggaaagcttcatcgaccccgccatcatcactacgcttaacattgctaaaattacgggcatttcatagctcaacatctgggcaacagagcgcattgctcccaaaagcgaatatttattattagacgaccaacctgccatccacaaaacaatggtttcaacggaagtaattgccacaagatataaaaccccgagatttaagtcgtagggtaccattcccttaccaaaaggaattactaaaaatagcataacgggaatggtaaatattaaaaccggagctaagaggtacggccagcggtcaacgttatttggaataaagatttctttcgcaaataacttcacggtatcggcaaccgtttggaaaattccccggggtccaacccggttaggacctaagcgagcctgtacccaggcaccaaacttccggtcatagtaaattaaaaataaggcgtttaggaataaaaacgctaaaacacccactaccgccagtaacattaaaaaaacatcggttaccaacggtacaaaatgttgactttccagccatgttcttaaacccttagccattcctacaaataaattttcacccatagactctctcccctactgttaaattaacagtccacatcacccaaaacaacatcaatacttgcaaaaatggtgataaagtccgccaatttagttccgattaataattcctttaacatcccaatattgataaatgaaggtcttcttacatgcatccggtaaggcttggttgaaccatcactcaccacatagtaaccaagaatccctttgggagcttctacttcgtggtaaacctcccctaccggcggttttataacctttggcaccttggccatgataggaccttccggaatcatctccagagcttgttcaattatttttaccgattgcctgatttctgccaacctaagataaaaacggtcccagcagtcaccgttagccccagtaggtatatcaaattcaaaacggtcatatacgctgtagggccgattttttcttaaatcaaacttatagccagaagcccttaaatttacaccaccccatccccaggctaacgctttttcaacggaaaccggtgcaagccctttagttctggcaagaaaaatctcatttcccgccaaaagtccttcttcttcatcaaccccatccaggattttgggcaggtattcctttgctttttcaataaatccttcgggaagatcgtcggctactccacctatccgcataaagctaaaggtcatgcgggagccagtcagcatttccaaaagttctaacactaactcccggtccctgaagggatacatccagccggtataacttcccatatccaaagacatactggctaaaaaaacgtggtggctggcaatccgagatagctctgtagcaataacccggataaattcagctcgttccgggacttcaattcccataagtttttcaatagcctgcacatatcctaaattgtaggacatcgcaccaagataatccatacggtcggtatagggaattacctgggtataagtacgatcttccgctaatttttcaattccacgatgcaagtaaccaaccactggttcggcatcgacaatggtttcaccgtctaactttaagataatccgaaacaccccgtgggtgcttgggtgctgcggaccaacgtttattgatatttcctgggtttttagcatttaaatccacctctacctgttggattgaaccttataatcctttcttaagggaaaaccttcaaaatcctcgcctaaaaacacccgggtcaaatggggatgattttcaaaaacaatccccattaaatcataaacctcccgctcctgccagtcagcagctggccagatggaaaaagctgaaggtatccggggattttctctgttaacgcttgtttttacggtaataatgtcatagttgtttaaaaaagattccacgtggtatacaatttcaaatctttccggcggataatcaacggcagttaaattggttaaaagttcaaaacccatatctttaatttcccgcaaaacgtttaatatttcatccttgtttttcacaataatagcatctttatttaattccacatcgtactttccatgcaaacggtcataaacctcattaacgttcattatcttttcaccacccggggattttgaatctttcttttaagttctaaccagccataaagaagggcttcaggccttggaggacaaccaggtatataaacatccaccggtaaaaaggtatttgccccggggacaacatgataagaatcaacaaacggtccgccggatatagcacagcttcccatcgcaatgacatatttcggctccgccatctgctcgtacaaccgtaataccagaggctgcatctttttggtgattgtacctgcaacaatcattaaatccgcatgtcgcggggagggtcgccaaacttcatatccaaaacgtgaaaaatcatactttggtcccccagctgccataacttcaatagcacagcaggcaagaccaaaggttaacggccagagggaattaccccgagcccagttaaatactgcatccaaagtagtgagaaagacgttcttcccaattaatttttcttcttcgctttgaatagtttttatttccattctaacgccccttccttccaggcataccacaagcctaaaactaagattccaataaatattaccatttcaacaaaggcaaacaagcctaaaacattaaaacggacagcccacgggtaaagaaatattgtctccacatcaaacaaaacaaataccaaagcatacataaaataattccctttaaactgcacccaggtcggtccaatagtttccagtccgcattcataagtctcccgctttatgagagacttacttttgggtgacagtaagtaatttaaaactaaaataattatggataagaagaaacccgtgagaaaaaagattaaaatagcaccttttgggcttagcacccctttccctccttcccttttattgtttatataaaaaatacataatacacccatttaattatattcaacataaacatcgcttataccttttcaaacagctttaattgtccataaaaactttttataggttcaaaacttttacgatgaatcggtgaagggcctaaaagctctaaagcttcccggtgttctcttgttaagtaccctttattttttttaaagccgtaaccgggaaaatctttatcgtactgttccataattttatccctgataacttttgccaaaatcgacgcacaagcaacggcaaacgaaatctcatcggccttaaccatggatacctgtttacccgaaaatccagtaagcttcagggcatccaaaattaacgcttcgggttttatacttaaactatcgagggcagctttaaaggcaaattttgtcgcttggtagatgtttaaccggtcaattaagtccggccctaccactgccacagaccaatcggttaccaaattgatgatttcctcaaaaagtttttcccgttttttcgacgagagttttttagaatcgtcaacttcgggaatataaatccccggtttaattaccacaatagcagccaccacgggccccgctactgggccgcgaccagcttcatcgcccccagcaaccagttcataaccggaagaaaatagctggttttcaatttgcagattaaaaggtaaattattgtctaatgttttcataaccaaggtaatattcgctattttatcgaattttccctgcaaaattaaattaattttaaagtaattttaaagttatatttttcacatttaatccagtgtatatttacctaagaggccctgacgaaattcttttaaaattaccaaagctactttttggtaatcaatttcctctccccgtaaaaataagcctcttctacgcccaattttttcataaatttcattgagattttccgaaccgtttaagttaaatctattaaaaaattccggtttacgataagtgcacagtatttttaatagccaattggcaacttcaataaccggtaatacttcgtcacttatggaaccagtggcgcctaactttaagccaacttccatatctcccaatttcggccataaaactcctggagtatccattaattccagtttatcggaaagtttaatccattgtacacctcttgtcacccccggtttggcaccggtttttaccgaacgctttaataaccgattgataacggttgatttacctacattgggaatcccaaccaccattccccgtaatggcctggggcgaagcccttttccggaccacttttctttatactgtccgtaaactttttcgataatgttccagacctcttttaaaccgcctgttgctttcgattcaaccaaacagtaataaactccttctggccagggaagtttttttaaaatttcttcggttttttcgacatcggccagatcttttttattgaacaaaacaattcttggtttatttttgcatatttcttcaatatcgggatttttactggacaaaggaatacgagcatctcttatctccaaaactacatccacaagttttacctgagcaagtaaggctttttttgttttgaacatgtgaccagggtaccaatttatcatcaaaaaggcttctcccttcttaaaaatttacaaatttacctacaatgaaaaaagggacgaatcctcgtccctttttatcgccgctcagcaattctggcagctttacccgtgagctttcttaagtagtaaagtcttgcccttcttaccttaccacggcggataacttcaattttttcaattcgcggggagtgtaagggaaatgtccgctcaacgccaataccgtaagaaacccggcgaacggtgaatgtggcacttaatccagagcctcttttccttataacaactccctcatagggctggattctttcccggttaccttcaataactttaaagtaaacttttacagtatcaccgggacgaaactcaggaaggtcttttcgtaactgttcttcttccaaagattttagtaaatccattactttttccctccttccggcacgttcatggagcccctgtccagcggaacgtttggtaagcgtaaaaattataacatttatttcttggccatgcaatagccttatttacaaaaccattcttcccccaaaaggcggtctaaaataatagctacagcgcttctaacacttaaatggttataatcggtaggtccgtatatcggttctaaaatataggtagcactttccataacctctcggaccagtccccacccggtaccaaaaagtaaaaggtacggattttcgtcatccttaatctttttccttaaaaaattataactcaccgtgttgggatataagcgcgcatcagtgcttacagttaatggttttttcccttcaattttttcaatatcaagcattacatcttctaaactatcaactaattttacaatacgaaacgcttccttacggtcgggattataactggccccgtagccctcctgccaaaagttcaacactttgtttattaattgcttcatggtagaggaaggatgcacaatataataattttttataccatacgtccgcgaagaacgcgcaatgtcatggatatcaagattggtaaccgatgtagtaacaacttccaaatgcttattataaaccgggtgatgaacaagggccaggtaaacattgcccaaacctattcgctcctttctggaatctcatcgattaacatcgccaattcaaaaaagccctgccataaaagaattttttcttctttggtaagcccccttacttttagtaaatcccggcgccgaaaaagagtatttagaagggattgtttttttcgccataaatctatttttttatgattacccgaaagcaagacctccggaacttccagtcctcggaaattacgaggacgggtatagtgaggatactctaagagctggtcactaaaactttcctcctcggccgatacttcatcacccaatactccgggaaccaaacgagccaccgcatcgataattaccatagcggcaatttcaccgccggttaatatgtaatcaccaatcgaaatttcttcatcaacaattaactggcgaactcgctcgtcaataccttcatagtgaccgcaaataaaaattaaatgttccttttgggaaagctcccgggcaagcttttgattaaattttcttccttggggtgaaagcatgatggtaaatgaattgttcttgggaattgcttcgtatgccttaattataggttcaactttcatgaccataccggcaccaccaccgtaaggtttatcatcggcctggtgatgccggtcagtagtaaaatcgcgaatattaatgtagtttattgttattatccctttttcttgggccttttttaaaatactgctgttaaggggtccgtaaaacatttcaggaaaaagagttaagatatctattttcattattttttttcctccaacatccccggcaaaagttcaaccttgataaaaccttcaggtaaatttacttctttaacgaataccttaataaaaggcaggagcaattctttatcatggatggtatcaataaccaacaaatcattagcgggattttttaaaaccgtacgaactacccctattttctggtaatttaaatcataaacggtaaggccttttaattgaaaaaggtaaaactcattttctttaagctggacaatttcgttttttgggattttcaggtaaccaaagattaacttatttgcctctttaatatcattaatttccataaattttaccaaaattcgctcggcctgtaattgcacctcttcgatacgcaggggaaaaatctcatcttctttttcccaaaataccctttcggtatttaaaaaccgctgaggatgatcggttaagggttctacttttacccatccctcaatcccaaaggttccaagaacgtagcctatagcaattaaattattcatttcccatcaccttttaaaaaaaaggggcaaaaagcccctttttatactatctctaagattactttctttttttctttcgaagctgcagccttaaccagtgttcgtaaagctttagcaattctaccttgcttaccaataatttttcccacatcttgaggtgcaacttttaattcaattaagattgctttttcgccttcggcaacggttactaccacttcatccggattatcaaccaatgattttgctaaaacctcaactaatcttttcataagtccacctctcggtgtctatttttgctgaaatttttgtaaaaccccggcttttctaaaaagagcgcgggcagtttcggttagctgggcaccttttttaagccagtccagagctttttcttcgttaataactactgccgccggctgcttcaccggatcataataaccaatctcatcaataacgcggccatcccgcggcgaacgggcatcggccactaccacccgataaaagggattattctttgcccccattcttttcaagcgtatttttactgccattatttcacctcccttattaggtttccaattgctattttatgaaaagaagggaaacttaatttttttgcctttttttaactgtttctccataccaccaaattgtttcatcaatttcttcatctgttcaaattgctttaacaaccggttaacctcttgaatcgaagttccgctacctttagcaatacgcttttttcggctaccatcaataatttccggctttcttctttcttcgggagtcatggaataaataatagcttcgatgtgttttagctctttttcatcaaccatccccgcaatatcttttactttacccatcccaggaatcattcccagtaattgctctaacggccccatcttctttatttgctgcatggaatccaaaaaatcttccaaatcaaactccctgctttttaatttttcctgcattttctgggctttttctgcatctaaggcttctttagctttttcaatcagggttaaaacgtcacccatacccaaaatacgggaagccattcgatctggataaaaaggctccaagttttcaattttttcacccattcccgcaaacttaatcgggcatccggttacagccttaaccgataaggctgcaccccctttagtatccccatctaatttggtaagaatcaccccggttaaacctaactcatcgttgaaactttttgccacatttaccgcatcctgaccggtcatggcgtccacaaccaacagtatctcgtggggatgaaccacatccttgattttctttagttcatccatcaattcttcattgatgtgcaagcgtcctgcagtatcaattatgacgtaattttttaagtttgacttggcaaaattaatcgaagctttggcaatatctaccggtgactgctctcccatcgtaaataccggcacgtcaatggtatcacctaaaacctggagctgtttgattgccgctgggcggtaaacgtccgcagctactaaaagcggtttcttcccctgtttttttaataaataggctaacttggcagcggtagtagtcttaccggccccctgcaagcccacaagcataataattgttggaggcgaaccggcatcatttaattttgcattggtttttcccattaaatttattaattcttcatgaacaatttttattacctgctgccccggggttaaactttccagtacttcatgaccaactgctttttcttttactttagcaataaaatctttgactacctgaaaattaacatcagcttccaaaagagctatccgcacttccctgagtgccaggttaacatcttcttcggttaatcttcccttaccttttagctttttaaaaacttcctgaagtttatttgacaggttttcaaaaaccatttcatccgctcccgctaatcaaataaatttttaatttcttcaaaataaggtaataaaagtttatagttatcttcacccagtaactcttgcattttcattaggatattattataccgggctattttttgttcattttttcttaataaaccgagtttttcttcaaaaatgtttaactgccgtatagcccgctgtaaaatgtcataaactccctgccggcttatttttaaatactcggcaatttccgctaaagaccaattttcgatataataaagttcaagaatttcccgttgtttttcggtcaataaacctccataaagttctaacaagcttccgtttcgggcaaattcatcaatcattttttcacctgtcaagtatttaacctttacagtagtattttatttatatatacttaaattgtcaaggaaaaaagaaggaggcaagaaaatggaacttattaccttggagcaagctttaaccttaacccgtcaggatatccgggacctctaccgtgagtacgttaacgaaagtttagcaacccttttaagtttattggaatttgataaacagtttgttaaagctaagggaacaaaagtttgggacaatgagggaaatatttatctcgactttttaggaggttatggtagcttaaacttcggtcacaatccagaggaaatctgggaagcggtaaaaatggtggaagaactgcccaatcttttgcaggcctcgataggtcagttaattggagcagctgcctacaatttagcaaaaataactcctggtaatttaaagcgggtattttttggtaattctggagcagaagctgtggaaggagcgctgaagctcgccagaatttataccggacgtccgggcattgtttatgctcacaattcttttcacggaaaatcttttggcgccctttccgttaccggtaggcaaaagtaccaaacaccttttacccccctcttacccgaatgctatcccgtaacatacggagatttagacgaattggagaatatcttaaaatccaaacccatcgcagcctttattgtagaaccaattcaaggtgagggtggcgttgttgttcctccgcaaggctatttaaaaaatgccttagaactttgccataaatacggagcactgttaatagtggatgaaatccaaaccggttttggtagaactggtaaagtctttgcggtagaatatgacgaaattgtccccgatatcatgtgtgtggctaaatccctgggcggtggagttatgcctgtgggtgcgtatataaccactgatactatctggaaaaaagcttacggttccaccgataaagcaaccctgcatacttctacttttgggggaaatactaaggcaatggcagcagtgatcaaagcaattgagcttttagtgaagtgggatttagcaaaaaaagccaaagaacttggggattacttattgagccagttaagttcactgcaaacctcctatcccctgattaaagaagtccgaggtaaaggtcttttaattgggctcgaattcaacgaaccccagggcttattaaataaaattcccgggctaacaaatctcgcccgggagtataccggcagctttgtcgctggactgttaatgaataagcacaggattattaccgcatataccctgaataatcctaatgtaattcgcttagaaccaccccttattgtagaaaaagaagaattggacaggttaatctatgctttaaaggatatttttgaaagccacagtagttttttaggggtagcatcggccaaccttaaaacggttatcggctccctttttaagagataacttgtaaaatgaaaaacttcaaataatacgtttcgggtgaggagaggagcatcgggtgatctttagcttgccgccgggcttcaataatcctcactctttttttggcatcaaacgccgcctcagaaatcacattccagaataaatcttcggttaaatgatacgaacaggaactggtgactaaaatacccccctcatttaaaagcttcaaagcccttagatttatctctttataaccccttatggccccaggtaaagcttctttacttttggtaaaggcaggagggtctaaaattacaatatcgaaatttgctctattcttttccagttcgcgcaggtagtcaaaacagttcgcctcgataaagaaaattttatcctgaaatccgtttaatacagcattttcctgggcccgggttatcgcctcggaagaaatatctaccccaattacttcttttgctccaaacccggcagcataaacggaaaaagctcccgtatgacaaaaacaatccagtactttttttccatggaaaaaaggttttaaagctaaacgattttctctctggtccaaaaaataaccggttttatgaccttcttttatattcaccgaaaatttaaagccattttcgttaattaccaccagttccggtacttcgccagctaagagtccggttgcaaggggtaatccctccttggtccgcaccggaacatcgcttctttcataaatacccctgggttttataacttccattaaggcctcaacaattaacggttttaatttttcaataccataagttaaactctgcaacaccaagtaatctccaaaacggtccacaattaaaccgggaatttgatcggcttctccgtatatcaaacggtaagcatcggtattggaaactaccgaggaacgatactgataagctttaattattttctttttaatccagtcatagtttatctcttcgtcgtgaaaagacattattcttaccgcaatttgagagttactattataataaccaattcctacaaaacggttattatggtccaaaacacgaactaattcccccggagaatacgggtattgagcggctaattcggttttataaatccagggatggcctctgtaaacccgatggtttctcccttttgttagacgtaccgtttgcactttatctaccccgcaactaattttaatccgcgtttatttgcttcaaatttaattttttcctcatcaaggcgtgttagctgtctcttttccatgataatttccccatcgacaattaccgtgtccacatcggctcctttggccgaataagcaattaagttaaaaatgttgtgtctgggataaaaattggtttcattggtattaagcaaaattatatcggctttatatccttccttaagtaatccaacttccgttaaccccagggctctggcacccaaactcgttgccattgcgatagaggttttggcgtttaaagcttctggattcatgctgcttactttttgtaagtaagaagccgcacgtaattcttcaatcatgtccaggtcattgttacttgcagccccatcggtgcccaatcctactaagaccccggcttctaacatttttgccaccggagcaattcccgatgctaatttcatgttgctttgggggttatgaatggcaccgacttgataacgtttgagaatctgaatttcctcgtcatcgacatgtactaaatgggcacctatggtttttacctcaaataagcctaagctttctaaatgtctgaccggcgttgttccatatctttccttgataatacttatttcatctaaagtttcgctaatatggatgtttatcggaacatttaatctttttgcttcccaaattacatcctttaaaaattctggaggacaggtatagggagcatgaggtgccaatgcggtagttatccgaccatttgccttcccctgccacttttcaataaaatctatactttccttaagtcccttttcgccgttttccggatctaaagcaaccatgccacggcttaatatagcccgaataccgctttgttcaacagcatgagcaacttcatccatgaaaaagtacatgtcgcaaaatgtagtagttccgctcttaatcatttccactattcccaggagacttccccagtaaacatcttcgccggttaagcggctttcactgggccaaataacattatttaaccagtccattaaaggaaggtcatcggatgctccccgaaataaggtcatggctacatgcgtatgaccattaattaaacccggtaaagctactttattgctaccgtcaattatttttaagttctctttatcatttacctcaatatcaacaccaattttcgaaatcttgtttccttcaattaaaatatcgttttcaaccgctgcaaacttatttaagtctaaaaccgtagtattttttattaggattgtcaattcattcaccatccccggtcaaaaaagtttttttagataattaatttcttccgaacttaaagtatgtgggttacgtacctttaatgccgctaagtatatttctgcacatttttctacaattcgacaaaggttaaagcagacatcaagattttctcccatggtaataagaccattgttggccagcaaaaaagcattattggcaaaagctttttcctttatttctaacaaataactttcagaatcaatataaaccgatttaagtaaaggcacgtcttttccaatagaccgtaccatttccggcaaaataaccggcaatggttcatgtaataccgaaagtgcagtacagtgtacggggtgagcgtgaatgatagcacggacatccggacgaacgttataaatttgccggtggagttttaaattaaactttgcttgattttctccctctaaaatattcccctccatatccacaattaagacatcaaaggtacttaagcaagccatatcgggagtaaggggagtaattactaccactttctcttccggtatatacacactcaaactaccccagttataaaacattaacccgtactggcaaagtttttgcgttgttctaactatcttttcctttaatttttcaacacttaacttcatttaaaccccttctctttaaccaaataaatattctttttggtcatcggttaacttgtctatttcgatattaagcgattttaatttatatagagcaactttttcatcaagttcgtttggtaaattataaactttaggtaataattcatcatgtttttccaaaagatacaaaaccgccaagagctgtaatgaaaaagaaagatctataatttccgccggatgcccttgtcccgcagccaagtttaccaaacggccttcggcaataacgttaagctgccggccatcagggaggatataaccggttacctttggcctcacttcgcggatttccactgccatagcttttaactcatcgaggttgatttccacattaaaatgaccggcattggcaagaattgcaccgtttttcattacttcaaaatgtcttccccggaacacatctttgcaaccggtaactgttataaagatatctcctattttagcagcggtcagcgaatcagtaacttcaaaaccatccatataggcttctaaagcacgaatgggattaacctctgtaacaatcacccgcgcaccaagtccccgggctttttgtgctacacctttaccacaccagccgtaccctgcaaccacaagattctttccagcaattaataaattggtagtagccatgagggccgtaagagatgattccccggtaccataacgattatcaaacatatgcttggttaaagcatcatttaccgcaatcattggaaatttcaaggcattctttttttccagaatccgcaaacgatggacgcccgtagttgtttcttccgcaccaccaattacgtttagcgccaaatccgggcgaacatgatgtaagatgtgaaccaggtctcctccgtcatcaataataatatcgggcttaatttctaaagcttttattaaatgttcttcgtactccgaaggcgtagccccatgccaggcaaaaacttctaaaccctcttcaaccaaggcagcagcaatctcatcctgggttgaaagtggatttgagccggtcacggcaacttctgctccaagatctcgcaaaattaatgcaaggtaagcagtttttgcctccaaatggatactcatcgtaatcttttttccggacaagggtttttccccaagcaattcattttttaaataatttaaaaccggcatgtaatttttgacccaattaattttttgctgccctaaaggagcaagctttctatccctaataatgctcataaaattctccccattcccctgttttttatttccctaactgactttgaccacttactgccctctgacaccagcagttccggtcgggatcaaggttctcaatagttttagcaataaggttctttaattgttcacttttagcggtcatcatttccacaacttcttcatgggttaaaggattaggtgaaataccagcagcatagttggtcactaaggaaattgaagcataacacatttcggcttcccttgctaacacaacttccggaacgctggtcattcccacaaggtctccacctaattttgcaaacatttttatttccgctgccgtttcaaaacgcgggccttcggtacaaacataggtacccgcaggatgtacggtatatcccaactctttcgcagcgttataaataatttttcgcaattccgggcaatatggttcggtgacatcggtatgaattacgcctcgttcgcccccatcataaaaggtataaatgcggtttttcgtaaaatcaagaaactggtcaattaaaacaaaatcaccacctttcatatttaaattcaacgaaccaacggcagtcgttgcaataatttgcttaactcccagcgttttcaacccccagatattggcccggtaattaataaggtggggtggaaccgtatggccagctccatggcgtggaagaaatgccacccttttacctgaaagttcgcctatcgtaacttcaatatcgccataaggcgtagctactttttctctggaaagattatttaacatcttcgggtcataaacaccggtaccaccaattactgcaatttttacagacattggaattcctccctgcggtttattttttaagatgaaaataacgcttcaacaaattcttgggggtcaaagggtcttaaatcatccattttttccccaaccccaataaattttattggaatttgataactacttttaatccctataattacaccgcctttagctgttccatccagttttgttaaaaccaacccggtcaaatccagggctttattaaaatactccacttgacttaaagcattctgtccggtagtggcatccaaaactaataaaacttcatcaggagcccccggtaactccctttctattactctttttacttttcttagttcttccattaagtttgtttttgtatgaagcctaccagcggtatcaataattaatacatctatttttcgggcaatggccgccttaactgcatcaaaagccaccgctgccgggtccgaaccttctttttgttttatcaccggacatcctactttattaccccagatttccaattgctctatggcagcagccctaaaagtatcgccagctgctaacaatacctgctttccttgttgcttgaagtagtaagctaatttcccgatagtggtagttttacctacaccatttacccctactaccaatattaccaggggcgttcttgggacattcttcagtttattgtctcccgcttctaaaatttttaagatttcttcttttaacacctgctttaattgctcactatcggtaatccgtcgttctcttgccgtttttcttagcttttccaccagctcaagacttggtttaacacccacgtcaccttcaatcaatatttcttccagtttttcaaaaagctcctcatcgaccgtcgactttttgaagacatcctcaattttagctacgatgttttgcttggtttttattaaactctcttttaaacggtcaaaaaatcccaaacttcctcacctgccattacattatcttttttcttaccctgctttaatattttccatgggaagcgaaagaactttggaacatccatcttgcatgctaatgccaattaactttgcacagacttccatacttccccgccggtgggtgataaggatcacctggtttctttccccaattttttttaagtaagcagcaaaacgctgaacatttgcttcatctaaagcggcatcaatttcatccaaaacgcaaaaaggtgacggttttagattaaacagggcaaaaagcaaggctattgaggccagagccctttcgccaccggaaagaagccccaaaggttggcgctttttccctggaagctccacaataatctcaattccctctttttgatcttctccaacaactttttctaaggcagcacgtcctcccccaaatagctctttaaatactaagtcatactcttcgttaagtaactttaaaaactcgttaaacctttgctccatttcttcggttaattggcttaaaagtttttctaattgttctttagcctcattaagatcatttctttgctgatttaaaaaattaatgcgttcttccaatcgcttaacttcatcaattacaaaaagatttaccgggcccaacccctgaatttgattgtaaagctcttcaatttccctttcctcaatataaaccggttctaattttaatacttcctcatctcccaacactatatcgtatttttcattcaataacaactttaacctgttgatttcctgtaaaaggttgcgctgttccgtttctaaacgcgaaatctcggcaaaatgtttttgtattagtttttgggtttttgtcagagtcgtttgcatttccgaaagtttatcctttaactcctcatgcttatttttaacagtttcaaaatattttttactcacagaaagtaaatccccatgggccgctatcttgcgctctaaagttaaaaaatcttttttaagatttaaaattttatttttaaactctaaggcttttttagcactgaccttctgtctttcaaagagttcttttttttggagacttttttcatttataaggttaaaaatattttccagcgccttttctaattgaacctgctgtaacgttagttcttgatagtaattttgattttcatatattaaatcattgattctggatatttccttttcaagaaaagcaatcttttcctctaattttttcttaagagaaataatattgttgatttgttgttccctattttctttttccactaacaaatttttcttttccctattatttttatctaactgcccttttagctcaattaacctactttctattaaattccttttatctttgatattttgttcttttaaatcggcctcagttagctgggcttctatgtcactcagcttttctccagttaattttattgttgcgtcaatatcctcctgtttttttaaaaatgcacttaatgcctcttccacttcattattcttttgtaaaagctcatcaacttgcttttgaagtaactttatttcattttttctttgtaaaaccgagacagtttgattaaaactaccaccaataataattccaccagggagcagcaattctccctcaagactcactactttataacgatgtttggtctttttcgcaatgattaagcaggattgataatcctttcctaccagaactttacctaaaaggctttcgtaagctttagaaagctcctggggaaacgaaattaaatcaagggcagtacctataaaaccatcactatccgttaaattgctgaagtcaccttttaaactttccgtttccagcaaatcaagggccaaaaaggttattctgccgagattttttaattttaaatatcttataataccttctaaatcccgagaacttttcacaataacattttttatccccgcacccaaagcagtttcaaccgctaatcgatatctttcatcaacttctaaaaactccccaacagttcctatgatattatccggattaggcagtaagccacttttttttgcctcaaataaattttttacgtcttttccgtaaccttcataactctcttcaagcttagttaatatttgtaagcgggtaatattttcattatattttttttccaaaacccttttttcgttttgcaggattaaaatatttttggctaataaattcaattcttcttccagtttctttcgtttattttttaacacttcccgctttctcagattttcctttttaaaatcgtttaagcttctcagagtattttctatttcaccaatttctctatttagttcatatatatctttttcaatctttaaagaatcgttagttaaccttgttaaggagtcagaaataaaattaatttcattccttaacgacacttcacgaaaatttaactcaaattgttcatctttacaattttccaagctcttctttaattccaaaagtttctcttcgtttatcccaagcttttgcttctgcactttaagatttccgataatctccctttctttggcttttaaatcctttacttgtctttggtacgaatttaattcttgatttatttcaacaagtttcctgccatttgctttaatctgttcttttaagcttttaagctccaaccagaggcgattttcttcttcttgttgatattttttgacgttgtcaagtttctctaaacagctttctaaatttaaaacaattttctgcaggttatcagaaaaaagacctaactttccttcctcggaaagaatctttgcaaaacttgcttccaggcggttaacctggtcctgattcttttcaataagattatgtaacagggtgattttttcttcgttttcccgaactttatccagtaaattttttatttttattccataataatttttagctttaaaggtaagtttttcttttaatgttaaatacgtttttgctttaataacatcctgttctttagcctgtaattggttagttaactcgttggtcaggtcattaagcctggtaatcccgttctgagtttccaacagctttttcttcgcttccaactcccgcatccgaaagcggttaattcctgcagcctcttccagatagcttcttttttcttccggtgacgaaaacagaatctcatccacctggccctgaccgataatggcatagccatgcttcccaagcccagtatccaccaataactcatgaatgtctttaagtcggcagggagatttatttatgtaaaattcactttctcccgaacgaaaaaagcgccgcgtaattgctatctcagcgtaaggcaagggaaaatgcttattactgttgtctaaaattaatgttacctcagccattcctaccggttttcttccctgcgaaccggtaaagattacatcctgctgtcgctcagaacgtaaaatctttgtttttgtttctcccaaagcccagcgaattgcttccgcaacgttacttttaccgctaccgtttggtcccacgatacccgttatcgaaggttcaaaagttatttccgttttttccgcaaaggatttaaaaccctggataactactttttttaacacatcaaacctccttctcgttttttaaaagctccagggcctttttagcggcttcctgttcagcttctttttttgattttcccctacccgtagcaatcagcttatcgttaataataactccagcggtaaaaattttttggtggggaggaccttcttccagtaaaatttcgtaccgcaaaacgttatttttttctttctgcaatagttcttgcaaagtggttttttcatctttgggtaattgttcaaggttttctggctttagtttttctccgtaaagcctggtaataaaactaaaggcagcttcgattccacaatcaaaataaactgctccaattactgcttctactgcattagctaaattcgacatcctttggtttcctcctgctttaaattcaccttttcccagacgcaaaaatttatcgagattaattttaaaagcaagctcgtataacgattcagcacaaaccaggcgggaacgtagttttgttaagtctccctcacttttttggggaaaggttcgaaataaataatcactaataaaaagctccaaaactgcatctcccaaaaattcaagccgttcgttatgctctataccctcttcgggatgttcaaaagcataagaaggatgggttatggcagaaagtaaaatactggggttattaaaattaaaccccagaattttttccaaggatattaaattctctttatccatgatatcacccgttaaatttttttacaattaaacttacattatgaccgccaaatcccaatgagttagaaagggcagcttttaccaccgtatcccgaccggtattgggaacataatcaagatctaatccttcctccggttcatcgcaatttaaagtagggggaacttgattgaaaaatactgccaaaatcgaataaatggtttctatccccccggccgctcctaacaaatgccccgtcatcgacttcgttgagcttaccatcagcttgtaagcatgatcaccaaaaaccttttttattgctaaagtttctactttgtcatttaatggcgtcgaagtcccgtgagcattaatgtaatcgatatcttcgggatttaaccgggcatctttcagggctaactccattgctcgggcggcaccttttccttcaggatcaggagcggtgatatggtatgcatcgctcgtaacgccataccccacaatctctccataaatccgtgctccgcgggccagggcatgttccaaagtctctaatatcaaaattccggcaccttcacccataacaaacccgtcccggtctttatcaaaaggccgggaagctttttccggctcgtcatttctcgtagacatagctttcatagaacaaaacccggcaaaagagagaggagttatcgctgcttccgcaccaccggcaatggcaacatcaacctcgcccctttgcaaacagcgaaaagcatcccccaccgcattagctcccgaagcacacgctgaaacaatcgtttcattggggccggttaagccaaaggtaattgctatctgccccccagccatgttggcaatcatcataggtacaaaaaaaggactgactcggtctggccccttctcccgtaaaatagcagcctgctcctccagagtttttatcccaccaattccacttccaataaatattcctgctctttcaggattaattttactgagctcaagccccgcatcttcgattgccaatttagttgccgcaacagcaaactgagtaaaacggtccatgcgccgggcttcttttttatcaataaattttaaagggtcaaaatccctaacttcagcagcaatacgggttgcaaagccagtggtatcaaaggaacttacttctctaacccccgatactcctttcattaagttatcccaattttctttaatcccaataccaagcggggaaattagacccaaaccagtaactacaacccttttcattttttcacctcttttaaaaaagtcccgggaaacaattccgcgggactttaaatttaaactctctcctgaatatagttaacagcatccccaacggtgcgaattttttccgcatcttcatcgggtatctctaattcaaactcttcttcaaaagccataattaactccacaatgtccaatgaatccgctccaaggtcgtcaataaacgatgcttccatagtaacttcatcttcttcgactcctaattgatccacgattatttttttaacccgctcaaacactcctgccataaattcacctccttcctacatcaccattccgccatccacaacaattgtttgcccagttatatagcctgcgccttcacttgccagaaacaacaccgccgccgccacatcatcgggggtacccagtctttctgcagggatggcgttaagcaaagcttcttttactttttcgtctaatttctcggtcatatctgtttttatgtacccgggcgcaacggcattaacggttattcccctgctggcaagttccaaggccacggctttggtaaagccgataatagcggctttacttgcagcataattggcttgaccggcatttcctttaatgccaaccaccgaactgatattaatgattcttccaaaccgctgttttagcattattttggcagcttcgcgggttacaagaaatgttgaatataaatttgtttttataacggagtcaaagtcgtcatatgacatgcgtaaaagaagtttatctttggtaatacccgcattatttacaacaatatcaattttgccaaaagtcgttactaattccttaaaaattctctcaacttcttctttttggctgacatcaccttttacaagaagaacttctgcacccttactttctaactcctcttttaactggctggccagcaaatcgttatgagcatagtttattccaacttttgctcctgccagagcaaatctttcggctattttacgtccgataccgcggcttgccccagtaaccaggacaactttaccgctaaaattcattttatccaacctccccggggttatcaagtaaaaaccgcaaactttcaagattatttacactaaaagtggcaaccgggactatgcgcttaattaagttagttaataccttgccaggacctatttcaataaatttcgtaacttcgaccttaaccatttccagcaccgactgctcccataaaaccggagaagccatttgcttagatagtaaatcctttattttcacaggatcagttaagatttcagcggtaacattactgataaccggtactttaggaggtaaaaactcaaccttttctaagtactcctgaaactttaacgcggcagccctcatcagggacgaatgaaaaggtgctgaaaccggaagttctacaatctttcgagcccccacttcctttaattgggtttttgtaagctcttttattttactttcaccggccaatacgtactggcccccaccgttaaagttcacgatttccatgataccatattcctggagtttttttaccgtagccacaagttcttctttttctatgcccataaccgcaagcattaccccttgccccaaaggaacagcttcctgcatcagttttcccctgacatgtacaagtctaactgcatcggcaaaatttattactccggcagcggtaagggcagtaaactctcctaaactatgaccgccataaattttagcttttattcccttttcttctaaagttacatacagagcatagcttaaagttaagattgccggctgggtattttcggttttattgagttcctcttcgggtccttcaaaaataattttagttaagtcataacctaaaatttcattggctaaattaaagtattttcgtaccactggtagttcatcatataaatctttgcccataccaacatactgggaaccttgacctggaaaaacaaaagcagttttactcatcgaattccctcacaatccttttcattatttctctcgcctcatgcataatttcttcaataatttccttaaccggttttatttcttttattaatccggcaatttgtcccgccatcagtgaaccttcttctatatccccttcctgcatgcatcgcctcaaacttcccgcaccaagtttttcaagttcctcgggaggagctcctttttgttctaactccaaaaaacgccgggcaagcttattttttatgacccgcacaggatgaccggtcgaagccccggtgataaccgtatctctgtcgccggctttaattaccgcttctttcactgctggatgaatttccgtttcttccgcacaaagaaaacgggttccaatttgtaccgcttgggctcctaaggctaaagcagcaaccaatccccgaccatcagcaattccaccggctgcaactaccggaatcgaaacattatctacaacttgcggtacaagggccatggtggtaagttctcctatatgtccccccgattcatggccctcagctatcaccgcatctactcccgttttttccaggcgctttgccaaggccaccgaagccaccactggaattatttttacgttattttccttgagtttttttatatacttgccgggattgccagcaccggtagttatcaccggaaccttttcttcaatgattacttccataacttcatctacatggggagaaagcaacattacattcaccccaaagggtttatcggtaaggttttttaccttccgaacctccgctaaaacccattccgccggcgcattacccgcacctataatcccaaggccaccggcattggaaaccgctgctgctaagcgcgcagttgccacccaggccattcccccctggataatgggatactttatctttaaaagttccgtaatcttcgtcttcaatttatcgccccccctaatattccataattaaaccgccccaggcaagccccgctccaaaaccactgagtaagagcttatcacctttctttagttttcccgcatgaatagcttcatccaatgctattggtatagacgccgccgaggtatttccgtaaagctcgatattaataaaggtcttttcaatatctaaagctaaacgttccaaagagttaacaattattcgacgattggcttggtgaaataaatataaatcaatatcgtccggttgtaatttggctttttcaagtaaaccgtttaccgactcttcaattttctttacagcaaatttaaaaacttcacttccattcattttaataaaatggagccttttttcgacagtttctgctgatgctggaagtttagacccaccagcaggcaattttaatagctcagcaccacttccgtcggctccaagttcaaaggccaaaatccccgctttttgaggatttacacccaatatcacagcacctgcaccatcaccaaataaaacagcggtacttctatcctgccagtcaactattgctgaaagcttttcagcgcccactacaagtaccttttggggatacagcactttagtatataaagctccggtaactaaagcataaataaacccagtgcaaccaatagacaaatcaaaagccccggcattggtagccccaatcttttcctgcaactgggccgccgttgcgggaaaaatcatatccggagtagcggtagccacaattattaaaccaatttcccctggttcgatttttgccttctgtattgccttttctgaagcatagtatgccattgatagggtagtttcttccggggaggcaatacgcctttccctgattccagttcgggttactatccattcatcggtagtatccaatcttgactcaagctctttgttcgttaaaaccttttctggcacataataccctgttcctaaaatttcaatgccttcaatccttccagacattaaaatccccctttatcaattcagctaaaaaaccggattcaacggtctttgtcattacttttaaaccattgcgtaccgccagtcgccgggagcgcccgtgggcaataaaaactatcccgtttacccccaaaagcggagcaccgccatattctgcataatcaagacgcttttttattttttgtaaagactctcttaaaataaatcccccaagactcccccttaaaccggtaaaaacctcatttttcaaaagaacaaaaatactttctgccagtccttctccagttttaagaacgatattaccaacaaacccatcggcaacaattatgtccgccacacctctaaaaatgtccttcccttcaatattccctataaagccagaaattttttcctttaaaatgggaaaggtcttttttatcaggtcattaccttttccttcttcttctccgttacttaacaacgccacccgaggattttttatttggtacgcagtttttaaataaacctgggccatgaccgcaaattgaaaaaggttttcaggtttgacatcaacgttggcaccagcatcaattaaaaacgtctgcccggtcagggtgggcagcggggtaataattgccggtcgatcaattccgttaatcttacccaagcatagcaccgccgaagccatcaccgctccggtattgccggcagagaaaaaaccctgagctactccttcccttactaattgaagacctttccataccgagctttcctttttctttatcgcaactgttggtttttcttccatcgttacaacttcgtcggcatttattatttcaatataaccaagggattttcctttttttgttaattccttttttatttcattttcccggccaaccaagacaattttctctccggtttcttcaacaaaatcctggacccctaaaactatttcccggggagcataatctccccccatggcgtcaaccactaacaatcctaaccctcccttgaaattttaaaaaccacaaatcttccaacataaacaatttcattttctacattgcccacaacttttatgtaatatttattttgtttttttacccgaaccaccgcggtagcaataaccttttgacccaaatatgccggttttttaaagctcacccgggcaatccccgtcaagacatttttacccggacacaaagcaactgccagagagtttgcctgggcaaaaagaaagtgtccgcgagcaatatttccatccttaaagcacatttccggtgtaatttccaacattgatgccgccttttctcccggttctaataaaagcaaccgtccaataatatcctctttggcaagcgatgttaaattttgataagctcgttgcgccatcatttcaatacgttcccgttgttcggggatagctaaaatcatccgatccaaacggatagtctgcacacttacccctaaagttgctgctaattgttcatcagtcaaaaaagggtttttttcaattatttccagtaatttttttcttctcgcttccggagacttattcatttaacaccacctattattacctgctactatataatagtttaacttatccccgattgtcttgcaagtaaaaaaaaatctccagttgcaactggagatttttggctattccatattcacaacctgccggccatcataatacccgcagtttttacacacccgatgaggtatcattaattgatggcagtggggacagcttacaagtttaggagcagcaatcttccactgcgaacgccgtttattttttcttgcctttgacacccgtctttttggtactcccataccttacacccccttttgcttttctaagagctgttttaacggcaacagccgaatatcgatttcttcatgcgaacagctgcattcccgctcatttaaattttcaccacaaaccgggcacaggcctttacaatcatgatggcaaacaggtttcaaaggtaaatttaataccgtttcttcaaaaaccagttcatcaagatttattttaaaatcaaccagagcataactatcctcatcagcaactaacttatataaacgttccacaaaaagatcaacttttagctcgatattgctaagacaaaggctacagttggtatgaacttccccggttattctcccttttaaataaaacccatcattggtattttgcacggtgccggtaattaaaaaaggcttatcgctggtaaaattaccaaagccctctcccagcgtttcaagattaattttttcggcaaactccagcacgacatttttgtcattttttatggaagttaaatctaagtacatctttaaaacccccaataacaagtaacattataaccggggtaaaaaatactgtcaactattttacttgttaactaccagttcaagggtttctttagcgatcatcaattcttcattggttggaattaccatgattttcactttcgagtccggagtagaaattattgcttccttacctcttattttatttttctcttcatcaagggttgccccaagaaactccaaatatttgcaaacttccttgcgcaccacatccgaattttcccccacacctgccgtaaaaactatggcatcaacgccattcatggcagcggcataagccccaatatattttgctacctggtaacaaaacatttccagagcaagcttagctttatcatccccggcagatgccctttcctcaatatctctaaagtcgctgtagccagatattcctaaaacaccgctctttttatttaaaatatcattaacctgagcggccgacaatccttccttttcttggataaaggtcacaatagctggatcaatattccccgaacgggttcccatcagaagaccctctaaaggagtaaaacccatagaagtatctatcgatttcccttcttttaccgccgccacacttgaaccatttcccaggtgacaggtaattatttttagttcatttagtggctttccaaggatttctgaagctttataggcaacgtacttgtgggaagttccgtgaaaaccataccgtctaatcccgtatttttcataccagtaatacggtacgccgtaaaggtacgctttcctgggcatggtctgatgaaaagccgtatcaaaaacacccacctgcggagtatttggcaggagtttttgacaagctcttatgcctaaaatatttggagggttgtgcaaaggagccaggttaacacattcctcaacagctttaaggatttcttcattgataataactgagccggaaaatttttctccaccatgcacaattctgtggccaatcgcagtaatttcttctaaattacgcaaaatgccgtattcttcccgtactaactcttctaaaactgcattaattgcaacctcatgattgacaaaaggttgctcctttttgattttttcccggccgggaagatcaattattaaccgcgaaccttctaacccaatcctttctaccaagccttttgctaataccgtttccttctccatgtccagtaactgatatttaagggatgaactaccgcagtttagcacgagtactttcacaaaatatgcccccttttacgaaaatttaaaagcgccaaaggcgccttaaataccataatatgattgaaccgcagttatagctaccaagtttacaatttcatccacactacagccccgggacaaatcatttaccggcttggccataccctgcaatattggtccgatcgcttctcccccagacattctctgagcaagtttatatcctatgtttcccgactgcaaatcggggaatatcaaaacatttgctcgtccggccacttcacttccaggagctttctgggcacctaccgcagggacaattgccgcatctacctgaagttctccttcaatttttaaatcgggtcggagacgattggcaattcgtgcggcctcccgcactttttcaaccaactcatgttcggcacttcctttagttgaaaaagataacaatcccacataaggagttattcctaacaacttttgcgcagtcatagctgatgcaatagcaatttccgctaactgctgggaattaggatcggggttaacagcgcaatcggcaaaaagcattattccatgctcgccaaattgcggattaggaattaccataataaatgctccggaaacaactgaaaactccggcttggtttttattatctgtaaggccggacgtaaaacattgggggttggacttaatgatcctgccactaaaccatcggcatcttcagctttaaccataagcgttgcatagtaaaggggatcatttattagttcatacgctttttccaaggtcattcccttattttttctaagttcatacaaaagattagcatatctatcccggttattatcttttaacggatcaatgatagtaactccattaagatctacatttaaattttttgctctttcggcaatttctttttcgttgcctaataaaattattttagctaattgttgattgataatttcactcgaagctttaataacacgatcatctttactttccggaagtacaattgttcttttaaattctcgggctttgcttttcactttttcaataaaatttaacataaaaaagcctcccgacttttttcaacattatttttaccaatttatttatatcatacccaataaagtttttctatccaaaatattaaattttaaatttttttatatttcttatatttcagactcaggagtgaaaagctttgtggttattagtaagaaaaaataaagcctggttattatttttgttttttcttattttcattttaaacccaatggcagtttaccagggtgcaaagtccggggtagacctgtggctgcaaatcatcattcctaccttacttccttttttcatagtagctgaacttttaaataaaaacgatgtgtttttaatgcttggttccattttcgagtttattttaaggcctcttttcaacgttccgggagttgcagccctatcgattgttatgggatttatgtccggtttcccggtaggcagcattgtggttgcaaaccttagggagcaaaagttaatcacccgggaagaaggagaacggcttttagcgttcaccaataacgtaagtcccctttttcttatatcaaccgtaggcataacattgtttaacaaccccctttacggttcatttttgttaatcggccattacggtgcaagtataacaataggtttgatcttgggaattggtgcacggagaaaaagagaaataagtaaatcgacaaattttgcgatcataacttcttcttccaatcttccattcggcaaaactctccaagaagccattgaaactgcttttcacaaaatatttttagtggggggctttattatcttttttgctgtggtaatatcgttagccgaaaaaacttttttaccaaattccggaataataacagccctttttgctggtttcttggaaatttccaacggaataaaaaaaattgcggagttaaatttcactccgctaacaaaatttatcttaacgagttttattttaagttttggaggaatttcagtactggcccaaattatagccctaatttccagaactgatttaacagcaaagctttacttaaaaacacggccactgcacggtctattaagtactggaatttcaactatgcttttcttaaaagttaccatgccggttgctacaggacaaaattctccaattttaaattccccaaaacttttgtcaatttcagtagtttcagctttggtattttacctttttcttcattttttaaaaaagctttcaaaaaaatttatttcttaagttcttcaagaccttttgttacttcctgtaaagcggcatttaaattaaaagccagcttttccaaaacctctaccgcatactgccgcgccccctgctttaattcaagggcggtactattggcttttgcaataatctctcttgctctttcctcggcaatcttaagcatttccgattcgcttaaccacttttccccttgctgctttgctctttccaaaatctcctccgcctctattttagctttggctaaaagattttccctggattcaagaactcccttagctttacttatttcatccggcaagatactcctaattttatcaatatacatcagcagttgttcctcatccattaaaacttttcctgttaagggaattttaggactatcaattattttatcttcaagctcctctaatattttcaatatatccattcattaacacccttccttctgaaatttttcccttaattttaattcgacatattcaggtaccaatccttttaaacatcctccatacatagctacttcctttacagcacttgaacttatgaacgaatattctgctttggtcattaaaaaaatagtttcaacccacggcaccaactttttattggttaaagccatcataaattcattttcaaaatccgaaatagctctaagtccccgaattataacctgagcgtttttggcttttaaataattaaccgttaagccctcaaaactatcgatttcaatattagggtaatatttcaacgtttcccgcaacatatccaagcgttcttccagggtaaataaaggttttttcattggatttttggcaatagcaacaattaaacggtcaaaaagctcggccgctctttcaataatatccagatgaccgttggttataggatcaaaactacccggataaactgctatgcgcaaattattctccccctcgctttaattgataaaaccccagtaacgtattcccgtatacagcttcccttatcaaccccagcttttcagagcttatatttaaaccaattttttttgccgtttcaaccacgataagaccggtttcttttagtaaccctaattgtaaaatagtcaataccgccctttcttcaaaaccatatccgtagggcgggtccaaaaatatcaaatcaaacttctcattaatgtggggtaaaattttaaaaatatctcctaaaatcgcttttgcccggtccccatagcctaaattttcaatatttcggcgcaaacagctaaaagcttctctatcggcttcaataaaataagaaaacttagccccccgacttaatgcttccaagccaaggtttccggttcccgcaaaaccatcaaggacaaccgcatctattaccctataccctaaaatattaaacatcgcttctttaacccggtccgaagttggtctggtttttaagcctttaggtgcaattaattttctaccccgggcatctcctgttattatcctcattttttaccaccatcaatgtataattttaatgtttggcggaaatactacctaatgctccggaagagagcaaattctatacaccctcccccatttgctcttcctccggtttctcctctctttgctggcgtaatgccagcattttttttaaagatactgcaaaatatcttttatcctaatttcataattttcttttttccaaaaaatattcttaggataataatttacatttagttttggttttacagcacgagtccaataaggagttaaaccatactcccttaaatataataaatattcccggaccaaagcatcctctcctaaattaacaactgccatgcgaattgtttccgtttcctcggtagttggaatacaataaaaactgcggcaaacaaaaggccgaaaggcataaatttcacattttctatctttttcatttaaaaacacacaagctccattttcatttctttttaaaattatatcaatttcccaacctttaataaatatttcagtataatctcgtagaaaatgataaaggtcaatattttgtccatttttttcccctaatcctcttcgaagcataataacatcaacattagttaaaggaattctttcataacaacattttatacagttaagacaactttttgttcctgcttcccggtaatattcccctgcttctacaaggttttccaacgctttaaggtagtcggtaacggtagcatcgggatctatttttaaagcgtaccctcttaaattggcaataatttttgcgataatttccactttttgcaagaaccctttcctcccttataaaatttcttcctttgtcacacactactcgctgaggtgataattttggcaataatggagcttcttaatactttaggagtaacaattgacatggccgttgaagcccacgaattattaagaggtgaagcggggattgaaattcccggagttaaagtgattaaagataaaaaggaaaattatgaaataaccaaagttgaaattctaaacgagcagggtgcagctcacttgcaaaaacccatcgggaattatgttacaattgatgccccggtgcttcgaagtcaaaacagaactgcccagaaagaaattatgttggccttggcaaatattctaaaaacaatgctaacaataaatgatgagcgacccatattaatagtagggcttggaaactggcacgccactcccgacgcgctgggcccaaaagtggtagacaatattttcgttacgcgccatttgtttaacttaaaacatgaagccctgagcaagggttttaaaaatgttgcagctatttcccccggagtcttaggtattacaggaattgaaacggtagaaattgttcaaggcattgttgaaaaaatcaatccttcctttgtaattgccgtagatgctttagctgccgccaatgtagaaagaatttgttcttctattcaaattgcagatacaggaataaatccaggatcagggatagggaaccaacgtccaggattaaatcgtgaagttttgggaattccggtaatcgccattggctgcccaacggtggttaacgcagctattatcgccaaaaataccctggaaatgtttttagataaattcagttcatcaaaacaattttaccaatttttaaaagccaggcaagcgggaataattaccttagtccgggaagttttagagccatttactaataatcttacggtaacaccaaaagaaattgattttttattgttaaatcttgctaaagtaatagccgggggcattaccatggcagtacacgaaaacgtccagccggaaaatgtggaaatctacttaaattaaaggggacaggaggttaaccccctctgccccacaaaaagttagttagacttttccagaaagctgttgctccgcttgctgaattaattttttgaccatattgccccctaatctaccccattgttttgccgggatatcgccaccatattgtcccggctgaacattaactccaacttcccgggcagtttcccattttaattgttctaaggcttgcttggcttgaggtactaccacttcatttcgtgccattttttatgcctcctttttaggtagtaggaaattgaccacttaactgggattccgcttgctgaattaactttttgaccatattgccacctaatctaccccattgttttgccggaatgtctccaccatattgtcccggttgaatattaagcccaacttcccgagcagtttcccacttgaactgctctaaagcctgtttggcctgaggcactataatttcattccgagccatctttatcacctccttttctggattggtactcttattttttctcggttaattttttttatgcgagtaagattaatcctcaactggcttgatattctcatttccggtattttttgtttttaaaataactttgtttacgtcaaccccgacttcattggccaattcaaacataaactgccggtgttcgggagtaagctcaaaattttttttagctttcttaggcattttttcacctcctcttgaaaattagtttttattcagcaccaaaactttataacaagaaaacaaaaattttatcggtatttttatttgtaaaattggtaataataaaaaaaaattacgggaggaagcaaaaatgaaagaaaaaaagacatttaacctttaccgcgacgtctatttactggacgataaattttttgctgaagttaacagaaatgaagctaagaaaaaaaacttggagcatgaaaaaaggcagaccaagtaacggtctgccttttgttaatttttttgaagcatattaattttatctccatatttctccaaagcaagggtaataagcgcacgatgattttccttattggttaagatctcatctgcttcctttttagctaaaaacaatatggcttgatctcgcacaatatcggcaagtttaaattcccaggcccctgactgacgggttccgctaagttctcctggccctcttaatttcaaatcttcctcggcaattttaaatccatcattgtatttttccataattttcatcctaacaataccttcctgatttctggggtttcctaaaagaaaacagtaggattgatgctcaccccggcctacccgaccgcgaatttgatgaagctgggctaaaccaaaacgccaggcatcctctataataataacattggcattgggcacatcaactcccacttcaattaccgtagtcgaaaccaagatttgaatattatttttacggaagttttccattacctcttctttttccgcaggttttaaccgtccgtgcattaaaccccacttaaactggggaaattttttagaaagcttttcgtaaagcttagtaactgcctctacttggagcttttccgactcttcaaccagggggcaaaccacataaccctggcgtccttcagcaacttgctttaataaaaaggcgtaagctttacctttatcctgagaagaaagccaatatgttttaatcggttttctccccgcaggtaaagcatcaacaatagaaacatctaaatcaccgtataaagttaaagcaagcgtacggggaattggggtagccgacataactaactggttaacatataaccctttttccacaagactacttcgttgttccactccaaaccggtgctgttcatcgatcacagccagccctaaattatcaaaaataacagcttcctgaatcaaagcatgggttccaattattacatcagcgtacccatttttaatggctttataaactgcttctttcttgcccgatgataaactccccgaaagcaaaactacctttatcccgagaggagcaaaaagacggcttaagttcaaataatgctgttccgctaagatttcagtgggcgccattaaagccccttgaaaccccgcttccactgctttcaccagagcaagggcagctaaaatggttttaccgctccccacatctccctgcaccaagcgattcattggttttttagctgctaaatcttcttttatttctctccaaaccttctcctgggctgaagtcagtttaaaagggagcgaatcaataaattttttctctaactctccacttcctgcaattacaatcccgggctttttctgataattttctttatataatccaatggccaggaaaaacaagagaaattcttcaaaaaccattcgacgtcgcgctaattcggactgttcgctgctttccggaaaatgtaaattcattaaagcttgcttaaggtctggcaaactatatttccttaaaatttcctccggtaaaggctcggtgatttcctcaagatatttgtcaagagcatttttaattaactggcgaaatgttttgggggaaaggttttccgttaacggataaattggtactaagcgattggtatggagtaattctttatcccaaaattcatactcataaacataaatatttgtttcgaaaaatctcttttcaacttttccgtaaaaataaactttttttcctttaataaaaacattttttagataagactggttaaaaaaacaaccataggcagtaccggaaccgtcgttaatcccaacttttaatatttttaacttgtccctgggtataacttctttcacctcaactacagttcctaataccgttgtcacttcatcattaattaattcacttattttttttaaagaactgcgatcctcataacgtttcggaaagtagtaaattaaatcttttaccgtctcaatttttaacttttgcaaaagtttggctttttgtggccctacgccttttaagtactgaaccggaatatccatagcaaaactccttatccttactcttttagcattttctttggtatcaattttccattgccccttgcaaaacctttagctttttgatatcttttacatgtatatattttagcacagtaagagcaggaggtgtactttatggctaaagtttgcgaaatctgcgggaaaggcgtagtttatggtcatcaaataagccattcgaatattcatactaaaagaaaatggctccccaatttacaaagagtacgggctgttgttaatggaacccgaagaagaataaccgtttgcactacctgcctgaaatcaggtaaagtacaaagagcatagaataaagtcgtgcaaaagcacggcttttttctttaaaaaaaaacgccaaaattggcgttaggtatttttttctttatattcttttatttcttttcctgaaaaagtgtatttttctctacaaaaatgacagaccgcttcaactatttcctcatcttttacctcagagtaaagtcctattaaatgaggtaaaagcttttctctgctgcaactgcataaaaaaccaacaggtttttttacgtaaatttcggtcttataaggatttaccacttcttgaataatttcttcgatatgtttaccttgctgtagttgataggttagagactgctgttctcctaaattttgttcaagagtactaattatttcttccggtgctcccggcaaaatttcaattaaacatcctcccgcctgagcgactgaaccatcgggattaaccaaaactcccaagttaaaaacattgggcctttgttccgagtaatacaaatagtaagccacatcttcggcaatttctccagacactaattgcacggtaccggtatatggttcctttaatcctaaatcctttgttacgtataaatgacctttgcctattccccgtcccacatcaagtttgttggcatcattaagtggcaattcgacttccggattaaacaagtaaccacgaaccatgccatcatttcccgccgaacatactatcccacctaaaggtccatcaccaaaaattctaagggttaataaatcaccggggttttttaaatcggatgctaaaataatcgttgcggtcagggcccttccaagggccgccgtcgccaaacgggataagttatgccgttttcttgcttcctcaacggtttgcctactactaactcccgtaaaccttataaattcccctgccataccttttactaaataatcgctcaatgttactactcctttcttaaatcacctacggtttttactacgttgcctgtaacaatatcaattatttttatatcccggtcaattatcgcaattgttggtacaggctcaaaacctttgggaagggatggtgaacctggattaagcagtatgcagttggaaaacttttcaatttgccaaacatgggaatgaccatgaataactatatcggcaagctccaaataattttcttttaacttttcaaaatcatgaacaaccatgagctttttaccccgatattcggttaagaaaaaaggggaaaaaaagggaatccccaggaatgtttcatcaacttccgcatcgcaatttccccgtgcaatataaattttttgcttgatgctttttaaatattttgctaaaccggccggatcatagccttccggtaatgggtttctcggcccatggtataagacatccccggcacaaaggataaattcggtatctttaagaaaatcgtaagctttgataaatctttgtaaacttccgtgaatatcacttataaccccaattgccaaaccaaaccctccagtttatactttcttaaataaatttgccatttcaatagccgctaaggctgcctcccagcccttattcccggcttttgtaccagccctttcaatggcctgctcgatggtatcggtggttaatacgccaaagattaccggcttgttagcctccaaaccaaccgcagcaattcccttggctacttcagccgctacataatcaaaatgaggagttgctccgcggattactgcccccaaacaaataattgcatcataatctttgtgaactgctcttttggcaactaatggtatttcaaaggccccaggcacccagataacatcaatattggtgttttctacttcatgccgggtcaaacaatccaaagctccagctaaaagcttttgggtgataaattcattaaaccggctaacaattattccaatttttaatcctttcccgttaagctttccttcaaatacctgcattttttattcccctttcctttagttttcagttagatttaagagatgtcctaattttttcttttttgtaagcagatactttttattttcttttttaggtggaatttctatcggtaccctctcaacaatctctaaaccatagccttcaagccccttaattttcttaggattatttgtcataagccggatttttttaattcctaaatcggctaaaatttgcgcgccaattccataatcccgcaaatccgctggaaaacctaacgcctcattagcttcaacggtgtcttttcccatatcctgcaagtgataagcttttatcttatttgccagcccaattcctcttccttcttgacgcatatataacagtactccgcgtccttctttttcaatcattttaagagctgtttgcaactggtctccacagtcgcaccgtaagcttccgaaaacatcaccggtaagacattcggaatgcactcgcactaaaaccggctcaccatcagcaacatttccttttactaccgccaagtgggtttgatggtctaaaagactttcgtaagcaacagcaacaaattccccgtattttgtaggaagcatggcaaaagctccccgttctaccagcttttcgttacgacgacgatattgaattaatgaggcaatggtaatgatttttaaattatgtttttgcgcaaattccagcaaatccggaactctagccatctgtccatcgtcacgcataatttcacaaatcactcctgcaggatacagtccggccagccttgccagatccacagccgcttcagtatggcctgcccgccttaatacccctccttcttttgcccgcaggggaaagatatgtccaggccggcgaaaatcctgcggtcgtgcttgcgggtctattaattttaaaatggttttagctctttccgcagctgaaattccggtatgggtatccacggcatcaaccgacacggtaaaggctgtatgatgaggatcggtgttttgcgttaccattattggaatttctaattcatccaagcgctttccttccataggaacacagataagacctctaccgtattttgccatgaaatttattatttccggagttaccttttctgcggcacaaactaagtctccctcattttcccgatcttcatcatcaaccacaattaccattttcccctgttttaaatcttctaaagcctcttcaatggtgttaaagcccatttatttctccccctatcttttataaaaagccatgttcggccagaaaatttaggtctattttacgggatgctccctgtttttttataaaactaaaaacatactttgctaaaatatccgcttccaagtttaccggagaaccaattgttttatagcctaaagtagtatttttaaacgtatggggaattattgagacagtaaatgaatcgttataaacatcaactaccgtcaagcttatgccatcaaccgcgaccgacccttttggaaccaaatactgtaaaaaaccttcggaagcttttatttttattattttggcaatttcttttgctcttatttcaactatccaccccacttcatccacatgaccttgaacaatatgtcctcccaaacgatccgtaggccgtagagttctttcaagatttaccctatccccgggacttaagaattttaaatttgttttagtataagtttcgggcataacatccgcctcaaaataatcgttgccaaaattgaccaccgtaaggcaagtaccgttaacagcgatgctatcacctaattttatatcttcaagaattgtcttggcttcaacggttaatgttaacgactctccgctttttttaatttcccgaactcttcccagctcttctacaagacctgtaaacattttaccctcctgaaaaatagccttcaataaaaacatcttccccaaaacgtcttaacttgtgtattgctaacggcaaggcatctttcattaaacttatttttaaatcaccaattggtccgggagcatttttccccccaactatcttgggtgcaataaagatatatgctttgtccgcaagtctattttgtagtaaactcgcatggaccactgctccgccctcaaccaaaattgaaatgattccaagcctggaaagttccaaaaaagcctctttaatgttaatcctattttcccctaaaggagtagttataatgtgaccaaatccgttgcttacatgttttggtagttttttactggcggtaattaaaatatttttctccttttcaagttgaaaaatatttagaccttccggtaaatttccacttccagataaaactatgcggtagggatttcgcccctgaggtatccgacaagttaacagtggattatctataattaaggtctttgctcccaccaaaactgcatcatattcattccgtaacctatggacaaaactccggcttttctcaccggaaacccaacgggagtcataagtttcggtggcaattttaccatcaaccgtcatcgcccattttaaagaaataaaaggtagccccgttttaataaacttaaaaaatttttcattaaggtaaaaagcctcttccgccaaaaccccttcaacaacttcaattcctgcatttcgtaaaatttcaataccttttccggaaaccttgggattcgggtcccgtacggcaactaccaccttttttatacctgccgcaattatcgcatcggtacaaggtggtgttcgtccatagtgacaacatggctctaaagttacgtacatggtaccgccacgggctttttccccggccacttttaatgcttcccgttcagcatggggtaagccagcttttttatggtatccttcccctacaatatttccatctttatcaacaataacagctcccactacaggatttggcgaagttcttcccaaagctcttttagcaagctttaacgcccttttcattaactgctggtcgttcatattaacccctcgcaaaaaatttaaaaccccaaagcttctgcttcggggtaaaaaggtacaataagagtattaataccttctcccatccagactttaactgtcggctccggaatttcaccggatctatccgtaaatttttacggactcgcgggctttaccgccggttaggaattccacctgaccccgaaggtagtaagattaagcagtattaaattaatttaattatattaagaggtatttttgctgtcaataatttagctcttttgacaaacttctatcaagtcttttaggtttttaattacatcacccttaaacaaaaagctaccggtaacaagaaaattcgccccggcctcaatcactaacggagccgtttgtaaatttatcccgccatcaacacccaataaaatttcctgaggagctttacaaaccatacttttcactttccttatcttcgtaagttgattattaatgaagctttggccaccaaaaccaggattaacggacattatcaatattaaatctattaaatccaaaagatattcaagattttccggtagagttgcaggatttaaagctattccagcttttttccccgaatccttaatcttttgaagtaagcggtggggatgcctggtactttcccagtggatagttatcatatccgcccccgcttcaataaagggctcgattaaactttccggcttttcaaccattaaatgcacatcaaaaatcaaattagtttttgctcttaagctttttacaaccggtggaccaaaagttaaattaggtacaaaatgcccgtccataatatccagatgtaaatattttgccccacctgtttccagttgttttaaaacaagttcaagattactgaaatctgcatttaaaattgagggcgcaatattaacaagcaagttaactgctcctttcgtcactggtaatttcttctaaaaaggttaaatagttttcataacgaaagggcggaatttccccggtttccagaagttctctcacccggcagtttggttccttaacatgaagacagttaggaaaataacaatatttccgattttgattaaattcaggaaaatagctctgcagctctaatttatccatttccggcaaagttaaattactaaatcctggagtatccgcaataaatccgccaaagggtaattttattaactccacgtgcctggtggtgtgtctgcccctttttattttaggacttacctctccggtagccaattttgctcccggtaccaatcgattaattaaagtactttttcccactcccgaaggccctgctaaaacggaaattttttggtttaaataatcagttaactcatcaatccccgtgtcacctctggcagtaatggcaacaacctttggcaatatttttttataatactcaaaaagcttttggctttccggattcaccaaatcaaatttattaaataccaaaaccacttcaagccttaaagcatatgccattaccagcaaccgatcaattaattcggtactgggaaagggatcagcaaaagcaaatacaagcaatacttgatcgacattggcaattggtggtcttatcaactcgtttttacggggtagtaagctttcgataactccctcagaattaggaaccagttctctgattattaccctatcaccggttaaaatttttatattatcttttttaaacttcccgcgcgctttacacatgtaaatagcttttccggtatcaacataataaaaccctgcataatttttaacaacgagaccttccaatgaattagttcacctccttgtcttctatcaccacatcatctaaatacactttaattctcccttttccataatagtatacttctttttccagaacggttcctggctcttcactatcattagcataaacaattacttcagaagttcttgcatcttttacaacaatttttaccgaatgtttctggccatcatttggcaccgctaaagtcactaaaaccgactttctcaccgggccagggccacgagatacggtaattctaacttttgagccttcctccactaaactccccggaaggggattttgagtaacaacttgcccggcaaaatattcggtactatctacctctttaatagtatcatcaaggactaatttcacctgctgcagtgtttttcgagcctcttcaatttgtttgcccctcaaatcaggtacggtaatccaggccggttttgctcccttgcttaaaataagttttattttgtatcccttttccacttcagtgtttggttctgggtcctgttcaataacggtacccggtgctaaacgttcgtcatatatttcgtttatttcacctacttttaatcctgcattttccaaaatcacccgggcatcatgaatatctttttcccgcacatcgggaaccagcaccatttcctttcctttactaacaaccaaataaatcggtcgagcaactttaaccctttctcccggtaaagggtcaatagaaatcactttatccttgggaactgtttcgtggtatgccgaggaaatattgatattggtaaaaccaagttcctctaacttttgcttcgcctccccaattccaagcccgcgaacctcgggaatcaccgcttctttgacattaaaataattatacaaaaaataccccaaaccaccaattaaagccagaaacaaagccaccagggctatgattccggaagttttcaatctttttttaccgcgaacttccggaaactggtttttatccaatataatggtcatcgtactatcctcagcaaaattttcttccggcaaatccaatttttttaaagtggcaattaactcataagcggatttatatctttgctctggctttttactcaataacttcaagattattcggtctagttcgtcaggaatatttttattataagaggaaggtggttttggaagatcatttatctgctttaaagccacagcaattggggaatcaccggtaaaaggcagtctttttgtcactaattcataaaacaccactcctaaagaataaaggtcggaagcaaaagtcaagttttcacctttggcctgctcgggcgataggtaatggactgaacccaaaatttctttatctttgttgattgtcgaggaggtaacattaccggcaatgccaaaatcggttaatttggcgattccttcgggagtgataatgatattttgtggttttacatcccggtgcaagataccgtgttgatgggcatgacccaaagccaaagcaacctgtaaaacaatcctcacactttcacgtaaacctaaatttttttctcgaattatttcttttaaatttttaccttcaacatattccatcactaaaaaataagtattctcttcctgtccgacatcgtaaatgttaacgatattgggatgagaaaggctggcaagagccttagcctcccgtttaaatctttctacaaattcttcatcactggtaaattcaggtcgaagaattttgatggttatgtagcggtttaaaagtaaatcctgtcctttataaacaaccgccatccccccgccacccagggtttcaaggattttatacctaccggctaatactctcccgatcatttcttcacctctctctcctcggcaaaccgggcaagaaccacggtaatattatcccgggaccccttaagcaaagcttgccgaattaactcatccgccaagttttctagcgccattgtctgatttgtatcaaggaattcggcaagttcagcctcctttattccgtctaataaaccatcggtacagaaaagataaagatcctgcgggtgaacttgaaacttaacaatatccacttcctcatttgccccatctaaagctttgagcaaaagatgccggtagggatgggaaatagcatcttcttccgttataatcccttgggaaaccattttggccacataagtatgatcttgcgtaagctttagcaatttattcgccctaaagacataagcacggctatcgccaaggtgaccaataaaaagattttccccggcaaatatacccaaagttaaggttgtccccatttcttttaagtttgcatctttattttgctgctctttaattttcttatttattatttgaaaaacttcctgaatgcttttttccgcttcagttatttccccgctcctaaattgggcaaaatattcggcaatgattcttaccgctaattgactggcaacggctccgcccgaatggcctcccattccatcagcaaccgctaaaatgctctttttttcgtcaataaaatatgcatcttcattgagagcccgtaccggccctttagctgttttccccacaattttcatttttacacctcaaaatactttgcttttaattgaccacaagctccgtcaatctcatcgcctaactcccggcgaacagtaacgggaattcctgccctttttaaaacttctttaaacttattaattttttctactgaaggagttttaaaatttctcttttcaattgtattgtacgggattaaattaacatgaacaagttttctctgcaataactgcgcaagtttcaaggcgtgttcaacggtatcgttaacattttctattaaagcatactcgaagctaacacgccttccggttttatcgataaagtaccaggcagcatctaaaagttccgccaaaccccagcgtttattaatcgggattaattcattccggagcgcatcatctggcgcatgcaaagaaatggctaaagtaacgggaagcttttcctcggcaagagctttaatttggggtaccattccgcaggttgaaacggtaattttccggtaactaatatttaagcagtccttttcattaattttccgcataaacttaagtacttcggtaaaattatctaagggttcaccgctccccattagcactacccgggtaattttttccgaactacttgctttaagcaccagtatctgttctatcatttccccagccgttaaattacgcgaaaaaccccccagcccggtagcacaaaatttgcagcccattttgcaacccacctgggtggataggcaaacggtattgccgtagcgatactttaataaaaccgcttcaattcccaggttatctttaagctttagcaagtatttaatgctctgtccatcccttgattttttgctgtgaataatttttaaagaaggcaacaaaaaattttctttaagcttttcccgcaatcttaccggtagatttgtcattttattaaaatccaattctccgtgtttaaaaatccactcatttatctgttttaagcgaaaagatttttcattattttccttcagccaagccactatttcttccgaatttaaatctaaaaatgccctcatttactacccgccttttaacataatttttttaaaattacaccaaaaaaaccatctcctatttccccgggaagcaaacgtagatagtaattattttttacaatacctaaattaaaaaaccattctggaggctttaccaaaacaaaatttgggttttttcttaaaaaattttccacaaccccttcattttcttccggctcgatactgcaggttgaataaactaatattccttcaggtggtaaaagcttggataagttggttaaaatctctaattgatattgagataactttattatttcttcctcgctcttttgccagcgggcatccggctttcgcgccagaacacccgtacctgaacagggtacatcggccagaatccagttaggatttaccccatcgggtagctttaatcttgtggcatcccccaataaacatcttataatattaatccccaaacggtgggcattttcctcaattaatttaagtcttccgggatggacatcaaaagcataaataatccctttatttcccataagctgtgctaagtgggtagatttacctcccggtgccgcacacgcatctatccccaccgaattgggttcagggttaattaaataggcaataaacatcgagccagtatcctgaatataaaataagccttcatcgtaccccggtagctctttaactccaaccttatctaaaattaccactccttcgggtaaatacggcagttgtttaaaattaatgtttttttcgtttaacaggtcacaataagcttttggagagatttttaaggtattaatccttaaagttaggttcggctgatggttattatacttcagtatctccaccgtttttgtgtatccatattgatttaaccaccgctttaccatccactcgggatgggaataagcaatggctaaatactccacctcatcgcttacgtctatttttgtaatttcctctcgccgcctaataaaattacgtaaaactccattaacaactcccgtaaatccccgataattgcgctttaccgcttcaaccgtttcattgattgccgcataggttggtaccttatctaagaagtacagttgatatagccctacccggatagcattaatgacaaaaggcggaagtttgctcctttttttcaggagctttcccgccatgtaatccaacaatttaagttgttttaaaacaccataagtaagttccacaacaaagtctttatcttcttttttggctaaattagcaattaatttaggtaataagagatttacgtaagaattatttttttcgacttcaaccagggtttttattaccaattcgcgcaaattcaccaaaagcacctaccaaatcaaccggtttaaataataataaaatttatcgtactcaattaatgtttcaaaacatggtcctttaggtcttaaattaattagtccaagggaaagaaccgggatatcattcatccccgaaaacagatccccttcacaagccacagcaaagacaacctccggctgtagactcttgacaaattgccttgccgcagttcctcctgcagcaacggcaatttttaatccccgttccctggcatagcactttaaaactccaaccgggcaccggaagcattcacggcaattatgtacatcataagtaattttataaagacaatcagctttctgcaaacaatggggcaaaagcaataacactttttccggagaaaacgggccatattttagggttttatcattcatcaatgaaatatatttttgaatatcttttcgtacatcacgcttaaaaagagattttataaagattttttgcttgtaaaaatttagcattcaaaggtttcccccacaagaggtcgataaccatttaaaaaactttcccacgacatttttttaccgccttccggttgaagttctaagatttgtaaacccctttctcccgtagcaaccaaaaacccgttttttctatcagcaaaaattatctcccccggcttttttccagaaaactcccccaccttcgccttccatatttttatttttttcccgcgaaaaacggtatatgccccaggaacaggatttaaagctcttatttggtttcttattttttcagctgaatcggcccagtggataatttcatcttcttttttaaggggtggtgcgtaggttgccaactggtggtcttgcggaactctgggaagaccaccttctctaagcctttttaatgcttcaattatcaaatccgcaccaatttctgccagaatttttcttaactctcccccggtaatttcctggttaattgcaaccttttcctgtaaagcaatatctcctgtatcaagcccctcatccataaacattatcgtaattcccgtttctttttctccggccataagacagcgttcaatgggtgcagccccccggtaaaaggggagaagagaggcatggatatttaagcaaccataaggaggaatatttaaaatctctctgggtaaaagtttgccataagcagctactacaataacctccggttttacggctaaaatctcctggtaaacctcttcattaaactttaaaggtgtaataaccctgagatggttttcctgggcaaatagcttgaccggtgaagaaataacttttttacccctgcccgcagcagcatcgggtttagttaccaccaaagccacttcatggtgggaaattaacttagctaaaggttttaccgcaaattccggagtacccatatagacaatacgcatattattagcgaccctttctgacaatattgtccgctttttccacaaataaaataccatttaaatgatcaatctcatgttgaaaagctctggccagcaacccttccgccggtatcacaatttcctcaccgtaacgatttaatccttttaccgtcacctttttcgccctaacaacctctccctgcactccaggaacacttaaacaaccctcaatgtccttttcttcaccggaaacctcaataatttcgggattaataagttcaattaacccttccccaacatccaccacaattgccctcttacttaccccaatttgcggagctgccagaccaaccccgttatacgcatacatggtatcagccatattttccagaagctttattatattaggtgtaatttctttaatgggcttggctatttcttttaaaatcggatcaccaatctccactactttataaactgccatctttttcctcctttaaagaaagatttggggacttaaatctaaaaccaaggttaatttatggtttaaactactttttttaaactcctgtaatcctgcttttaaaacttcacgggcaaaactgcttttattagtttttaaaagtatatgatagcgaaagtttctttttaacttataaaagggagctgctgccggtccaataatttcaatctctggactaaatttgctggcattttttaataaattaactaaattatttgccccctcaataaccttctgttcgtcttcgccagctataataagcctaaatattttactaaaaggtggatatcctgtctgttttctcaaagaaagctcctttaaggcatactgctggaaatttccccgttgcaccgcttgaataatataattttccggattaaaagtctgaattatcacttctccgggcacgagccctctaccggctcgtccggcaacctgggtaagtaaattaaaacttctttccccggcgcgaaaatccggcaaatttaagctttgatcagcatttaatactccaactaacgttaaatcaggaaaatcaaatcctttggccaacatttgcgttccaataatgatgtctgcttccttgtttttaatcgcctctaatattttatcatagctatttttactcctcatggtatcgtagtcgacgcgaaaaattttggctggaaatagctttttcagttcctcttcaaccctttgggtcccataaccatataaatcaagagagatttcctgacaagctggacacttgcgggtaaaagcaatttttttaccacagtaatgacattggaaatttttttcttctttgtgataggtcatggaaacgtcacaatcagggcagcggtaaaaataaccgcattttcgacacataatcattggagcaaagccccggcgatttaaaaacaaaaaaacctgttctcccttttggagtcgctcgctaatttttttttgaagcacactgctaattatcccggtatttccttccttagcttccttaaacatgtcaacaataatgacctggggataaggcctattttggtaccgcttacccaaaaaataatatttaattaatcccgaaattacagcagcatatgtttccatggagggagtagcggtacccaatagaaggggaatgcccaaacgtttagcccgccagtaaaccacttcgcggacatgatatttaggggtttcttcttgcttataactgagctcgtgttcttcatcgagaataattaatcctaaattttgaaagggtaaaaaagctgcagacctggttcccaataccaaaaccggactacccttttttaattcccgccaaaccgtgaacttttcccgggcactcaagcggctatgataaaccagagtattttccgggaagtattttttcacccgggcaaccatctgcgtggtaatacctatttctggtaaaagaaatagtacctgtttcccatggtttaaaaagtctcccgctaactttaagtaaatttccgttttaccgctgccggtaattccgtgtaataatcccacaaaattttttggcatatcccgttttatttgctgatatacctgcttttgactctcggtaagctcaattggcggtaaattaggtagtggtttctctctaatctggagtattccctgtttaaccaattttttaatagtagaagtagttcttactaaaccccttttatcctttaataagcttattaccatctcatcgttttgcaatcttttgcttttttttatcttctccttaagttttgtttcatccactaccgtacaaaatacttccacatcctgatatattttctccggaaaagatattaaagttaatgcctcggtaattgaacaaagataatactcggaaatccacttaaccatctccaccaattcaggagttaaccaaagttcttcgggtaaaacttctaaaataggttttatttccccagaaaaatccttttcctggccaagagaaaagataaagccttcttccaaacgattattaaaattaaacttgactttggctccaattgcaactttttttatgtcagaagagggtaatttataagtatataagcgatctaaatgccttgacggccttagtaaagcaacctgggcataaacagtcatacactgcccccttaaaataattaaaaacgaaaaaggcttaacctttttcgttttgtttatttaagtacttttcccctattaaccgggcaagtttttgggcaacaatttttttggatgcccggggaattaagattttttcaccatccctggtgtaaactacaatttcattttcttccgaatcaaaccctatatcagtcctggaaacatcattagctgcaatcatatcaagatttttttctaaaagcttttttgttgcgtaattttccaggtcatgggtttgcgcagcgaaacccaccaaaaactgatccaccttccgctctcccaagctttttaaaatatctttggttttaattaaatcaatggtaagagaattttttttcggtagtttttgttgaaacttttctttgggcgtataatctgctaccgcagccgctttaactacgatctgcactttttcaaataactcatcaaccctttgggccatttcctcggtagtttcaacggaaatgaagttaacacccgttggcggtgctaaacttaccggacccgaaactaaatagacttcagcccccagatttctaaaagcttcagctaaagcaaaccccatcttcccagaacttttattagtaataaaccggacaggatcaatatactcccgggtaggtcccgccgttaccaaaacttttatgcctcttaaaattttctcctgtaacaacttttcaacctcagctataatttccggaatatcgggaagtcgacccggccccacatgaccgcaggcaagactgccggaatcaggctccaagatattaaaaccatgagcaactaatcggttaagattttcctgcacaatactgttttgatacatacgggtattcattgccgggcaaattaaaacaggacagtttttagcggcaacaatggtggtaagcaaatcatcggcaatgccattagctattttcccaataatgttagcggttgccggagcaattaaaattaagtccgcttcatcagtaagggatatatgcaaaatgggatccgcttcagtaaaaatttcctttaatactttattaccggtaacagtggccagtgatagggaagtaacaaagttttctgctcctgcagttaatacgggaaaaacttggtaccctctcttggttaactcccgggccaactctaccgttttatatgcggcaattccgccggaaattcccaagattattttgccctcagacacgaaaacttgggcctccttatttattttgggatgatttaagccgctggtaggtgattaaatcgttgccgatttcgtgtaaagcaatggtcacgggtttattggaaatatgttttaatttacttgattctccagcagtaatttgcctggcccttttggctgttgctaccactaacgtataccggctatccgcttttttcattaaaatatctaaagaaggctggttcatctttctaaaacacctccttcaagtaaaacccggtaatttactcttttgggttttaatttttccgcagttaataccgcttctaaatcattaaccgctgtttcgagatcatcatttaatattaaataatcataccaatcacagttagcaatttcttcccaggccatttgcattcttttaacaataatttcctctttatcggtacctctcttccgtaacctttcttccagtatagaaatggaagggggtaaaataaaaacaaaaacaccctccgggtaagttttcttcacttgccgggctccttttatatcaatttctaagatcacatcctgtccgcgcgctaaagcttcaaatacaggctttttcggtgttccataataatttccataaacatcggcccactcgagaaattcatcgtttgcaatcattttctcaaattgttgtcgatcaataaaatagtaatgaaccccgtcaatttctcccactcttttttcgcgggttgttgcagaaatagaataaaagaggtttggatttcttttccgaatttcctggcaaatagtaccttttcctgcccccgaaggtcccgaaactaccaccagcattcctttatgcataacttctccttctctgttaaaaattttcctcttgattttctttcgtattaaggcgatgggctaccgtttccggctgaaccgctgataagataacatgatcgctgtccataattataaccgcccgggttcttctaccatatgtagcatctattaacatccctttatcccttgcctcggaaataatccttttaattggtgcggattccgggctgacaatagaaataatgcgattcgccgaaacaatattaccaaacccaatgttaataaactttatttccaccaaattccctcctttactctatattttgaacttgttctctgattttttcaagttcactttttaaatttaccacttttgtagaaataaaaaggtcattggctttcgcaccaatagtattagtttctctaaacatctcctgcacaataaaatctaactttttaccgataggtccagaatcatggataacctctaaaaaagctgtgatatggctttttaacctggtaatctcttcatcaatgcttaccttatcggcatataaaagtacttcctgcaagatcctttcctcgggtatacctaaatttcccaaatcctttaaccggtttaaaagtttttcccggtattctttgggaatttccggcgcccgactttctatttccgttaccaggtttttaatcacggttactttctggctaatatcatcttgcaggcgcttgccttcatcccagcgcatagcaataaatttccccagggcttcatttaaaggaactaaaaagtaattccagatctcctcttcatcaaattgcggttcggctattttaaaaatatccggtagcagtaaaaggtcttcaatctcaatatccgccttaatccccaaagcttcacctattttttgcaattctttgtaatattcatagactaaattttcatcaattttaacatttttgcttaatgcttcctctactgtaacgtaaagatcaatcttaccccgataaaccttgctttgcacaaccttttttatcttatcctcaagaaaaaaataacgacggggaagtttaacatttatttccagatatttatgatttactccttttagctctattaaaattctcccgaactctgaaatgctctcagcccgtccatatccggtcatgctttgcatttttctacaacccctactctaagttttttaaaaaggtctctaaacgctttaaaccttcttttaaatccgctaaactcaaagcataagaaaggcggacaaagcgatcatcaccaaatgcaattcccggaaccattgctactaagtagtactctaacataatttccgcaaaatcgatactggtatttattatttttcctgaatgttttttcccaaaacagttatcaatccgcggaaaaacataaaaagctcctgcaggttcaattacctttagctttaattcctgaagtctacttaccacaaaatccctgcgttttttaaattcctgcaccatcttttcaacgctatcatcttcaatggttaaagcagctaaagccccccattgagcaaaggaggtcggatttgacgtctggtgactttgaagttcaataagtttggcggcgtactgtctagatgcagccacataccctaagcgccacccggtcatactatggcttttcgaaaaaccgttgacaataaaagttttttccttcaattcggggttggcagctacaaaactaattggcttttcggaaaaatatatccgttcgtaaatttcatcagcaataatcaaaatttctctgtcttttagcaaccgtccgaggcttttaagttcatcaaagctgtatactactccggtaggattagaaggagaattaataattattgctttagtccgattgttaaggtaatttattagtttatccggtgccagcttaaaattttccccagtaggtaccaaaattggtactccaccggccagtttgacctgctctacatagcttacccaataaggcacagggataattacttcatcgccgggatttaaaattacttggaaaatattatacaatccgtgctttgcaccacaggtaaccactacttcctggtcttcataatttacaccggttctttgggttaaatattcggctattttttttcttaactccggaatgccacctaccggtgtgtacttcgtttttccctgccgtaaagcattaattgccgcttctttaatgtattcaggtgtatcaaagtcaggttctcccaccccgaaattaatcactttctttccctgcttaataagttccttagcttttttgtcaatggctaaagtaggcgattcgccaatttgtaaggccctctctgaaaacatctttatcccccccgagtcaatctcaagaaaaaagtccactccctcaaaactgagggatggacgcatagttagaactcaaccttacccaagtgttgctcaattctttgcaaagcttcttttaatcttgaagttggtatagttaaagaaattcgaaaataaccttcaccgtttgttccatagccatttcctggagttatgacaaccccagctttttcaattaagtattccgcaaaactcgccgacgtaaatcctttgggaaccggagcccaaatataaaaagtccccttgggtttacttaaattccaccctaatttatttaaagtttcaattaccaaatcccgtctttgggcataaaggtcacataattcctttaccacatcctgaggtccttctaatgctttgattcctgcatattggatagcttgaaatactccggaatcaatatttgactttaaccgccccaaagcatctattgcttttgcatttcctacagcccagccaatccgccaaccggtcatgttgtaggtcttcgataaagaatgaaattcaatacctacatctttggctccctttacttctaaaaagctcggagctcgatacccatcaaaggtaatttccgaataagcggcgtcatgacacactaaaatttcatattttttggcaaaatgaaccactttttcaaaaaatcccaggtcagcaactgcaccggtaggattgttggggtaatttatgaacattaatttagccttgcgtgcaacctcttcgggaatactgtcaaggtccggtaaaaacccattttcaggctttaatggcattttatatgtagtaccaccagctaatatcgtcccaccctcatacaccgggtatcccgggtcaggaaccaaaactaaatctccgggatcaacataacaccaggaaatatgcgctattccttcttttgaacccaggagggaaactacttctgtctttggatctaactcaaccccaaatctccgtgcataccaggcagcaaccgcttgtctgtaagaaagcattccaaccgaagaggggtactggtgattttccgggttttgggctgcaaggtaaagttcctcaataatgtgctttggagtaggggtatccgggtcaccaatcccaaggcttattacatcaactcctgcctcttttttttcagcaattaatctttcaattcgcgcaaacaagtagggaggtaaatttctaactcttgtagcttctaacatttgccatcccctttcccaagtgtttttattaaattataaaaaatattctcccttaaatactatttcagcgggaccagtcatataaacgctttccccaaaaacccagttaataaacaaactgccaccgggtaaaacaacttcaacatcttcctgcaaatggccaagaatacgtcctgccactacaaccgccgaagcaccggtaccgcaggcaagagtagcaccagcacctctttcccaaacaaaaacttttactttcgctggactcaaaatttctacgaattctacatttgttttccgcgggaatagcggatgggtttcaattaatggaccatatttttctaattcaattttagctaaagaatcaacaaagattaccgcatgggggttacccatagataccgctgtgaaatagaatttttgacctaatacttcaaggggaatattaaccggttcttcctccaccgctacgggaatctcctgcggttttagtattggccggcccatatcaacccgtaccatattgttctccaaaacttctggtttaataataccagccaaagtttccacctctaattgcttcttggccggattatatttttcaacataatagcgagctacacaccgaatcgcatttccacacatttctgcttcgctaccgtcggagttaattatcctcatcttaaaatccgctttctcggacggaagcaacaaaactaaaccatcggctccaataccaaatcgccgatcacaaatttttttagctaagtcggaaagatttttatttactaagttctggttttttatttcatcaaccactacaaaatcgtttcccaatccgtgcatttttaaaaactccattgtcaacctcctaaaaaatccattttttttataataaatttttttatatttattcgtcaacctcgctatttcaagaaaaactgtatacttgccaataagaaaaaatatcgttacgataggatgggaggtaggagttatgaactatcttttattaaaagcagtggtggaagagttatcacaagcaataattggccatcgggtagacagaatagcgtttaccgataatttatcaatcttaataaatttttttcacccaaaagaaaaagaaaaatttttgtatctttccgctaataatgatttagctgcaatttttctaaccaaaaccttttttacgtcttccaaaactactactccttttttaaacagttgtcaaaactttctcttggggaaaaggctttttaaaataaatttagagccctgggaacggaatgtctgtttggagtttttggaccccaaaaccaatgataaagtgtatttatttgttgaaatcatgggtaaacacagtaatcttatcctcgttaatcacgaccagacaattattgatggcattaaacgttatggcgaaaaccaaagccggtatcgggaagtccttcccggtaaaccatatattccccctccccaaccggaagttttattaatccatcagttaactttggaaaaatttcaaacgctttttttgaaaaatcctaatttaaccttgggggaaattttcaaaaaaaatattgttggtcttggaaatttgttattaaacgaggtttttttccgctgtaatttaaacgttaaaacccctagcagagaattaagttcaaaacaaatagaagatttgtattttacattaatttctttaacaaagaaagaaccaaaacccgttttatattataaagaaggaataccttattatccggctccctttgaatttgcttcattagaaaacttagcaaaaaaacccggaacagccaacgaagtatgtgaagaatattatttatatttccgtgaactacgagaaatagagaacctgaaaaattctctcagtgctaaagttgctaaaaaaattaaaaacctccaggaacgcattaatgaattaaaagccaaggttaaagaatacagtaatgccgagcagtttaagaattttggcgatctactcttaacctacaagcagcacattactaaaggaagttcaatagtaaagcttccaaactgggacgggcaggaagtagaaatcccattagatgccggaaaatcggcggtagaaaatgccgaattttactataaaaaatatcataaagcaaaaaatgggcttatttcagcccaaaatcagttaaatttcgctctggaagagcttgattacttcaagactgttcaatttcagattgatgacgcccaaactttagaagtgttagaagatatcaagcaagagttgggtttagaaaataatataaaagttaaaaaggtaaaagataaacatctggactttttaacctttactacttcatcgggtttaaaagtttttgtaggaaaaagtaaccggcaaaacgattatttaacttttaaggtagccaaagacaacgatatttggcttcatgctaaaaatattccgggagcgcatgttatattaaaaaccgatggcgagccagatcaacagtcgttgctggaagctgccgttatagcagccacttttagccgcgcccgctacggcaaaaatattccggtagattatactttgcgtaaacatgtccaaaaaccagccggagcaaaaccgggatttgtaatataccgtcaggaaaaaacaatttacgttgacccggatctatcactacttcattttcgacttcccggcttaaccacgggaactccctcagcacagagagggcagttttccggcaaataagtttctacatttacctttaataacgggtaaaaaggaacgccaaaatctaccttgccgccgctgcggtctaccagggaagctaccgctaccacttcaccacccatgctctgcactaaatccatcacttccctggtggatccgccggtagtaaccacatcttcaacaactataactttgtcatcaggttttaccgtaaaacctcgccgaagccgcatttggccctcttccctttcggcaaaaaatgctttgacctttaacgccctggccatttcgtaagccaaaataatgcccccaattgccgggccgattacaagattagcttctattttatcagctctaagcttttgagcaagggtttcacatagcatctcagcaatttccggctctgcagttaataatgcacactggaaatatttattgctgtgcaatcctgatgacaatttaaagtgcccttctaaaagcgctttcttttctaaaaataacttataaagatccatgcaaaacaccttccatctcttccaaatatttttgggcggccaatctacggttggaagcagcaataatcggccttcccaccaccaagtaatccgctccaagctccagagcttttttaggagttaatactcgcttctggtcaaaattagcatcttcaaaacggcgaattccaggagttacggtgataaattccgtaccgcaaatactttttattaaagcaacttcctgagctgaagccacaaccccatccaaaccagcttctttggtctctttagctaaaattgccactaattgagatagtttaattttaaacccaacttgctccaaactctcctgattcatgctggtaagaacagtaaccccgagaattattggggctttgccttttctttttaatgcctcatcctttaccaaatatgctgctcttaacatttcttttccacccagggcatggatgttaaccatatcaacttctaagtctattaagttttttaatgctcttgctacggtattgggaatatcgtgaagtttcaagtccaaaaatactttcagccccaaattttttaggtcatctattaatttaggcccctcccggtaaaataactccatcccaaccttaaaaaaggaaaccacatcctttaactcttcaactatatccattgctttttccttatcagaaacatctaacgccacaattaatctttcagacattttcttccccccgatgggcaagtccagttaatttagcaatactttcaatattttcctcctgtaaatactctcccagttcccttataagccgcggcataaagcccggttcgacaaaattttggctgccgacctgaatggcggttgctccggccaggaaaaattccagggctgcctccttgctgtctattcctcctaccccaataattggaatagaaaccgccttaaagcaatcataaaccatctttacagccatgggtcgaattgccgggcccgaaaccccgccgtgcttgttgcccaatattggttttttgctttttacatcaattaccatgccggtaaaagtattaatcagggttaaagcatcagctcccgcattttccgcagctttagcgtaaacggttatgtctgtaacatttggagttagttttactattaaagttttgctatatatttttctaacggaagacacaatttgttttaaagcttccaaatcggtcccaaaagcaatgccacctttactgacattgggacaagatacgtttaattctaaggcttttatttcgtcaaaccgttgagcttcccgagctaaatattgaaactcttcaacactctccccggcaatatttaaaattaaaatatcatttaagtcctttatttgcggtaaaattttctcacaaaaataatcccacccgggattggccagtccaattgaattaatcattccgcaggatacttcataaacccgcggtggtctgttccccaaccggggatttttggtaatagtctttaccactaacgctcccaagttttttaagtcaaaaatatctttaaattctaagccaaaaccaaaggttcccgaggccggcatcaccggattttttaaagtaagctcgccaattttaacttttaaattcataaaaccacttccttaaagttaaatacgggaccgtcctgacaaacttttttatagacaaattcattgttggagaaaactttaacagcacatccaagacacgctccaaacccgcacgccatgaagctttccagcgaaacttctatcagtcctgaatagttctgtaatacaggttttgccgcttttaacatagcctcgggaccgcaaagataaatctggttataagtggaaagatctgtggatttaagcccatctaacaccaaacctctctttcccagtcctgaaacttccgcgtaaacttctacatcctcaaaagcattaacaatttccggaataaacatttcagcatttttcacgccataaattatgcggacttctcccccgtttttggtaatttccttagctaaaaattttaacggagcaatccctatgcccccggcaaccagcaggcttttcccggacattactgtaaaaccccgccccaagggaagcagcatacttatttcccgaccgggaggtaattcccgtaaagctcctgtcccctggccaaccgttttaatgtaaaaagtaaccaaaccagttttcaaatccacatcggcaaagctaaaggggcgacgcaaaaacacccctttagcttcaacctttaccatggcaaaacttcccggaacaatttcgggcaatatttcctccggtacggaaacttgcagcttatagatttcttttgtaatagggatattttccaccactaaaccttttagatcctgcataaactctctccttaatgataatcttgaagggcataaaccttaatttcttcttctttgtcgattaaatactccagcatattggccatcgcccgggccgtatctaaggaagtaagacacggaacgcccagctcaacggcagtacggcgaattctaaagccttccttttccggctgacttccagaggtgagcgtgttgatcaccaattgaatttggtcatcccgcagtaagtcaagaatattatacgttccctccgaaagttttttcactttaactacatctaaccctttgcttgtcaggaagtttgccgttccttcggtggcaaaaattctaaaccctaaatcggcaaattttttaatgatagcatatgcttcttccttatcccggtcggctatggtagcaagaacggttccttttaatggaactttaattcctgaagcaatcaaagctttatacaatgcttcgggaaaagtttgggcaactcccatgacctctcccgtcgatttcatttccggtcctaaacttacatctaagttggtaagcttggcaaaggaaaagaccggagcttttacaccccataaatttctcgtgggtaaaattcctccttgataaccaacttctcgtaaggttttccctaaggataatagggtagcaattttaaccatgggtactccggttattttactcaaaaacggtatcgttctacttgcccgggggttaacctcaagaacatataattcgttttcgtaaaccacatactgaatatttaaaagccctttaatccccaaccccaaagcaattttacaggtatactcgtaaattttatcgatcatctcggcatccaaatgtaaagttggataaaccgctatactatctccggaatgaactcccgcccgttcaatatgctccataatcccgggtataaacacttctttcccatccgctaacgcgtccacttctatttccagtccttccaagtaacggtcaattaaaaccggatgctccggagaaatttgggttgcccacttcatgtaatttttaagttcctcttcattgtaaacaatttccattgcccggccgcccaaaacgtaagatgggcgaaccaccaccggatatccaatttctttagccgtttgcacggcttccgaaatagcaaaaacacctttacctgcaggtcgttttaaccccaaggagtttaaaaaagcgtcaaatttttgccggtcttcggccgtatcaatggcctccacactgctgccaaacagtttgatccctgcctgagcaaggggtttagctaaatttatggcagtctgtcctccaaactgcacaactactccttccggcttttcatgatcaatgatatttttaacatcctcaaaggttaagggatcaaaataaaggcgatcggatgtgtcaaaatcggtactgaccgtttctgggttgttattaataattactgctttatacccttcctctcttaatgtccagaccgcatgtaccgaacagtagtcaaactctattccctgacctatcctgataggtccggaacccaaaacaatagcttttttgcctgaagtttccttggcttcattttccttttcataggttgaataaaagtacggagttttggcttcaaattccccggcacaggtgtcaaccattttataaaccggttttattccgtatttttctcttaaatttcgaacttccccttccgtcaagcctttcagagccgcaatttccctgtcggaaaaattgagcttctttgcttccagtaaaagttctgctgttaggtcatcgcgggcaattttttgctcaaaacgtacaatattttcaatcttttttaagaagaactggtcaatccccgtaagttccgaaagcttttcaaggctataaccctgaattatcgcctcccgcaggtaaaaaagcctttcatcatcggggtattttaacttttcctcaagctttgtaaggtctaaacctttcttcgaaagaccataaactccaatttccaaagaacgtaatgctttgttcaatgccccttcaaaagttcgatctatggccattacctctcccgtggctttcatctgggtaccaattcttttatccatagtccgaaacttatcaaagggccagcggggaatctttaccaccacgtaatccaaagccggttcaaaagctgctgtggttttaccggttaccgcattggttatttccggtaaagttaaacccaccgcaatttttgccgcaactttagcaatgggatagccggtagcttttgacgccaaggcactggaacgggaaacccgtgggtttacttcaataacatagtatttaaagcttttgggatctaaagcaaattgaacattacagcccccttctatcttaagagcccgaattatttttagcgaagcattgcgcaaaagctggtactctttatcggataaagtctgggaaggagctaccactattgaatcgccggtatgcacgcctaccggatcgatattttccatgttacaaactataatggcattatccatcgcatctcttagaacttcgtattcaatttccttccagccggcaacacttttttccaccaaaacctgttgaattaaactttgcttaagacctctctggcaaatttccttaaactcttcatcattatgggcaattccgccaccggaacctcccaaagtataggcaggacgaattattaccggatagccaatactgcgcgcaaaactaaggccatcctcaacattggttacaatggtactttccggtaccggttcgccaatggctaacatggtttccttaaataactcccggtcttcagctttcttgatagcttcaaggggcgttccgaggacctgaacgctctccctttgcaaaattcctcgctcaaacaattctaccgttaagtttaaaccggcctgccctcctaaagtagcaactattccctgcggcttttcttgaattattactttttctaaaaattcaacagttaatggttcaatatagaccctatcggcaatattggcatcggtcataattgttgccggattactatttaccagcaccacttcatatccttcttcttttaacgctctacaggcctgggtgccagcataatcaaattctgctgcttgtccaatgacaattggtcccgaaccaattaccataactttttgaatatctgttcttttaggcatagctgtcccccttgtcaatcatttctaaaaacaaatcaaaaataaagtctgcatcattgggtcccggtgccgcctccggatgaaactgtaccgaaagaattttactatatctacttcgcaggccttcaatggtattatcatttaagttgcgaaaccagatctcaagaccggttccaattaagctttcttcccgcacagcaaaaccgtggttatgagaagttatgaaaactctcttactttccgtttcaattaccggatgattgctacccctgtggccaaattttaatttgtaggtttgagctccgtgggccaaagctaaaagttgatgtccaagacatattcctaaaatgggaagcttgccaattaattgcctgatgataaaaatactttcctgtaaatccgccggatcaccagggccgttagaaagcactaccccctggggagctaaggctaatatttgctcagcaggcattagaggaggcacaacaaaaacctctgctcccctttttaacaacgattgcaaaatactattttttgcgccatagtcaacaagtacaacccgcggtttttggcctggataatgaagaacctcgtctcccgccacctgataggcaagtttttgtccggaaatatctggaactaatttaactttttcctgatattccgcccttttttccggaaaagctgaaatgattcctttcataactccgtacaagcgtaatttctttgtaatttcccgggtatctacccccgctaaagtaacaattttttcctcattaagaaagtgttctaatcgctctttttggcgccagttactgggaaaatcgcacaattcccggaccaccagcccgcgtacaaagcttttttcccgttccttatcttcgggtataaaaccgtaattaccaattaatggataagtcatgacaactatttgtccggcataggaaggatcggttaatatttcctgatagccggtcattcccgtattaaaaactacttccccataattttccccaacatacccgtaaatttctccttcatagcaagatccgtcttctaaaatcagtatcccttttggcaagctactgcactcctttcaatagtcgctgataggccactataccctgataaacggtcattactggccaaccggttaatgttctcccgagaaaaggattattctttgactttccaaccagcaactcttcgcttacctttagggtaagctttggatctattactgttaaattagcataatttcccttttttatatctccctgctttggcagctgtaagatttttgctggattaaccgtcatttttaaaaggagcttttctaaagtaatctttttcttgagtaccagctcggtatacaacaccggaaaagccgtttctaacccttcaatcccaaaaggtgcatcgttaaactccacatttttttcataggaagcatggggagcatgatcagtagctataacatctattaccccctctaacaaacctttaagtaaagctttctgctcttctgcctcgcgcagagggggatttacttttaaattagtatcgtacccggctaaagcttcatcggtcaaaactaaatggtgcggtgtaacttcagccgttactttaagaccaagttttttcgcagccgccaccaaccgcaccccttccgccgtacttaaatgagcaacatgaagttttgctccagtcattttggcaatttcaatgtcccggtatattgcaatgttttccgctgctttcggtatgccccttaaccccagtacggtagaccagtaaccttcatttataactccccggttggcaattgtcggttcttcaggatgagttattaccaaaaggtcgagggcagcagcatattccatagcatgtctgaatacagcaccatcggcaacccagttcccatcatcggtaatagccacagccccagcctcttttagttcataaaatttactaagctcttttcctgctctatttttagtaatgcatccggaaaaaagtatatttagaggaatacttttgcttttttccttccagtaataaataaccgtcgcattgtccggtggcgggtcggtattgggcatcattaaaacaccggtaaaccccccggccagagcggcgttacttccggaatgaatgtcttccttgtgggtatatcctggatcccggaaatgaacgtgcatatcaattaatccgggaattaaaaattttccttcaatgtcaattacttcgacatcactgcggttgatttcaggggagatttcaactatgatacctttgtctattaagacatccatttttcttattttcccgtcttcaaccattaccacattaccgtttttaatcaacattcccactttcgttccccccggctaacaaatataaaaccgccattctaaccgctaccccattggtaacctgttcatttaccaccgcattagggctatcggcaacataatcgtcaatttctacaccacggttcagcggccccgggtgaagaatgagcaattttttaccttttaatttttccagcttttcctgggttaaaccataccagtcgcgatattcatctaaggtcgttaaatatcctgcatcctgccgttctttttgaattcgtaacacattgacaacgtcagcccactccagagttcgctgaagatttatttctactcttaccccaagtttttcgatttccaccggtattaaagaaggaggaccgcaaacggttacttcggcccctaatttgagtaatccccaaatattagagcgagccacccggctgtggtaaatgtcaccaattattgccacttttaaaccttcaattttataaagcttttgctttatggtaaataaatctaacaaggcctgggttggatgctcgtgaaacccatccccggcgttaataaccgacatttttgtattgagagaaataaacttgggaactcccgactgctggtgacgtacggctatgatttccacgcccattgcttccaaagtccggatggtgtcaatgagcgattcccctttttgcacactggaactgctaacgttgatactcagtgtgtcggcacttaaaaatttggcggccaactcaaaggaacttctggtacgggttgaaggttcgtaaaaaagggttgcaaccgttttcccccttaatgttggaactttctttatatcccgcattattatgtcacgcatcgggcgggcaatatctaagatagtattaatttcttctttactcaattcctgaagaccaagcaagtgtttccgtttcaccatattacctccttataaaaaaactcccggaggcctccgggagttaacaaaacccgtcaaccccttttaggcctctcaggacctatttaaaagggtcgccttttattcatcttctttttccattatataaaccgcttcgtccccatcgatttcagctaaatgcacatgaattacttcctttttggaggttggaacatttttacctacataatcagctcgaaccggaatctccctgtgaccccggtctattaaaaccgccagctgcactaacataggacgccctaaatccattaaggcatctaatgctgcccgcacggtacgaccggtatataaaacatcatccactaaaacaagtttttttcctgttaccggaaaattaatttccgtttggtgtaccaccggctgatggcttaatgacgagaggtcatcccggtaaagagtaatatccaagatccccacagggacctctaccccttcaaacagcttaatttcttccgctatcctctgggcaataggcacaccccgtctccttatcccaattaaggctaaattttccacgccattgtttttctccacaatctcgtgcgcaatacgccgtattgcccgtctaatcccgtcttcatccataattttagctttagtttttaaacccatttatacccctccatataaatttaaaacctgcacacgtgaggcgcgtgcaggtttagtattgccttattaaacccttactagcctcacaggaccagtttaaaggtcattcagttatactaagagtaacaacttttttttttctttgtcaagaaggaaattatctcacaaaaggcgaaaataaatgttttaaagaaggaggtaccaagcatgaaaaaagtagcgttccaaacaatagtctttgatagcgatatgaatccagttgtattacttattgatgaaaatcaagaatttgtccttcctttattttttactcccaaagaattagaacctattcttttttctttggaaaactttattcctgaacaaccggaaacttataaccttcttttagaaattatcaaaacaaataacttaaaagttaaggaactaactattaccgacatctttgccgatagagtattttctgtattagctttaaaaaaaggtcggaaagaacagttttataactgccgtatcaatgacggacttgccctggcaatatatttcaaagctcccatctacattaccgaaaaagtagaattatccacctatccagtgaccagtttaccggatgacctggaaaaagagctccaaccgttaatagaggaatggaaaaaatctcttaattaaccccttaattttgcaagcaccctttgaaagtcttccggcaatggagcggtaaactcaagtaattctccagaacggggatgaataaaagatagctttatagcgtgaagcatttgtcttttgaccccaaaaggattattctggtgtccgtattttgggtctcctagaaccggatgacccaagtaactaaaatgaacccggatttgatgagtacgtcccgttaaaagtttagcctgaattaaggtaaatcccttattaaactcttctaaaaccttatagaccgtctgggcagtttttccgttggaaactaccgccatcttctggcggtctctgggatggcgtccaataggaagatcaataattccttctttatttttcaaataaccatggacaattgtccagtattcccgaacagcttttttctctttaatttgttctgctaatgactgatgggccaggtcatttttcgccaccaccagtaaacccgaagtatctttgtccaaacggtgaacaatacccggtcgcagcactccaccaatgcccgataaattttgacaatgatataaaagggcattcaccaaagttccatcccaatttccttcagccgggtgaaccaccatgcctgcttttttatttaccacaaccaaatcctcatcttcataaacaatgtctaacggaatttcttcgggtttaaccgatagttcgcggggaggaggaagtaaaaccgctataatttctcctccccttactttataacttgctttgcgatgtaatccatttaccgtaacttttccttcctcaatcagctttttaataaaacttcgagataattccaattcttcctgttcagctaaaaacttatccagtcgtaaaccgctatactctgaatttaccactacttttatttccgtatccatttttgctactcctttttcagcaaaaactgataggtaaaaagcaaaagccctatggtaataaaactatcggccaaattaaatacaggccagaagtgaaaatccaaaaagtccgtcacctgtccctgcgtcagacggtcgtaaaagtttcccagagctccaccgaaaataagagctaatgatgttaaaagaaaacgatttctattaccggtagttaccaaataaattaagattccgcttaaaacaaaaatggttattaatataaatattcctcgttgattgggtaaaatactaaatgctgcccccggattttttacatgtgtaatgctaaaaaaggaaagtattttaaccgattgacccagggcaaaattttttataataaaatattttgacaattggtccaataaaaaaaagccaaaagaaagcagtaaaaaataaaccactttcgccaaccccacttttaccggtgttgtggtctactttcatcatctacccctttaaagttctggtaaataactccatcatccccaatttcaaaaggaatagaatctacctcatcggtgctgctgttttcttcttcgggcggcaaatcttcataaaaaatattctcccgggtattaaaatttgccaccgcctgccaggaatcttctccatcaaaaagggtttgggaagtattatcatgattaaatttttccataaaaggtgaaagcacttgttcttctaccggtcttatagaaggtacagttctttcttcaactcgtttttggcaggcaacacaacgaattgctacaggattagcaaaaagcctgtcaactggaattttctggccacaatctatacagaggccatatttcccttgatttatcagggctatagcttcgtcaatttgtcttaactttaattttagattatcgataagggcaaaatctttgcttctttcaaaactttcactgcctaaatctccggggtgattatcgtaaaaagaaagttcctgggtactctcaaaaaaaggattttcttcacttttctttaattctaaaagccttttttcgtattcctcttttagctttaaaagcatcttcttaaatattgcaatatccattataactaactccttttttgcgtttaatacccaagtcttaaattaactaactgaataattttagcgataaaatcactgataaccggtagattcaaaaccagtaagtgctttaaaagataaattaaaactacacttaccacagaaaatccaatagcagccccaatcccccgcccaatccccaaaagaaaatttaaaaaaataagtcttccgggattttctaacatttcaacatattccttgattttcacctgctctaacttcactaccaatttctcggcagcttcggctatgttttcccgctccacctctacccctactttcaaaattattataaccggttacttaatttcttaaactttggatgggagcaggaattcgtccgccgcgcattacaaatttttcactgctaaaccgattgacatccattatgacagtacggcccaataaacctccaaattccacatattcgcccgcttttttcccaggaaccggaataatgcgtaccgcggtggtttttccattaataacgccaatacttatttcatcggcaataatacctgcaatggtcgaaaccggtgtttcaccgggaatagctatcatatccaggccaaccgaacaaaccgcagtcatcgcttctaacttttcaatattgagggcgcctacctcaaccgctcgaaccatccccatatcctcgctcacgggaataaaagcaccggataagccacctaccatggacgacgccatagcaccacccttttttaccgcgtcggttaacatcattaaagcagccgttgtccccggcgcaccgcaatactccaagcccattgcttcaataatctctgcaacactatcacccatggcaggagttggtgcaagggataagtcaactatgccaaattttacccctaacatttttgccgcttctttaccgattaactcccccaccctggttattttaaaggccgttttcttaatctcattggccagttcctccaagtcagctccaggaattttttctacaacccgtttgaccacgcccggaccgcttaccccaacattaacaacataatccgcttcacccactccatgaaaagctccagccataaaaggattatcctccggggcattggcaaagactacaattttggcacatcccagtccatccttatctctggtccgttcagccgtttcctttattatgcgtgccgaaaaattgattccatccatattaatccctgctctggtggtcgccacattgattgaagcacatacccgttccgtctccgccagtacccggggaatagtatttaatacatttatgtccccctttgtaaagcccttatgtactaacgccgaaaacccaccgataaaatttaccccaatttcctgcgcaatttcttctaaagcgtaacctattttaaccgtttcggtttcagtaaatccccctgctaacagcgaaaccggtgtaaccgcaacccgggcgttgacaatcggtattccatactttatctctaatttcttggcagtttccaccaagtactgccccttttcccggattttttgctttatgttttcacaggttttcgcgatactgctatcgacacaatccagaagacttactcctaatgtgatcgttctgatatccaggttttcctcctgaatcattttaagagtttctaaaatttctccaaagttaaacatttaacccctccctaaattcggtgcatagctcgaaaaatattttcatgttgaatttcaatttttaaatttaattgtgctcccaaatcactcaaagacttttttaacgcttcaaactcaaggttacagtgagtaatatccaccatcataatcatggtaaaaagtccaccggtgatggtctgactgatatccaaaatattaacgttagcctcagctaaaagagtagccacttttgcaattattcctacccgatcttcaccgataaccgtaattaaagctttttcctgcaatttaactacccctttctcttttatatttttttcaactttaaaaaaaaacgaggcgcaaacctcgtgttttatacttttattcttttaattttttctctttgaactcaagcgttttaaatcaaaccaaatgggacttgcattaaatatcgatgaatacgcaccactggttaccccaattaacatggcagtaacaaatactttgatacttgaacctccaaaaagcaacagggaaaccaaaacaaagataaccgttaataccgtatttatcgagcgagccattgtttgccacaagcttttgtttattagatcatctaaagcctctcccttttcccgtttcttcagattttccctaattcggtcaaagataacaattgtatcgttaatggaataaccgataatcgttaatatcgccgccacaaaactgctgtccacttcccattgaaatatcgagaaaagcccgatggtaacaaatacgtcatgaagtaaagcaataatcgccgcaaccccaaagtaaaattcaaagcgaaaggtaatataaagtaacattaacaccgaagcaattaataaagccaaaaaagctttttgcagcaattcgcggctaacaacgctcccaatccggtcctcacgtaaaacctctaccttccccagtttatcttccaaagctttaattacagcatcccttttcacggtgtctaactcttcagtacgaattagataatttccttcaccggttaactgaattgagctaactttaaaccccatttgggttataacatttctgatgtcctgggaaactacatttttgctaaactttacttctaaaatcgttccgccggtaaagtctataccccaattaagaccctgaataaaaagggaaataatcccgggaacaataattaatagtgatattatataccagtattttctattctttatgatgtgaaacatggccttacccccttatgccccgtacagtttaggatttttaacgactttagaatctgccgctaagaacaacagccagcgggtaaaggtaattgccgtaaacatactggcgatgataccgatactcaaggtaaccgcaaatccccgaattggcccggtacccaggaagtagaggattacggcggcaataagggtggtagcgttggagtcaaaaaccgttaaaaaggcccgtttaaaaccggcatcgatagctgaccgtaaagttttacccattcgcaattcttcttttaacctctcaaaaatcaggatattcgcatcaaccgccatacccatggacaaaacaaaacctgcaattccgggtaaagttaaagtagcctttagagcaatcatcacccctaaaacaatagttgcgtataaaattagcgcaaaatcagcgataaatccgggaaaacgataatataaaatcataaacacaaagatggctatcacgcctataatacttgctcttaccgaacgtcttaaagagtcggcccctaaagttggacctacaaccttcttttccagaatctcaagttttaaaggcaaagcaccagaacgaagcaaaacagcaatgcgatgggcttcctctaaatctttgtatccggtaatcctggccttaccgttcgttatcggttccttaataacaggattttgcaaaagtttaccgtcaaggtatatacctaaattgcgattaacatttttagtagtaaagtcagcaaattttttcgcaccctcagcattaaaagtaagatccacttcggctaagccggtattggggtctttggcttcaatggcgtcccttaaatctttacccgaaacaataacttccccttcaggagatttaaactccaacaccgccggtttaattaaagttcttaccgcttcctcgggatttttatagccggcgatttccacaataattcgatcttttccctgcttttgaatgatgggttctgaaatacctaattcatttacccgcgtttcaataatggaaatggtactctgcatagttttgtcgttaactggactgccgggaagttccttggcctgaaataccacgtgcactccgccctgcaaatcaagtcccaaggtggtatattttaccaagggcttgaccgccccaaaacctaaaaatgtataccatccaaggattaatattaaaatcagtacgccactaaatagggtaaatttacctaacctcactcccaaattcctcctctgttgacattaacaaagctattatacttttgcttgcatctaattgtcaatttcttaaagcaattttgtgccatttatcactaactcaaacttacattttaaaaactcggctgccttccggcataataccattctgcttagaaaaatctcaaaatactccattaccggacaaatctcggtatttattattaattccaaagttatcgttcgtttttgttcgttgacccagacaaaagagtgctccaccgcagaatttacgcggtcgtgaatatcataagtagcaggatcctgattcctcacccgggaccggtgaacatcggatttatccgccaagatcagggccgcagcaacgttattaaccggctggccatactgttcttcatgattgccaatggcagaaataacaatggctatctcttcataatccatcccaagcctttctaaaatttgcgcagccaaaagcgcgccggttaaaccgtgttcctggcgattaatagcatttcctatatcatggagatatcctgcgattgctgccagctctccttcccgctcgggatggcccaaacggtccaaaatgtttttggcaattgccgaaaccagtcccaaatgtctaaacccgtgttcggtatacccgagggttccaagatgttcattacttttttttatgaacgcttccaccatcggatccttttttacatcggccaaggtcagcacagagccaccacccagcttgaattattccttgtacggtccggttatcgcagattttaaaatttctacctttacattatcggataatcttaaaaccaccgttttttctttaattttaattacctcaccaattaatcctcccgccgttaatactttgtcgtccactttaagggattttaaaaattcctgatgctgcttttgtctttggttttgcggtcgaatcataaaaaaatagacaatgagaaagaagactacaaggtaaataattgttactacttgtggtgtaaaaatcttactggacatttatcttacccccttttttgtataaaaaacatctaaaactatattcgacttttttattcttttccctgctcataattttgtaaaaattctcgggcaaaaaccaataacctctcctctttaattgctttcctgatttccttcattaagtttattaaaaaatggaggttatggatagttgtcaggcgaattccaagcacctcatcattatgtaacaaatggcgaatgtaagcccggctgtaattgcggcaggtgtagcactggcagtcctcttcaattggacgaaaatcttctttgtaagcagcatttcttaccactaatttaccatacctggtaaaaaccgttccattgcgggcaatcctggtgggtaagacgcaatcaaacatatctataccccggattaccccttcaattaaagcatccggagacccaacccccattaaataacggggtttgtcctgaggtaaatgcggctccaaaacttctaacatctcatacattaaaggttttggctcaccgacacttaatccaccaacagcatatcccggaaaatcaagttccgttaaatacttggcactttccacccttaaatcggggtaaatgcttccttgaacaatcccaaaaagcacctggtcttctcggcggtgaacttctttacacctttttgcccagcggtaagttcgcttcattgcttccttagcgtaagaatattcggacggatagggagcacattcgtcaaaaaccatagcaatatctgaacccagagcttcctgaatcttcactgccttttccgggctcataaaatgcgtgctcccatcaatgtgggatttaaaagtgacaccttcctcactaattgtccgcaagggtcccaagctaaacacctgaaacccacccgaatcggttaagatagcccggtcccagttcatgaatttatgtaaacctccggctttagcaataagctcctcccctggccgtaaatataaatgataggtattggataaaattatttgagctccgatacccttcaactcttctgggctcatggtcttaaccgttgccagggtaccaacaggcataaaaaccggagtctccaccacattatgaaaggtttttaaaagtccaagtcttgctctggtattgggatccttttttagcagtttaaaagaaaacattataaacctccttaaattattaacatagcatcaccaaagctaaaaaagcgataccttaatctaacagcaatttcgtaagcattgagaactttttccctgccagcaaaagcagaaaccagcataagcagggttgattttggtaagtgaaaattagtaattaaaccgtcgatgatttgaaaattaaatcctggatatataaagaggtcggtataacccttggcaggagctacctgtcctttatcggcaacgctttctaacacccttaccacagtagttccaacagcaataacccttcttccctctctttttgctttatttactttttccgcggcctcgttttcaatttcataatactcctcgtgcattttgtgttctaaaatattttccgtctttaccggtttaaaagtacccagccccacatgaagtaaaacctcggcaaactcaaccccgtaatcttttagttcggaaattaattcccgggtaaaatgtaatcctgccgtaggggcagccgccgacccgggttctttagcataaatcgtttgatagcgctccgggtcttttaatttttctttaatataaggcggaaggggagtttgccccaactgatttaaaatttcttcaaatactccctgaaagctaaatttaattatccttcccacttccgtttgggccacaatttctccttctaaaaccccgggtgcaaaaataagcctggtgccaacccgggcacgccttccgggcttcaccaggacctcccactccctaaagttcatcctttttaccaagaggatctccacttctcctccctgctcacgtaccccaaaaagtctggcaggtatgaccctcgtcttatttactactaacaaatcgccgggcactaaatatttctttaaatttttaaaaacatcatgggtaatttcaccggtttggcgttttaagaccaaaagccgcgattcatctcttttttccaggggagtttgggcaatcagttcctctggaaggtagtaatcaaaatccttaagcttcatccttcacctctaatatattttagttattttaacaccagtataataatacttgattatctccctgtagtcaaagggaggatggtttttggtctgctgcgccattgcccaggctccccactgggacataccaaggccgtgcccccagccctgacctatgaaagtaaatttttgtggtatttcttcaacaatattatatccagctccgccgttttccattgcaacttcatcactaccaatcacatttaaattctctttatccacctcttttgtctctccatccccggttatcacatatatcttgggttgttcggtagcattcagcgggacaaacttggtttcgtatttcttttcagaaactttaacggtaaagcgcgagctatttaaaccgagagcttttctgatggctccatcatattttaatattttactacccttttcccctgtaaccgttacttccattgcccgtccggttgttgcggttttggttatttttacttcttttacctctccaacatcatatcccgatttttttagctgctcctgcaactcagaagccgtatattcttttatccatcggataacattataactacttgacccgcgagcttttaaaagaagagcggcttcatcatcataaatatcctttttagctttcaggtacggtaactccgttgtaccgtaaatggtactattggattcaatatatccgccgttactggaatgaaacaaagcagtaataacctttccattataagttatcacttctccggcagtttggtcaaccagagcatttaccgagctaaattcggagctcaagcctccgtaaacctggcttctttgatccgggtacaaatcaaattctttatcaggatttaaatggctataggcataggttctggctgctaaaatctgggcttttattgcatttaccggccaggaagcagaaacttcattgggaaccacaccataaaggtatttttctaaggaaaggcgattaactaaccttataccggtagcttttggtattattattaaatcaccgcggtaacgttccaagcgttgaggtaaggtacgttccggtgttaagttaaaattttctgtagtatcactataagcctgaaaaataacaggatttttagtaactaaaaatggtatcgggtcattgtctttgtaaagctcaagccaatattccgaaagatttgctgctatctcaatggtttttagtttaattgtaaaaatagtttcattgggatctttataaattaaatcttccacgttttttaagatacttccgtcataaatttgatatttaccgcttagctttaccttttggctctcggtcttgggtagatctttcagcaaaattcgaacctttacctgctctccagccagagtcggcatcacccttaggagaagagccgctacgattagcagcagtatcattaattttttcagtggttttttcactatttttgcctcctcccccggttaaaaccttttcctgttttttccctgattcctttttaattttatcatcttttggattttcccgaaagtttttcctgttttcctttgtttttatcttctctttcttatttacgttttcgacaggttttttattttttccagaaatcgaaggttgaggttggggtttgggtttttggtctggaagatatttttgcagtttatgaacgttaaatttttttccgggtaatacctccagcttaatttcttcacttgttcctaattccgaagtaactttagtaattgcctgttcaacctttaatccttttaattcatcgcggtatttttcaacctccggagaaagaggtaaaactttaatcaccttatcccggtaatttatgcctatttttactcccctggttccaccgacggttagataggcaaccacttccttttccttggcataggtaaggtaaaccggggcaaaaaataacaataaagaagcaaccagggcaacaattttaaggctaaagcccaaagaataaactgtccgttcgggaaattcaacttcatccccaactttataacttcccgctaatttcacttgcaaaaatcggccttcagacaagattagataagagttttcatttactttttccacaattacgccccggcccattattattcacctccccagccaaggtaggcctgtaaaccggtaaaccttccccagtaaatcaagataatggctaccaagtatttccgatacttttctatggtcttttgcttaatcttaaaacgttcggaaatgctttgcaggggtagctttttagttctgataagctgtcgaacaaattcttcatcttccgctatacctttagcaagcattattaatttctgccggctatcattatgcttgggcgaaactttaaccaattcggcaaaagttatattaaattgttttaaaagcttttcatattcagcaatttccaggcgtacatccacttcgtcaattaaatttctttgcgataaaaaactttcatccagcggcaaattttgctgataagacttattttgccggtaaaaatcaattaatcttcgtctgattatttgagcagcaaatttttcaaattctacccctttagcggaattataactttgtatagcctcacttaaagccaggaggccaatgctgtattcatcatcggacttagtaataaaacgtcccgtcaatcgggccgcaatcccaaaaataagactttcatgttggcgaatcatttgctcaaatatttcgtcattaattggattgttgggctgcataattaacccccaaaaatgtattcgttaagcaataaatttttcatggggtcttaccggcgaaaaagtaagttaagtattaaagttaacaaaagacttaataatatagaactagctagtggaaaaaagaaagtaaaatttcccttccggattaatatatccccaggcaaacgccctaagtgtaaaaatttctctcccataaaaaagaaaaaaccggtgataattaagattatcccgattaacattagaaattttcccatttctcccatagcttacttcccttccttatagtatctttccttttcactaaagatacagccgcaatacggctgcctgtataaatcgagttctttagctttttgataagcggcccgataacccggacaaaaatcttcataaacgaagtttaaaccatatttttctgctaagttcagtcctatctccttaattaagtcgtgtttctgataggggctaaccaaaagggttgtggaaacgtgattaattcctaagcttttggctttttgaaagcttttttccaaacgtgtttcataacaaaatccgcagcgtacacccggatattccagactgccttttagaaactcagtgagaggataatcgttttcatagataacttctaagtttattagagcagcgtactgttttaaagtttctcttcgtcttttaaactcctgataggggtggatattaggattataaaaataccctgttatgttatatcccatttctcttaacctttccaccgggtaaatgctgcatggagcacagcaaatgtgcagtaaaagttccatgttttcacctctaccataacgacagttccccagcatttttgttgtaagcaatacctaagtggtcataggcaagtttggttaccacacgcccccttggggttctttttatgaacccaatttggagtaaaaatggctcatacacatcttctatggtatcaacctcttcagaaatggcagcggcaatagcctcaatgcccaccggccccccctggtatttttcaatcattgtttttaaaattaaacgatcggttggatctaaacccagctcatcaatttccaataaatctaacgctgccttagcgttctcaagatttattaccccgctgctccgaacttctgcataatcccttactcgttttaataatctattagctatgcgcggtgtaccccgggaacgtttggcaatttcaaaactaccttcaggggtaatttcggtttttaataatgctgccgaccgatttattattagcattaattcttccaccgaataaaactccaagcggtggaccataccaaaacggtcgcgcagaggcgaagttaaaagccccgcccgggtagtagccccaattaaggtaaatttaggcaaactcagcctcaagcttctggcccccggacctttgcctaacataatatcaagagcaaaatcctccatagcagaatataaaacttcttctacaatcctgggaagtctatgaatttcatcgataaacaacacatctttttccccaagattagttaaaattgcggctaaatccccagggcgttcaagggctgggccggacgttattttaatatctactcccagttcattagcaataatggtagcgagagtagttttacccagaccgggaggtccaaacaaaagaacatggtctaaggcttcatttcgtttttttgctgcttcaataaaaattgaaattgtttcttttaccttctgctgtccaatatattcacttaatcttcgcggtcttaggctaaactcattttcatcttccgttaactcatatcccgaaactaatctttcctccatattttttcaccttatttctatttatttgtttaaaaaccttaaagcaagggcaataccttcctcgggagttttaacgctttttttatctattttacctaaaatttcccgggcttcagcagccgacagtcctaaactcaaaagtcccttgtacacatctccccacaaatcctggaaattttccacgctctcttcattgcttgtaaaagaagtatagccaattttatctttcaattcaagaaagagtctctgagcattttttttaccgacccccggtacctttgttaatgctttttcatctttattggcaataacccaatttaacttttccggagtaaattcatttaatattgctaacgcagctttgggaccaataccagaaacgcttagcaacaaatcaaaaaactttcttgtttcttcatcgctaaaaccatataagaaccaaccgtcttccctaacttgaagggaagtatacattactacttccgaatttaagttaaggcttcccaattcccggggaagaaccgctaccttaaaaccaattccattaacatcaacaaccaccgagtcaagagttttatccagtacttttccttttaaaacggctatcaaagcaatccccccatttttagaaaacctgcataggcaatagctaaagcatcagccacatcatcgggtttgggaggagttttaagccccaaaagcttagctatcatatactcaacctgacttttaggagcatgcccgtaaccggttacaatagttttcacttcgaccggcttaagctctaaaacaggaatatcatttaaagccgatgctaataaaacaactcctcgggcttcgccaacagaaattgccgtttttacatttttgctaaagaacaattcttcaaccaccactatttccggtttttcttgaataagtatttcattaagcttttgaaaaattatcttcaatcttttctccttggcaattgggggcgtggttattgcttgaaaattttttacaataagttttccattttttttctcaagtacaccaactccaactatagccgttcccggatcaataccaataatcttcattttaacctccaaaaagagaaataagagcctttgtacggctctttttagtcaaccagttcaaagttggcatatacctcttgtacatcatcatgttcttcaaaaagatctaaaagttttaaaagcttctgagcctcttctccagaaaccggtactgtagttttaggaagcatggtaatttcggcaatacttgttttgatgtttgcattatttaaagcatccttaaccttttcaaaagcttcaggcgcagttataacctcaaactggtctccttcatcctttaaatcttcagcgccagcatccaaaactaaaagcaaaatctcttcttcattaattcccggattatcttctttgggtatggtaatataccctttttcctcaaatatccactgaacgctccccgcttcccccatactgccgccgtgcttggaaaaaagatgcctgatttcgccggcagtacggttgcggttatcggtcattatttttagaagaatagcaacacccccaggaccgtatccttcgtaaaaaacttcttcgtaactttccgcagctaactcaccggttcctttcattattgcccgctgaatattctcgttagggatatttgcttccctggctcgagcaatagccgccttaagcctgggattggcttccggatctcctcccccaagtcttgccgctaccattatctcccgggcaagcttggtaaaaactttaccccgcagggaatccatcttttcttttctatgtttaatatttgcccatttggaatgaccagccatataaaacaacctccccaagataattacagcatcggaacctccggtattctctttttatgttgagattttctctgcattctttttacaaaatccactaactccgccgaaccttcaccggttaataaataatgatcaatgtctttgtaagtaaagcccatttcaccttcatcggtttggccttcccacaaaccggcagaaggagctttagtaattatcttttcaggaagtccgagatagcgggcaaactcccaaacttcggttttggttaaattaccgataggcaataggtcaacgccgccatcaccccattttgtaaaataaccgatttctaactctgttcgatttcccgtccctgcaaccaaataatttaaatttgcagcccagtaataaagggttgtcattctaagacgcggtttaatgttggccaaggcaagcttttccggctcgtgaggtgtggcattctttaagcttgaaaccagagcttggtaaggctcatctaaatttacaacaatatattttaaatttaaatgattggctatcattcgcgcatcctcttcatcctctggattactaaaacaaggcataataatccccaagcttttttcaggaaaagcctttttgattaaagtagcaactaccgcagaatcaactccaccggacaatccaaccagtagcccgctggcattggcttcccttgttttttctcttaaccaatttactaatttctcagtcttttcttcccaattcaccctcatcatctccttaacaatgaaaattctgataaagctaaattaataaagtgatttataagtgggtgttgtttttttctctttaaatatagcaaaaataaatccctttgcaaagctaagcccttaatcctgtgagtcgaaactaaccctaacttggttgcatttcttacagcaatttcggagcaaaaagctccccccagtcccccctctactgccgttaacaccgcttgattacttcccagctccataacaatcttaagtttcttttctgatataccaaaattttttaaggctttttccaggaacatacgggtgcccgaacccttttcccgccaaataagcggaatttttagcaaatcgtccggttccaaaacttctttttgggtgagggggtgattagccggtaagataaacactaactcgtctttataaaaaggaacaaattccaaacgcgggttttttatttccgaacctaccgccccaacatcatagataccatccaaaattttagccaccacatctcccgtatcactaatctcaagatttacctttacctgggggtaagccaaattatatctccccaagagcaagggcaaaagatattgcccggggatattacttgccccgatatttaagattcccttgggattttctttgttgccggaaatgttttgttctgcttcctcaagaatctttaaaatttcctgagcatatttatacaaaagagccccatcatcggtaagtttgattccttttacatttctttctaataatattgtattaaaatactcttccagcgactgcaaatgcttggttatcgctggctgcgttaagtttagcagctttcccgctttacttaaacttttttcatttactacagtaataaaggttttaaaatactctactttcataaagccctccgctactccacaacgatataaaagggataatttttctgccccccataaaacttttctacatcacaaaaagcatacttctcttccagtaatgacacaaatttttctgctacatcttctaaaacttcctctcccgtaaagaccgaaattaagctgttatcttcattaattaccttagcaactgcttccattgaagttaagagcacatcttttcctgcagcaataatatcaccgttaaaaatcgctatataatcaccactttttatttctaattcaccaaaccttacctctcttacagctctggtaacttcaataacttttaaattttttaagtgttcgtttattttggtaattaattcttcgggttcggcattttcatcaaaatataaggaaaccgccaccgtttgggccggattctttgtattaacaatggtaacacttttattggtaagatttttagcctgttcggcagccaagataatgtttttattgtttggaaatactattactttcgttgccggaacacgattaattgcctccacaatagccgatacaggaggatttgccgtttgtccaccatcaacgatttcatctatacccagtttttgaaaaatttcgctaaatcctttacccggcgaaaccgcaaccattcccagctttttggcaggcttttgcttttcctgactttgctccaacatattatcaatttttatattgtaaattaaaccccaccttaaccccaattctaaggcttctccggggtgattagtatggatgtgaacttttacaacgttttcatcaccggcaacgattaaagaacctccaatttccattaattcctgccgaattttctccaagaataatttttcccctttgataataaactcggtacagtaaatataatccataccaacttcatctaactcttgttcttccttttttatggaaaaatctgcttccggtaaatttaaagtaatactttcatcttttaacccggctaaacagccttgcaaaaataaaacaagccccataccaccagaatcaacaacccctgctttttttaaggcaggtaaaagttcaggggttttagctaaagccacttctccgtaacgaattgcttcgtcaattaattcaataatgttaactttgttacgaatgcttttcttaaatcccttaccgatttcccttaataccgtaagaattgttccttccaccggttgcgctacagcccggtaggcgtaaaccactccgtattgaaaagcttttgataattccgaaacacctgcctcgcgcttgtttttaaatccccgggcaaatccgcgcaaaacctgggacaaaataacccccgaatttccccgggccccaaacagagcaccctgcgcagcaatatcagccaccttgcccaaatgtacatccatcgcttgagatattttttccgcagctacctttaaagttgccgccatgtttgttccggtatcaccatcaggaacaggaaacacatttagctgatttaatttctccttgttgcgctcaagattcgcagcagcagcaataatcatcttggcataatcaataccattaattttttccaacaataccactccctaatcctttgctaaatataccgtaccaagagcaccaggtccgatatggcttccaataaccggtccggcagaatatatctctatatcatttctctgtaacttttctgtcaatttagcttgcattttcaccgcagcatcccgcgcataaaattcaactactccagcccaaaccgcatcgtcaggaattaattcgtataatttttcaaaggctttattaaaagttcttattttttccacaacctcaattgccccatcaaccatggtcaaaaccggtttaatttgcaagatacttccaaaaagagccgcagcaccgccaatccgtccgccccgatgcaaaaactccaagctatcgggaacaaaataaagcttcaatcttggaaccataccagtcagttcctcaaagatttttttcgcaggttcaccctccctggctttctgcaccgcatattttatcaagtaagtttcagctcctacaattgccttggaatccaacacgtaaattttatcttttccaacctcatttgcagccgtaagggcactattatacgtcccgctgaattttgaagaaatagtaatgcacacaatctcgtacccgagacttaacttttcttcaaacacttttttaaaagctgcgataggcggttgcgaagtagaaggtcgttctttggtactcattaatatttcataaaatcttttggtttcggctaaatcgtcaacaaaatcatgtggtccaatatgcgcagtaagcggaactatttccaagtattccttattacaccccacgtaatcggaagtcaaatagccaatggaatctgccactataaaagtcttagacattacgttcccccatttcacaattattccaatttttttaacaaaaataaaaattttttatactactttaagattttaatcaaagaaataatcaaattcaacatttttcataaatcgacaataaaatacccttaccaaatcaacatacctctggtatgataaaaacggaggtgttaataaatggttaaactggtaagagaagggacaaccttcggtcaaaaagatgtaattgagcttttggtagagttttcctcttttaaagaccgggttaacaaaaaatttaaagaaatcgcccgggagtttgaaggaaaaagtaacgaacacgacctatgggtaaatctttatttaatcgcttcagattatgccgaagaaatgcaaaaccgtaaggccaaacaggaaatgttaagccaaaaaataagttaagaatttttaagtaccaaaatttcttctggagttaattctctatattccccggggcttaatttattatctaaaattaagcccccaatccttattctttttaagtaaacaacggtctttcccaaggctaaaaacatcctttttacctgatgatattttccctcggttataacaatcgttccatgtttatctcctactttaccgagaagtcgggcaggtttggtaaggtaattatcttccagcctgataccggtttttatttttgaaaaatcttcctcttctaaaggtttatcaagctcaaaataatattctttctcaacctcttttttgggagacgttaaatgatgcgctaactgcccatcatcggtcaaaatgagcaaaccttcggtatcaatgtcaagtcggccaaccggaaatattttccgatgaaccggaactaaatcaacaacggtaggataacgccggtcaacggtagcggaaacataccctttgggtttgtttaacataaaataaacaaagggtttatatttaacttcttcacccttaacaattaccttatcggtatccacattcaagttatatcccgggtcctttaccaccacgccatttacttcaacctttcgtgcctttaagagttttctaacctctttacgggtaccaaaacccatatgagctaaaaatttatcaatccgcattttcatcctcctttgcttcatcggcattaatcttggcatttgcaaaaatcgcccggtatttctccattaaaagcggaactttccttatgtaattttgcgtttccgaaatataaagataattattgttataaacgttgccaggtccagcattataagccgctaaagctaactgccagttaccaaaccgtttgtattgaattgctaaatacctggcaccgccaataatattttgctcgggatcgtaaggatctacccctaaaccccgggccgttttgggcatcaattgcatgaggccaattgctcccgccggacttattgcattgggatttcctccggactcttgctcaatcaccgcggcaataagcgcaggatctaaattataaagttccgccgctttaaaaatgtattttgaccaacggagaaccctgtgcttttggtcaatatactccataaaattccttgaacccacagcaactttttgccggtcaccggaaatataaatgcgcatggtcaaaaagtcggcaaaagccgttaaggcgttttttaaattgcttttaacaataaccccggaagaaaggtcaaaattacttcggtcttttctgttaaaattcgttaattcatgtcccaaaaaagcaatggtatcttttaaacccttcttaaattcataatatttttcctttttaaaggaaagagttgcttttttgtcgagtttaaactctttcgggacaacactgtaagggggattgtagttagctattttcataattaacatatcttcaagctttgccggtgtaaaataaagaaaaattattattaagagtaatataatacccactaccttggttaactctaaaaaaatccctttaactttcttccaaagtctattaaacggtctacccatcggaaaatttaaaactggtttcaaacccttctcccccaaagcatcggttagttatgttaatgttctacctctattcctttatttcctgcaaaaaaaggggtgtagtttgccactacacccttagtctccttcacgagaatacggaataccaactgaagccggtggttgagcttttctcaccacccctgcgagaactaacagcgttaacacatacggtatcattttgataaattgatagggaactactttactttgaaccaccctcatactaatggcctcggcaaaaccaaagaggaaggaagcccaaaatgaaccgtaaggcatccagtttccaaagatcatcgctgctaaagcaataaatcccttaccctgggtcatgccttctacatacatatgggtgtgttcaatcgagagataagcaccagcaagtccagcaaaagccccgctaattattacccctaaataacgatagggtattactttaacaccaagagtatccgctgctaagggattttccccgacagcttttaaacgcaacccaaaaacagttttttccaatacccagtaagtaacaaaaacaagcaaaatcccaagaataattatcggcgaaatatccgtagcaattggttttaaaacgctgatattctttaaaatcggaatatcaattttcggtaaaccattaacactgggactggtagtagccatgccaaacaaagcaatactaaaaaatctggccaagccgtaagccaggatatttatcgccactcccgagacgatttggtcgacccggtaagtaacggtaaccaccgcgtgaatcaatgccaccaacatccccatggcaattgccagcaaaaatccacctaccggaccataatgcagcgcaccgtaggctccccaaaaggctccagtcatcatcataccttcaaggcctatattggtaacaccactgcgttctgagtaaatcgcacctaacgcggtaattaaaacaggaatggtcatgcgaagagccgaggctaacatttccataatatcgcccattattaagcctccttcttctctaatctctttatataacgtcccaaaatgttagcagcaactactacacttaaaataattattccctgcatgataacaatggtttccatgggcacacccataaaggtttggacaccctcggcaccacgattgagaaaaccaaaaagcaatgctgctaaaacaattccgaaggggttattgttacccatcaaagcaacggcaataccgttaaaaccaaagtttttcggaaagtccaaatccatatagccatagaaactcagtaaatgggaaagaccgatcaaccccgcaatagctccgcttaataaaaagcctttaaaatatactttattagggttaatacccgcagcttcggaagctttggggttacttcccaccgcacgaatttcatacccaaaaggagtgtgccaaagcaaataatacattcccaccgttaaaagcaatccaattacaaaaaaccagttcaggtaaacagagtttggcaaatctataccaaaaaagcttaaaaacccgtgaagctttggcattaaggctgtttcagcaaaatgcggagtccgaattaaaggactacccaatccttcaggtactttttggttgcggtccatgaaaagatccgcaataaaataatgaattaacgaataggcaatataattaagcatgatggtactgataacctcatgaactccgcggcgtacctttaagtaaatgggaacaaaagcccataatactcctcccagcatggctgccaaaatggccagaggcaaatgaataaatgccggaattccgctcaaagtaaagcccacaaaggcggcaaaaaaagcccctataaagtactggccttccactccaatgttaaaaagtcccattttaaaacttaaggccacagccaacccggaaaaaataagtggtgttgcgttaaataaaatttcgccaacactatcagcacttcccaggctaaactcaatcattgtttggtaaacttcaatgggatttttgccaattgcaactattaataccgaacttaaagcaatggcaaacaatatggcaactattggcgttaaaagctgtagtagtattattttgaaccgcttattcattaacctacccccacttccttatatgccccgagcatatactgacctatttcttccaattccatttcacccggcacaaactctttgacaatttccccattaaacataatacctacccggtcagaaagggaaagaacttcttctaaatcggcagaaattaaaagcacagattttccgttattccgggcttcaattaattttttatgaacaaattcaatggcccctatatccagtcctctaaccggctgagcagcaataattaaatcaggctcataacttaattcgcgagccaaaattaccttttgctggtttccaccggaaaggttacgaattgcctgttcaatagagcctaaacgtatatcaaattcttcaacctttttattggtcagggatttgattttatcccggaaaagtttccaccatcggctatactcttttttgcgttccaagccaaggaccatattttcccacacggtcatcggtaaaaccagtcctcgctgatgcctgtcctcgggaatataaccaaccccgatttccctgatggctttggtatcaagtcctttattgctcttaccctttattaatatttccccgccatcataaggtaatagtcccataattgcttctaccagttctctttgaccgttcccttccacaccggctataccgtaaatttctccggcacgaatggacaaactaagtttatttaactggtggcggtcaatgctgccttttacttctaagttccttacttctaaaattacatcaccggtttttacgatcggcttttcaagtctaaacaataccggtctccctaccatcatttctgctaactgttttttactggtttcggaagcttttacggtaccaacaacttttccccgccgcaaaaccgtaattctatccgaaatctccagcacttcgtcaagtttatggctgataaataaaattgttttcccttcctgttttaatttccttaggttaacaaacagttctttaacttcctgaggtgtcaaaaccgcggtgggctcatccaggattagtatctcggccccgcggtataaaacttttaaaatctctacccgttgctggtgccctaccgataaatccccgacctgggcatttaggtctaacttaaagtcgtacaattcacataattcttccacttttttcttggccttggcaaagtctatcactccaccgggactattttcgtaaccaagaataatgttttgaactacattaaaacggtttattaacataaaatgctggtgaaccattccgatacctttattaatggcatcccgggggccgttaatcctcactttttctccttttaaaaacatctctccctcatccggctgatacaatccggtaataattttcattaacgtacttttcccggcgccattttctccaaccaaagcatgcacttcccctttgagggcatcaaaggagatgttgtcgttggctaccagcccgggaaaacgtttggtaattccctttagttccagaactttttccaccgtatttcccctttcctcgtttttaccaaaatagcaataaaactaataagaggagatgacaaaactgtcatcccccctcgcacagtataacggttttaaacgtttttgtaaagtttttattaagttaattttaaaatgctactttatttcctttttactggtgggtactttaatttctccattgataatttttgttttgatttcttcaagtcttggtttaatgtcggcgatcaaatccttgttaaactcattttccgcatacccaacgccattttctttaagaccaaattccttgtacccacccttaaagttgttctctaccatgcttttaatggtctcaaataccgcggtatcaacccgttttaacatactggttaaaatgtaaggtctttgcgcttcaggagcagttaacgattggtcggagtcaaccccaatcacaaattttttctgactagcagctgcttcaattacccctaccccggaagctccggaagcatggtaaataacatcggcaccgtttttaatttgcttcaaggtcaattcttttcctttaacaggatctttaaaggcatcaccggtagtaccaatgtaatcggataaaacctgaatattggggttaatgtattttgctccggcaatataaccagcttcaaatttttcaattaaaggaattttcattccgcccacaaatccaattttgccagttttactctttaaagctgccgcagcacctaccaagaaagagccttcatgttctttaaaaagcaaacaagtaatattgctgtcttcctttaaatcaggcacatacccgtcaattaatgcgaacttggtttccggaaagtccttggccacttttgctatggcatcggtaaacatgaaacctacaccaaacaccagatcatacttatctcgagccagtaatcttaagagttgctcccggttttccccaccggccaaaggttcaagatatttaacttcaattttgtcaccaaactctttctgggctctttctaaacccgcatatgctgcatcgttaaaagatttatctccccggccgccaacgtcaaaaacaagtccaactttaattttcttagtttcctcctgtttggcaggctcttcggttttcttggcacatccagctaataacgttgaagttgcaaaaatcactaagacaaaggctaccaacaaagatttaaatttacgcatcccttttcctcctttataaacttacttaaaatttactttacatacattaacataaccaaaaaaaataaattttttaccccgtcacctcctaatacagtacacagtattcttttttttctcaagctaccctttttcctgcctcgtaatttattcgacaacttctttaatattcctgctgaattaacaaattcgcggtaaattttcccccaaaggcatgttgataattctttcaccgccaatacggttctttacgtaaaccaacccggccggagcttccttaacttctccaattatcgcggcatctttccctaaaggatgagcctttattttttctaaagctttttccgctatctccggaggcacaatcataattaccttcccttcatttgctaaagcataaacatccaatcccaaatatccgcataaagttttaacctgcggtctaatgggaactttctcctcccagagctcaatccccacattgctttgtttggctatttcatttaaggtagccgctaatcccccccggctcgggtcccgcatagcatgaaccggatattcatgaataatagactttacaagttcatttaaaggcgcacagtcgctcgtaaaatctcccggaatattttcccgtactgctaatattgcggctccgtgatctcctaaatagccgttgacgagaattttatccccgggtctggcctttttccctgacggattattcggggtgttaattataccaaggcccgcggtatttatataaattttatctcctttacctttttctaccactttagtgtccccggtaacaatttttactcccgctttttctgccgcttgagcaattgattggataattttttctaactcgcttagttctaatccctcttctaaaatgagtcccaaagacaaaaataagggttctgcccccatcaccgctaaatcatttacggttccgtatactgctaatttaccaatatctccgccgggaaaaaatagtgggtttactacaaaactatcggtagaaaacacaacttttgttccaggaagggataataccgcaccatcgtccccctgctgaaggtattcgttatttaaatattttttaaaaaggttttcaattaatcgttcggttaaccgtccccccgccccatgggccagcgtaactatttccatcatatttaccttgctacctcctaccgtatttataataagctgcacaactaccttcgctggataccatacaagctccaacgggcttttccggggtacaccctttggcaaaaagagggcactcgggaggtagcatccttcccaacataatttcaccgcacttgcaaccccggggaacaatcggcggcttttctctcaaaccatatttttttcgcgcatcatattgggaatacctttcacgaataaataatcctgacaacggaatattacctattccccgccaattggcatcgcctttttcaaaaacttcctcgataatcctctgggcttccacatttccttgttcccttacgacatggggataagcgttataataacttggttctttttttaaaattgatttaactaccaaacttattcctaaaagaagctcttcggcggtaaatcccgtaaccgcagcaggtatttgataattttcggtaataaatctaaaagctttggctccaattactgctgaaacatggccgggtaaaataaatccgtcaattaagctgttgtgctccaccaaaaatccaagggcaggaggcactgtttttaccgccaaaaacatggaaaaatttttaagttttttcgtatatgcttccaaaattgtcgctcctaaagccggcgcagtggtttcaaacccggctccaaaaaataccacttcaatattgggatttttttcggcaaattcaattgcattccggggagaataagcaacttttacagaaaagccctgggcttttaaaatacttaaagttcgcccctctccgggaactttcagcatatccccaaaagtaaatagggtaacgttatgtttctcaagaagctcaaaagcctctaccattatttcctctccggttacacataccgggcaaccaggcccagaaataaggttgatattttgaggaagtaaactccgaatcccatgctcgaacaacgccatcgtgtgcgtgccacaaacttccataatattaatggttaagtcgcttttctgaactatttccataatttcacgaaaagattttaatatgctgctgtttgtcattcccatcttaactcctttaacaattccaccgtttcttgataagcctcctcggaaattatttccactgcataaccggtgtgaatcaagacgtaatccccttctttggcttcaggaaccattataaggctaactggttgccttactccccctaaatcaactaccccaatatcgccctctattttttcaattttaccggcaactgcaaggcacataaactatcactcctcacaaagcttatttgcaagataggcctgtcccaatgcaatcccttgatcattgatgggaatataagaaggtatgataggttttaagcctaatctttttaaactaataaaagttttttccagtaaaacacgattttgaaatactcctcccgccaaaattactttttgaataccgtattgtttattaacaattttgccaagccccgcaatcatttcaacaatagtattatgaaacttgccggagataacttttttattaacacccttttttaaatcggcaagaacatcaagcagaagaggtctaaagtcaatttcgtaaggaattttttcctgtaatattgtaaaatcatagcatccccgttcacttctgtcggcaattgtttcaagtaaaattgcagcctgtccctcgtaacttatggtggtttttaaaccaagcaaagcactaatgccatcaaaaagccgtccgacgctggaagtaaaaattttctgctttgccaaacgtttttgagcaaactctaactccatcctttcaatatcctgaaaaattaaattagctacatccacctgcacctcgtttaataaactgagggcagatttccagggctttttaatggcctcatccccatccaataaaggaaaatattttaaatgggctattcgctggtagtcttctggcgtaaaggctacaaaaaactcgcccccccagatcatcccatcttcaccgtaaccggttccatcaaagattacccccataaagggagcttttattcgtttttcagcaacaactgcagccaaatgggctttgtgatgctgaattggacactttttaagcttagaatatttttcttccaccagttccgaagaaaaataaccgggatgcaaatcatacgccactatttggggagtaaattcaaaaaacctgcaaaaatcgtctatacctttcatgtatgctaagcgcgacggtagattatctaaatcgccaaaatactggcttagataaacataattatccttagtgatggcaaaactgttttttaactgaccacctaaggctaaaattccctctttcatcccccgtactttaagaggtaaaggcgcaagtccccgagcccgtcgtaaaattaccgggctttttttatagaccattgccaccgaatcgtccaccggacgtaaaatcggccgattattaactacaaaaaaatcggcaatatcttttaactttaaaaaaacttcatcgtcttgataaactataggttcttctgaaagattggcactggtcattattaacgcctcaaaatgctccaacaaaagataatgaaaaggggtatagggaagcataatacccaaatagtcgttgtccgggcttacttctttaacaatttttgaacttttctttttgcggcataaaacaatcgggcaaacattagaggttaaaagcttttcttccgcttttgatatatatacatgcttttttgccaccgttaaattttttaccatcagggcaaaaggctttgcttcccggtgtttacgctgtcttaaaagtaaaaccgtctttacattaaaaggatcagccgccaaatggtaaccaccaagcccttttaaagcaacaataaaccccttttttagtaattcttgtgttttatggatgacttcaccgtctttagccaataaatttttttctttatcatacaagaaaagccttgggccacaagcaggacaagcaaccggttcggcgtgaaaacgcctgtcttcgggattcctgtattctttagcacattccggacagaggggaaatattttcattgaagtatgcggacggtcatacggtaatttttcaataatcgtataacgcggcccgcaattggtgcaatttataaagggatattgatatctccggtcagaagaatcccttaattcctgcaaacagtcaccgcaaacgggtaaatcggcgggaacaatcaaaacccctttccggtcgcgctgactttcaatgatttcaaaggtttcaaaattaccggataggtttaaaggtattaccgaaattttttcaataactgccaaaggcggtttttcctttttaattgccgcaagaaatttatttacattttcttcctcgccttcagctaaaatttctactcctgccagactatttttaacccagccctttatctcccacttccgggcaatccgccagataaaaggacgaaatccgattccttgcaccaatcctgaaactacaatttttttagcaactttcatttatgcgccgcctcttttgcttcgaaccttttctgctataaacataattaacggttctaacccttcttccgtgcgagcacttacataaaaacgttgctggtcaggatttatagcttgaaggtcatcttcgtattgctttaaatcgaagtcaacgtaatttaaaagatcaattttattgagtaccgaaactgccgcttcccgaaaaatcaccggatatttcaatggtttatcatttccttcggtaacactcaatatgaccattttcatatcttcccccaaatcaaaacctgcagggcaaacaagatttcccacattttcgataattaatagattaatctcgtcaaggggaagtttttctaacacctggtttatcatattggcatcgagatgacatccacctaaggtattaatttgcagagcaaaaacgccggttttttctattctctcagcatctttggtagtggtcaaatctccctcaattacagccggttttatatcaggaggaagtttcggcaaaattttttctaaaagcgtagttttcccggctccgggagaactaatgatattaattacgaaaatatttttttcgttaaatatttttcggttcagagcagctatagcatcgtttgcctttaaaatattggtggtaagttgaacctgcatttttattccccctcatagtagtcgattaacaattcgtctccagctattattttaacattactactaaagcagtgcaagcagtaagaagaaaaacaatctatcgtacttattttccgacaattccggcaaaagatctgggcttttacctgttcaatttccaaaacagcatttttcgccagaaggtcccctttggccgcctcaaaggcaagctctaaagcttccggtaaagcattggttagctccccaacttttaacttgactttggtaatcttttgaatgccattggcctttgcactttcccggagaatttccaagacactttccattaaagcagtttcatgcataacaacattacccttcccttcaaaaagagaaaaccgggttaatacccggaacttaactcctttatgatttctctttttactttttctttcaccgcttccaattcagggcttaaatctaacccccagcccatttcttttggctcaacaccataaataatgattttatttaaggaggaggggtcctgaaacttaagcattcccaaaacctccatcaagcctacctggtgtagggaaagggaaaggggaaaattaatctcaatatctgtaggcttgaagcggtaaacagttcccgggacacctcctccctggaccgcatcgactataatgaccttatccttaccctcgataaaatcaagaaggtctaaagaagcggtgccaccatcaataaattcgacatcttctaaatggtattcagctgctaactctctaacaatgtgaacgccaatcccttcgtctttaaatatgctgttacctatgcccaaaactaacgtttttcccaaagaaatcacctacatggtttgccttaattgttcctttgttaccactgtctcttcctcatcaacggtaacatagccggtaatcatcgatttgataacccccaaaccttcggttaaatcgagatacaaatggatggcaactgttatgacaaaaatccagtttactaaatagtggataagccgggcaacgtttaaaccaccaaagaggtaagctaaagttggaaaggtatcaggtttatataaagcaagtccagtcaggatttgaataatcagtaaaacaccccaccccgaataaactaacttttgtcccgggttgtacttcccccagttagggtgttcatcagtcaagaacagataatatcttaaaagggccggaaagttttttaagtctctaaatctaaaccagatattttgataatctttggtagcaattgcataatagacccgagctaataatccagccatgacaacgtacatcatataaaagtgaagctttcttgctgcatccatagttgaaaagaagttgtactttaaaggattgtgaatataaaagcctgagataatcaatgaagtgattgctatcatattaacccaatgggttactctaataaacaggggatggcgcaacaccttccgggccatgatcacacctcctaataaattttgaacttgcctaaatcctgacccggggtaaacaggtgaacggcacaggcaaggcacgggtcaaaagcccgaactacccgagccacttctattggattttccggatcccttaccggtgtcccgattaaggcttgttctattggccccaataccccgttatcgtcccggggagaagcattccaggtagttggcaccaccgcctggtaattggcaattttgtaatttttaattttaatccaatgccccaatgccccccggggagcctccgtaagccccatcccttcactctccttgggaatttcaaagggagtgtgggttggtttacccggttcaagctcattaatccattcctccatcgcatgagctattcgcgaagtttccaaggcacgagccagatgacgtcctaaaacggaaaaagctttttcacccagtccgcgaatcttcttttccccggctatccacattctcgccagcggtcctacttccatcggatgaccatcataacgcggagctttcatccaggaataggctccatctttacccggtttgggcgctgtaactccttccctggggtgcttctgggaattggcatcatcaaaccaggaatattttaaatgttcggtaatcttttcgggattcagttcttgttcttgtccatttatataaatacccgctttaaaaaatctttcgctgccatcttctttttgggggaaactaccataactcataagattttggcagcccctcccaatgtcaaaataatctttataatattcggcaattgttaaaacatcaggtatatatacattatcaataaaagaaataagttcttttaagcgggagcgaaaattgataattttttgagcatcaacattctccgaagaccctccgggtacaatccccaccgtatggggcattttcccaccaaagatcgctgccatttcatgagcttttttccgtatatcaagagcttgaatataatgttccaccactttttgattaaccgcagccggtaaccggtaatccccttcataacgggggataaacggtgaagcatccgggcctttaacataatccaaagcacttagatggtaaaaatgtaaaatgtggtccattaaatgatcggcaccaaaaattaaatttcttaagatccggccattttttgggggttgaatcccaaaagcgttgtctaaattaaaggtggcagcagtagcatgagcggtaggacaaaccccgcaaattctttgcgtaatttgttgggcatcccgtggatcccgtcctaccaaaatagtttcaattccccggtaaaggactcccgaacttttggcatctacaactttacccccgtccaccattacttcaatctttaaatgtccttcaattctatttagcggatcaactactatcctttgggccattactcttcaccttcctttttctttttcttatgtccacccaagcggccggtagcaatattgccaattaaatgagcaccaagcccgatggctgtagccgctccaaccacttcaccaaaggtatccgccgaagcggaaatccccggtaatttaatttccggcattttttcgtaaatcggaccggtcttatccggaaatcccggttcagtacaaccgatacacgggtgacctgcttttatacaccaatttaccccaccgttccaaagccttgtaggacaatcagaatgggttacaggtcccttacagcctaaaagaagtaaacatcccggctcgctaaaatccttggcaaaaatactgttgtcaaaatactggcgtcgtgggcagttgtcgtgaattataccttcgtaaaacatcttgggccgaccaaatttatcggttttcggaagttcattgtacaaaagcacatgcgccaaacttccaacaaaccagtcaggatgtggtggacaacccgggatattcagtactttcttgggatcaattacctccgttactggaacacatccggtgggattggggtcagctgccggaataccaccaaaagcagcacatgtaccaattgcaataaccgctttggccttttcccccagttcttttaccacttcgctaaaataaagttcccgaccgtctttttcaccaattgagcagtaaaccccgttatcttttgttggtactgcaccttcgaccaccaaaaagaatttacctttatttttctccgcttcacctaaaaaagcttcaacagcgacatgtccagtagcagcgcttatattgggatggaattttaagttaataatctctaaaagaatttccttaatatccggatggacggagtttaacagggaaaccgaacatcctgtacaggaagctccctgaatccaaataactggcggctgacccttagcggcattttccagggcatatgcaacttccggaacactctgggacaacccaagggtcgcagcggtaaacgacgcaaactttaaaaattcccttctggatatcttgttcaatcccgaaaccccctcttattaattttcgcaataacctcttcctagcaatttttataccaaaataaaaaaccccggattccttaatccgggaacataaaattgtctattttttagacagtttgttgcaaaaatccttgagtttcgtaatttttaattaatttgtctattttttagacatgtctattttttagacatttaatctttaagctataactttcgcacaaacttgtgaaaataataattttctcaggattatgttataagttttttttatatgctttttcatccgggtacaagttgagagttaagcttcaattccatactccttgattttttgatacaaagtagcccggggaatacccagaagtttggcacaggctaatttattatagttagtagcttttaaaccctcaattataagttttttctcaacttccgctactgcctccttgaaagttgtaatttttgtaattctctcccccgacagcgctttggaggttaactgagcaggaaggtgctcaggttttattaaattgccttcagccaggtaataagcacgttcaataacgttttgcaactcgcgaatgtttcccggccacgaataattcattaagatattcattgcttcgctcgttacaattttgggagccatttttcttcgctcacaaaactcgttcataaatctattaactaacagcgggatatcatcccggcgttcgcgtaaaggcggaatatttatgttaaaaacatttaaacggtaataaagatccatccggaaccggccttcttttaccaatttagcaagcggttgattggtagcagcaataattcttatgtccacctttctcggcgtgttactaccaatccgttcaaattcacgattttgaataaaacgtaaaagtttaacctgcatacttagtggcatatcgcctatctcatcgagaaataatgttcccccatcagcctgttctatttttcccgccttacctcctcttttagcaccggtaaaagccccttcttcgtagccaaaaagctccgattcaagtaagttttccggtattgcagcacaatttatggctacaaacggcttgtccgccctctcacttaaataatggatagtccgggccgcaatttccttaccaactccactttctccttgaataagcacattaccatcggacatggccgctttttcaattaatttttttacttcaattattttttcagtctggccggtaataccatccaaatagtattttttgcgattttccatttcgtatttattacgataaaactccgcttcaccccgggttttctttaataaaaaaggaaggcacatatcaatttccgcaagtccctgatatacagctatcgccttttcccgacaagaattatatccgcaagctccacaatttaattcatcttcgggggtaaatttatcggtataagccaagatctctcttatttcttcttcggtgggcaacggtagttttctggcttttaccgtataccttactctaaaggttccagcaggtttcttggacaaaattgttttatttcctttacttaattctaataaatactgtcgcctttcgatatacgttaattcactatctatttccggcccatcgatacatcctctgcaaaataataaatcgtaaaacaatactcccgacgttctattatttgtaaggctttctaaagtctcgattatttgttcctttccttccactgaaatactccgctggctttcaatttcataacctcgttgctttaaggacaaaattaaacctccaggtattggaaaggactgagtaaagtttcgcggatactcgtaagtatccccaccattaacaccttttaacaattccttaatttctttaaaggttaaaaccgcatccacataattttctctaaaatttaatgcctcatttttcttagcaatacagggacctataaaaaccaaaaacgcatccggttcctccatttttatatactttgctaatgcttccataggtgattttataggagccaagtgatttaccaaagttggataatgtttttcaattaaggatacaatagcaggacaggcagaactaataacataatcctgcgtttccttcaaatattttccgtactccggtaaaattatttcaactccagcggttacttcctccactctggtaaaaccaaaagcttttaacttaccgtggacctccccgggttttaacggataaaaagacaccgggtaggaaggggccaaaagcgctattactttgccaccgttttttattttttctaaaacaacttctttaaacgaataaattttttttgccccctgactgcaaacccgaacgcaattgccgcaagcaatacatctctcctctaacacttccgctttttgctcttcaatttttattgctttaaccggacagtttctaacacaagcatagcaagctttgcatttttccttatcggttgttacaatttgcaatctacgcaccccctaaaggttttagggcccgttctaaaattcctgcatcgtaagcaaaaagcattccgtaattaattattttaatacccttttctttaaaaaactcaattcgtttttccatttcttcctgggttaacatacatcctccacagtgaattgccaaatccaaatcaccgttaattttaaactctcttcctttgtaaaacgtataattaaaatttaacccggtaagtttttttaaaattgctggtattttctccgaaccaatatcatttttctgaacgtggtgaacacaggcttcaaaaattccaatctttgcaccctcttctaaacgcttcatatgctgtattccttccaaaaaaaaggcaagttcgccgcgaaatctcgccataagtattgaaaaagatgttaaaggaatcttatccggaagctgttcccgaacctgagcaaaggcttgagaatcagtaataactaagccaggttcctctttaaggtttaaaaatagctcttttaggctttccggttgaaccacatgcgctataatatgataatctaagagttctcttaacacaagcatttggggttgaattagcctacctttaggggctccagcatcgattggtatcactaagacaacggattttcccttaggtactaagtctgctaccactgttttttgaactttttcctgaagattttgaactaaaaaattacgcaccgcagaacttgcaccatttttacaatcatgaagtaaatagggaatattaaatttttcaaaaaactttttccaagcttctaagttttccgttttgctttcaaccatattaataatcccaattatctttttcgtggtttgattttcttcaataaactgtaattcccaatcctccggcttaaatcctgtattaccaaccaaaataacgacactacaagtagctaaaacttctcgggttttagcctttcttatttctcccaaaacggaagtatcgtccaatcctggtgtatcgataaattcaaccggaccataaggtaaaagttcaaaagctctacggttaggatcggtggtagtaccaggaattgaagaggttatggctctttcctcaccgataatattgtttaacaatgttgattttccagcattacaccgtccaaaaataccaatcgttttccgaaacagtcgtaatgaattttccatattcatcacctatataaatacatctttttcgccctttaaaatgtactcaatagcccgccctatgttttcaaagttgggtaagtcctttaccacctgcaacaaatatccattaccttttttatatagttcaggatgcttgtctcttatctcataaagatattccacaaacgaaaaaagcgcatcgggagtacaaaaatctttgatctgcccccggtcagccaatcccataaatgtttttcctgttcttcgtttgcgatagcaggctgtacaaaaactgggaaggaaccctttatcaattaaaacctcgacaatttctgctaaggagcgatgatccgaaagtaaaaattgctgtctttcttcttcgcctttttttccccggtattctcccggaccggttcgggacgcagcactcatttgggaaacaccaagttctactaattcatcccgtaaatgctgcggttcccgggtagatagaattatgccggtgtaaggcagcattattctaagtagagcgactatctttttaaatttgtggtcacttatcttatagtcattagaaaataccgaattcagtgcaggctttaaacgcggaaccgaaactgtatgaggtccaattccaaattttttctttagataatcggcatgagcaataactccaagtaattcaaaaagcggatctccaagcccaaataacgctccaattcctatatcatcaattcccgcttcgatcgcccgctcaacagcgttaagcctccagagaaagtttgttttcggaccatccagatggacttcgcggtaaacttccggattatagctttcctgaaacagctggtacgttccaatttttagtttttttaagcgctcataccccttaagggtaagaggagctatatttacatttattctccgaatatctacctcggaatagatggcaggaattatttcctctaaataagataaggttttatcttccggttcctctcccataactaacaggatgcgcgtatgtcccatctcccggatagctttagcctcatccacagcctcttccaatgacaggcgaacacgagataattccttattttcccgacgaaaactgcagtaactgcagttattaatgcaaatattgcttaaataaagaggtgcaaataaaacaattcttttaccgtaaatctcttcttttaccttccgggcctgccaaaataaaatttgatctaactcttcagtgtcattggcaaaagctatgcccgcttcaatcaggcttaggcgctctcccttttgcaatttttgaattatttgggaaatctcctccttgggattccggttaactttatttacaatttcataagttctttgcactaacgtgataatttcctgagtcatcttttaatcccttctttttttgatattttttattaataataactttttttaacacaaaaaaaaagagcgcaaatttgcgctctttagtgttaaattcctttaaaaactaattatctactgccgatagagttttcctcattaaagccattttattgtgacttttggaacttttgagagcaaaatataaccctccaattccgataattccgtttatagccacaagacaaagcattagaaatacaattatatatacaaccatcgttatgccacctgccttttagttaaatagtattttttccaaaactttcttttaatcatattgtaaacgatgtttgttattgtgtcaactttcacttaatatttttttattttataaattttctgtcaccacttaaaaaaacagggcaaactgccctgctttgtgtcaataatcttcgccgctaaccaacccctgcattattgatacaccggaactggtccccagtctcgttgccccggcttcgatcattttaatggcatcagcaaaggaccgtattcccccggaagccttaacttctgctttttcgccgacagtccgtttcattaaacgaacatcttcaacggttgcccctccggttccaaaccccgttgaagtctttacaaaatctgctcccgcttcaacagccaattcacaagctttaattttttcttcatcggttaggtaacaggtttcgataatgaccttaaccacaacggtgggattttttccctttgccgcacttactacctcttttatgtcctctaaaacttcttcgtaccttcccgcttttaaggcaccaatattaattaccatatcaacttccaatgctccattttcaacggcccaggaagcttcataggcctttaccgccgtgctggttgcccccagcggaaagccaattacagtacaaactttaatttcagagtcttttaataattgggatgcaaacggtacaaaagcaggattaacgcagacactcttaaaattaaactctttagcttcttgacataatttttcaatatcggcataagttgccgttgcttttaatagggtatggtcaatcatttgcgcaattttagtagaacttaccattaattttcctccttctctaaggtaaagtaataaggtaaaatttgctctaaagtaaattcttttatgtcccccgccagattagctaagtaaattgtttcaatcttaaattcggccatgaattgacggcaagcaccgcagggcgagataggtcctggtgtgtcccctactaccagaatggcttttaactttttctcaccttcacttattgcttttgttatagctaccctttcggcacatatagttagcccgtaagaagcattttctatattagccccttgataaatttttcccgactctcctaatactgcagcaccaactttaaaccccgaataaggaacataagcgttttctctggcttctttggctttttcatacaataggttttttaaatcagacatatttctctactcccttagacgtcaccacagctttaataaatggagccttttgagggggcctactatcaattttaaaagctgcaaatacaattttttgcgcatcttccaatttcttttcatcattatagtgaagttcggctaagacatctcctcttagcactttatctccaacttttttccttaaaacaatcccaacactgtggtcaattttgtcttctttctttgccctgccagctcctaagtacatggcacctaaaccaacctttaacgcatcaacctcaatgacaaagccttctttttccgctttaatttgggatatcgcttgtgcttttggtaaaagcgcagggtcgtcaatttggtgcacattacctccctggcttttgacaaactcttttaacttggcaaaagccttacccgattgcaaagcttcttttaacatttccttaccggtttcaaaagtatcggccttccgggcgagaaaaaccatatatccgcctaaggtaagacaaagttctgttaaatcctccggcccttcaccctttaaggtcgctattgcctctttcacttccaggctattacccacggcaaaccccagaggttcacccatttctgatataacagcgatcgtttctctcccaaccctctcgccgatctttaccatggcttgtgccaactgaatgcttccttctaaatccttcataaaagctccgctaccggttttaacatctaagactatggcatcggcgccaccagcaattttcttggacatgatgctggaagcaatcagcgggagactatctaccgtagctgttacatctcttaaagcgtacattttgccatcagctggagcaagttttgccgtctgccctataaccgctatacctatatcattaacctgctttataaactcttccggggataaagctacattaaaaccggcaatggattctaacttatctaaagttccaccggtgtgtcccaagccgcgtccggacattttggcaactggaacccccaccgcagccacaagcggtgctaaaactaaagtcgttttatcacctacacccccggtactatgcttgtcaacctttatcccggaaattgctgaaagatctactttatccccggactccaccattgccatggtcaaatcggcaacttcttcatcatccattccttgaaaataaactgccattaggaaggctgccatttggtagtcaggaatctcaccacgggtaaaaccatggacaaaaaagtaaatttcctctttagaaagtttttctccgttccgttttttcaagataatgtcgtacgctctcattttttatccctacctttgcccgtatttatttaaataaaaatcatgcattacctgaatttcttccggttccaataataccggaccaccaataattgtcgaaagaagaaaaacttttgctcctttttccactacccgtacaactcgcaaagcttcttccatgttccttcctaccccaactacgccatgattggctaaaagaactgcaaatttgtttcccaaagctaataccgcgtttcgagccagcactcccgtacccggtagagcatatttagcaacttctacatctccaccaacaatctgggctaaatcttcaatcaccgccggcaaccgtttgcgggctacagcaaaagccgaagcatacggactgtgggtatgaacaatcgcccgaatatccctcctggctttgtaaatttccaagtgcagctggtactccgatgaaggctttagctttccctgtttgatattcccatccaagccgatctcaactaagtcctccgaatccatagttttataatccacaccgcttggggtaataagaaaagaatcatcgctaattcttaggcttaaatttccccaaggagataccaccaggccttccaaaacaacctctcgggctgcggctaataactcttccctgctcaccttatttacctccaaagagttttttaatattttctttatagggaggacgaacaattcctctatcggttattatcccggtaatatattttgccggagttacatcaaaagcagggttaaaaactttaacctggggcggggctattaaccggtcgccaatttttcgaacttcatcaggatttctttcttcaatggggatatcctgtcctgaagttaaattcaaatcaatagtagaataaggagcagcaacataaaaaggtatcccatgttcttttgctaaaatcgctaaagaatatgtaccaattttattggctacatcaccgtttgcggtaacccggtctgccccaacaacaactaaatcaaccagcccaaggctcatcacataaccggccatgttatcgcatattaaagtaacatcaattccatcttctaatagttcaaaagcagttaagcgcgcaccctgcagtaaaggacgggtttcatcggcaaaaaccttccttaattttcccgcctcaaaagcggccctgacaacacctaaagcagtcccatagccggcagttgccaaggcaccggcattacagtgggttaaaattgaggcattttcaggaacaacttctaagccataagccccaatttttttattcagttcaatatcttcataaaatatgctgttggcttcatttaaaagggcattagctatttcttcgaaggtttgattttttacttcaagatattttttccacatccggtctaaagcccaaaataaattaacggcggttggccgggtatttttaagcgtttcataaacatttttaagataaacctctaaattctgatcatttctataccccataaccccgagaaccattccgtaagctgccgcagccccaatggccggtgccccgcggaccttcattgagacaatagcttctgccacctcttcatatgttttaagtttaacgtatttaacttcgataggtaatttcgtttgatctaataaaaataaggtattatctttccagtacattgtatccattatattctcgccccttcccactgttattataacacttttccaacactaccaaacactaattttagggacggttctgataaccaccattttcatgaggaataaaagtaaaaagggataggcagattgcctatcccttttagagttttttccggcagcgacctactctcccgggacctatcgtcccagtaccattggcgctggagggcttaactgccgtgttcggaatgggaacgggtgtttcccctccgctatggccaccggaaacttattctggaagttggatgttggagattggaggttggattttataattaaacctcttctcctcacctattccttgaaaactgcacagaggcttattttggaatttatggttttaggtcttcggttttcggtttttccaacctcaaacctccaacctctaacctctagtttgaaggtcaagtcctcgacctattagtaccggtccgctcaaccgattgctcggcttacacgcccggcctatctaccggatcttctctccggggtcttactctggattgctccagatgggaaacctcatctcggggctggcttcgcgcttagatgctttcagcgcttatccattccgcacttggctacccagcggtgcccctggcgagacaactggttcaccagcggtgcgtccatcccggtcctctcgtactaaggacagtccccctcaagtttcctacgcccgcgatggatagggaccgaactgtctcacgacgttctgaacccagctcacgtaccgctttaatgggcgaacagcccaacccttgggacctacttcagccccaggatgcgatgagccgacatcgaggtgccaaaccccgccgtcgatgtggactcttgggcgggatcagcctgttatccccggggtagcttttatccgttgagcgatggcccttccactcggtaccaccggatcactaagcccgtgtttccacccagctcgacccgtcggtctcgctgtcaagcacccttatgcctttgcactcgccgcgcgatttccatccgcgctgagggtacctttgggcgcctccgttaccctttaggaggcgaccgccccagtcaaactgcccacctgacactgtccccccacccgctacagggcagcaggttagaacttcagtgacgtaagggtggtatcccaccgccggctccacctgagctggcgcccaggtctctcagcctcccacctatcctgtacatacgccaccaaaattcaatgccaggctacagtaaagctccacggggtctttctgtcctatcgcgggtaacctgcatcttcacaggtactacaatttcaccgagcccctcgtcgagacagcgcccaagtcgttacgcctttcgtgcgggtcggaacttacccgacaaggaatttcgctaccttaggaccgttatagttacggccgccgtttactggggcttcggttcagagcttcgcctttcggctaacccttccccttaaccttccagcaccgggcaggcgtcagcccctatacttcagcttttcgctttagcagagacctgtgtttttggtaaacagtcgcttgggcctcttctctgcgaccccctcgggctccagatgttcatccttcaccctaccggggcaccccttctcccgaagttacagggtcattttgccgagttccttaacgagggttctctcgcgcgcctgtggattctctcctcgcctacctgtgtcggtttgcggtacgggcaccctcgccctcggtagaggcttttctcggcagcttggattcggttgcttcggtactctatcttccctccccgtcacctctcgggctttccgtgggacggatttccctatcccacaccctaccggcttggacgcgcttttccagccgcgcgctcaacctatccttctgcgtcaccccttccctcaagcgggctcgggtggcaggggattctcaaccccttccccatcacctacgcctctcggcctcggcttaggtcccggcttaccctgggcggacgagccttccccaggaacccttaggcttccggcgggcaggattctcacctgccttctcgcttacttatgccggcattctcacttcctacctgtccacgtaacctcccggttacgcttcccccaggtaagaacgctcccctacccatactggaagtcggtacctccaactcccagcatgccgaagtttcggtggcgtgcttgagccccgctacattttcggcgcagagtcactcgactagtgagctattacgcactctttaaatgatggctgcttctaagccaacatcctagttgtcttcgcaactccacatccttccccacttagcacgccctttgggaccttaactgtcggtctgggctgttcccctctcgaccatgaagcttttcccccatggtctgactccctgcctctaagctacaggtattcagagtttaactgggttcggtaacccgtgaaggcccctagcccaatcagtgctctaccccctgtagccaccagcagaggctaggcctatacctatttcggggagaaccagctatctccgggttcgattggcatttcacccctacccacagctcatccgccgccttttcaacgacggtcggttcgggcctccagctggtcttacccagctttcaccctggccatgggtagatcacccggtttcgggtctgctgcacgcaactttcgccctcttcggactcgctttcgcttcggctccggcctttccagccttaacctcgctgcgtacagcaactcgccggcccgttctacaaaaagtacgccgtcaggctctattcgccctccgactgcttgtaggcatacggtttcaggtcctatttcactcccctcccggggtgcttttcacctttccctcacggtactcgtcctctatcggtcgccagcgggtatttagccttggagggtggtcccccctgcttcccatagggttcctcgtgccccatggtactcaggctcgtacgctgcagctacgcgtaatttcggatacagggctttcaccttctatggcggagtttcccaactccttctcctattacgcttcactgccgggtacatggcagtgtacccacccgtacggcctcctaccccgcatacgcaacggctgccaccttctacacgtatgcggtttgggctcctcccctttcgctcgccgctactcagggaatcgcatgttgctttcttctcctccgggtactaagatgtttcagttccccgggttccccccgtacacctatggcttcagtgtacggtgaccggccattacgccggccgggttcccccattcggaaatccgcggatcccagctcgcttgcagctccccgcggcttttcgcagcttgccacgtccttcttcggcctctggcgcccaggcatccaccgtatgcccttactaacttgaccttctcctttttacccccaacctctgtgcagttttcaaagaacagattcatatggtggtaggtggtatgtcgtcggtcgtcggtattttacctcgactcacatcttcctacctttttcattttttgtacctggctcggtcggtggttgtggctttcgttcttcctaaccacttaacacttaccaccgaccactgttaataacggcaagcggcttctctctccttagaaaggaggtgatccagccgcaccttccgatacggctaccttgttacgacttcaccccaatcaccggtcccaccttcggcagctccctccctttccgggttaggccactgacttcgggtgttaccggctttcgtggtgtgacgggcggtgtgtacaaggcccgggaacgtattcaccgcggcatgctgatccgcgattactagcaattccgacttcatgcaggcgagttgcagcctgcaatccgaactgagagcggctttttgggatttgctccaggtcgccccttcgcttccctttgtaccgcccattgtagcacgtgtgtagcccagggcataaaggccatgatgatttgacgtcatccccaccttcctccatcttatcgatggcagtccccttagagtgcccgtctttacgctggcaactaagggtaggggttgcgctcgttgcgggacttaacccaacatctcacgacacgagctgacgacaaccatgcagcacctgtctcgcggttcctaccttccggcaggcaccccggtgtttccaccaggttccgcggatgtcaagccctggtaaggttcttcgggttgcgtcgaattaaaccacatgctccactgcttgtgcgggcccccgtcaattcctttgagtttcaaccttgcggccgtactccccaggcggggtgcttattgggttacctccggcacggaacatttcctgccccacacctagcacccatcgtttacggccaggactacccgggtatctaatccggttcgctcccctggctttcgctcctcagcgtcaggttcagtccagagagccgccttcgccactggtgttcctcccgatatctacgcatttcaccgctacaccgggaattccactctcctctcctgccctcaagtccagcagtatcaggtgctcccccacggttgagccgtggccttttacacctgacttaccagaccgcctacgagctctttacgcccagtaattccggacaacgctcgccccctacgttttaccgcggctgctggcacgtagttagccggggcttcctcctccggtaccgtcatccactcacccttttcgaatgagtgaacttcgtcccagaagacaggggtttacaacccgaaggccttcttcccccacgcggcgtcgctccgtcaggctttcgcccattgcggaatatcccccactgctgcctcccgtaggagtctgggccgtgtctcagtcccagtgtggccggtcaccctctcaggccggctacccatcgtcgccttggtaggccattaccccaccaactagctaataggacgcgggcccatctgtaagcggtagcatgctcccgcctcagccacctttcctatcaggtctctaaacctgatagcgtatccggtattagccccggtttcccagggttatcccggtcttacaggtaggtcacccacgcgttactcacccgtccgccgctaaggaaacagttgagcaagctcaaccgcttcccccgctcgacttgcatgtgttaggcacgccgccagcgttcgtcctgagccaggatcaaaccctccataaattcaccccacaaaaagcttcgctttttgcggggaccccgaagttttaccccaaaaaatcttgcgattttttggggaccccggtataaaaacctgtttacacaggctaggtcctatgaaagggtcaatccaagctttatttgcttccgtacccttaccgagtacgggccgcttgccgttattcccttgccaaggtacctgtcgctttcggcgtttcccgccgtcggcgacgtctcttaatttatcatatctctgcgtcccttgtcaagcggttttttacctgcttttttgcttccggtccttatcgctgacgccgtgacgcttttttaatatatcaaattcctttaccttttttcaagggttattttctggaaatacaaaaaccgccggtgacttcttcaccagcagctttatggaaattaaatgaactttatccaactacttcaaggatgaaggtaacataatctggggtacttcacccacgataaccgtttcaattataggaagtttataggaaagctttgcctcttcactaactaatggaatcgctactttatagctcgcttttaaaataaccgaaagctgaaatctggtttgattaaggccgcccgattcaaaggaatccaaacaatttacttcaacgtatcccatcggtataaaactaatctttatttttggaccgaaggaagccaatacctttaaaccaaataactgtccaaagggaatcgctactttttgttttctcaacaaattaatatgtttttgcattctattgccaattcttgcagctaacttatgaaacaaaagtgtattggattgaaccaaagttatcttgcctttttgatccttttctatccgaattaatttttctgtctgaaactcttcactttcaatttcctgaagtacaacttttgtaaattcttcagtgataatttggtttatgcgtactttagctaaatttaaaaacaaatctccaatgtatcgctctactatccaggtaaaagttaaggtaaataggagcattaaggtaacaaacaccttaatacgtcttatttggtaaggggtaaaatacaaggctatcaccaccccaggttataaaatagggtatgatagccgtacacaaattgttacttttcaaagataatctttaaaaatcgccgttttccaaccttaacagtatagggctctttagagggttttaaaacaaaattaatatcattgattttctcttgattgactaaaacagccccctgagaaattaaccttttagcttcacttatgctttttacagttcccgcagaaaacagtactttaggcaataaaacaactccaccatcaattaattcacctggaaccttatattcaggaatttcatcgggcagctctttctcacgaaaaattttaataaactcccgttcggcttcatcagccgcttcgcgggaatgatactgagtaataatttcttttgccaaaaatacttttgcatcccgaggatttaacacacccgtttccatttggattttcatttcattaattgtttccattggaaccgatgttagcaattccaggtaacgcaaaatgagcgtatcaggaatcgacattatcttcccaaacatttcttgaggcgtctcatttattccaatataatttccaagacttttactcattttttgcacgccatcggtaccttccaatatcggcatcataatagcaatttgtggctcttgcccgtattctttttgtaaagttctacccatcaaaagattaaacttctggtcagttcctcctaattcgatatcggcttttagagcaacggaatcatatccttgcattaaaggatagaaaaattcatgaatactaataggctgcccctctttaaatctctttgcaaaatcttctctttcaagcatccttgctacagtatatttggaagcaagttttattacatcggcaaaagtaagcttagctaaccattcgctattaaaaaccattttggtctttgccggatctaaaattttaaaaatctgctcttgataggtcttggcattttccaaaacttcttcccatgatagctgcttccgggtttctttttttccagttggatccccaatttgggcggtaaagtccccaatgataatgattacctcatgtcctaaagattgaaactgttttaacttttgtaaaaccaccgtatgtcctaagtgaatatccggtgcagtagggtcaaggccaagctttacccttaaaggctttccttcatttaaggatttttttagcttttctactaattcctcttccggaacgatttctgcaactccccttttaattatctcaagttgacgctttaattcgtccactggcatctccttcctatgcatggtatattctaagcttaatatttattatgtattattccttaattttccgtcaaggtaaaactttttcaatacatctttcccaagatatgttataattttttttaagtaaaaggaggtcttaaagtggaaaaacaacgaaaaagaatgccaaagtggcttttagtttccctgctggtatttactctattattttttattggaacaattgccgtgggtagttatatttattattgtttaaaagacgtaccctctttctctcccaaaatgctggagttgtctggaaccactttaatttttgataaagacaataatataattgctgaagtccatggcagtgaaaatcggatacctgtaaaaataaaagaagttccggaggttgttaagaaagcaataatcggtgctgaagatgcccgcttttaccaacatcacggtattgatttaaaagctattttaagagcagccctggaagatttaaaatatggagctccgaaagagggagcaagcacaattacccagcagttagttaaacttacctttttaacctcagaaaaaaccctaaaaagaaaaattcaagaggcatatttagctatccagctcgaaagagcttttaccaaagatgaaatcctcgaaatgtatttaaaccgtagttatttcggtgaaggcgcttacggaataaaggccgccgcccaaacttactttggcaaagatttagatgaattaactttaagtgaagcagctcttttagcaggcctacttccagcaccaagtcgttattctcctttaaacaacaaggagctggcgctaaaccggcgcaacattgtcttaaataaaatggttcgagcaggcttgataactgaagaccaagccagaaaagctaaaagcgaacctttaatcttaaaccccaatcttatagacaaaagtcaccataaatataaatatccctattttgtagaatatgtaatcgaacagcttacagaaaagtttggaagtgaccgggtttttcgcggtggacttagagtttatacaaccttagaccccaaaattcaagaagctgcagaaaaagcgttatcagatcccaagaacttccccaaatccaagcgggataaagatggaattttacaacctcagggtgcagtggtagttcttgatcctaaaacaggtgaaattaaagcaatcgttggagggcgtgaacataatcagctacggcagtggaatagagctaccaggaccaaaaggcaaccgggttcagcctttaagccaatcattgcctacggtccggccattgaaaacggcatgtctccggctacagtaattgatgatagacctattaaatacggcaaacattcttttgtcaattccaatggcaaatatcggggattaatcactttaaggactgctcttacttattcagtaaataccgttgccgtacaacttctcgataaagttggctttgctgaagcatttaaatttgcaaaaaagcttggcattgagctaaatcctaagcttgaatcaaacctcggggttgcccttggcggtcttacggacggagttacccctcttcaaatggcagccgcttacggagcctttgccaataatggaatttatgtagaaccatcggcgataatcaaagtcgaatcagccaccggcgaaatactctatgaaaataaacccaaaaagcggatagccatgaaaccggaaaccgcttttatgattacttcaatgctcgaagacgttatttttaaaccgggaggtactggttccgctgcacggttagaccgaccggttgccggaaaaacgggtacaaccgatgaaggaaaagacctctggtttgtgggttatactcccgatttagtcgctgccgtctgggttggccatgataaacctcaaccgattcccggaggattcggcggtatctatccagccagaatttttaaagcaataatgactgaagctttaaaaggagtaccaaaatctgacttcgaaaagcccaacggtattatcaaagccactgtatgtggaaaatcaggacttttaccgagtagtgactgccctcagaaccagttggtttatgattattttgccaaaggaacagtaccaaccaaaatttgtaatgtccatgtaaaagcagaaatttgcgctgattcccatttgctggcaacagagtattgtcccaataagctgaccgtcagcttaattgatctaccctatgaagttccgagttacgttttagactactcattaaggttacccaaagaaaaatgtaatattcacggtccgggaagccagtcttcaactcaagaggtagaagtgcccatttgcaccgatccatcccacaacggtcaggacttcttggctctaattcccaaagccggtgaaagcggaggttgtccaccccaatatgttaccgttaaaaagtttcccaaagataaggtaccaaaagtttactgtgatataccggaacatcaaataaaacctgcccaaggtaatgacaatcaaacaacacctcccggcaataatcaaacaacccctcctaacaattaggaggggtttactttaaatatacctccgttgcttaattttctcttgttgtagggcaatttagaggccttgaggggtttactttaaatatacctccgttgcaccatctcccccttgattttgcggtgcaaaattaaattttttcacaaaaggaacttcccgtaaataatcccataaaaatttttttaacgcaccggtacccttcccgtgaataattctaaccttctctaccccggctaagtaagcattatctaaatatttttccaccaccggttcggcctcaagggtattcataccccgaatatcaagctctaaattaaaattttgttttttggttaattctaagcctgcttttttaacctgccccttctcgttttctttttcctgtttttgcgcgggccttatttgatcaaaacttacatttaacttcattatccccgcttggactatggcataattttctccaacagctaaaacttccgctttttgtccaacttcaaccaattccaccgtttctcctactttgggccgataaggttttattggttcaaaaggcaaggcaaaattttgcgagaactctttagttttctggcgtgcctcttcaagaagttttgccaaatttttttcctcataagtcttaatcttttcttttatttcctcaataacaagcttacctttccgttcaatttccaaaagcttctgctgatacttttcccggtactttctaataatttcttcttttgttttttcaagattttctaattcatcattaagcttagcttctttttctttgagggatattagaagatttgctacttcttctttagccttttctaactgccgcttctcttgctcaacgtcaaaaataagcttatcaagtttcaactcttcttccttcaaaaagcttttagctttttcaattatttgttcttttagtcccaagccctgggcaatatacaaagcattactccgtcccggttttccaatgtgtaaacgataagtcggttttaagctttcaggatcaaattcgaccgaggcattttcaacccgctcggtctctatggcataagccgcaagttcactggtatgggtggttgcaactacttttaccttttttccccgaagttcttccagaattgctttggccaatgcagctccttcccgggggtcagtaccggtccccagctcgtctaacaataccaagtctccttcccgggcattttctaaaataaattttaaatttagcaaatgagaagaaaaagtacttaacgattgaacgatactttgctcatcgccaatatcaacataaacttctccaaaaaggccaatttctgtctccggggaggcaggaataaacaagccagcccgagccataatggttaaaatccctatagtttttaaagtaacagtcttaccgcccgtattgggtccggtaataattaataggtcaaattctttccccagagttaagtcaaaaggtaccgccttctttcccagaaggggatgacgggcctgtttaaaagataaaacaccgttttcagaaattcttggtttatacgcatctaactctaaagcaagacgcgcttttgccacaatcaggtcaatttcccccaaaagctcataagtacgtttgatttccgttaaattacaagctaaacgttgggtaaaatctttgaggattttttcaattatttccttttcctgtaattctaaggttttaagttcgtttcccgcttctactgcactgtacggctcaataaataaagtttggcctgtattagaacgatcgtggataattcccggtacctgacttttataagaagcttttaccggtaaaacgaacctatctccgcgtacggaaataagaggctcctgcaaatatttagcaagttcaggttcttttagatatttttccactgcttctctcattttgtcctttaaacgggctatctgcccccgaatcctttttaattctggagatgcttcatctttaacagttccttcaggccaaaaacttctttcaatatcttttacaagagcttcatcaaaaaaaagcaatttaactatttgctttagccgtggaaatgcaccgcgactaatctcaaaaaaagtatctttagaaactttaagcaactgacctaaacgatatatttcttgcccggttaacatgctttctttagaaagttttagaaaaatttcggagaaatccgaaagcacacttaaatctaccgttttaaatcgcaaataggaaagtccttcttcaacctccaaaagcttttcctcaataatcttgctatcggatagcggtctaacttttaaagccagttgttttccaggaaaagattcggctttctgccagagtttattaataatatccggaaattcaattttttccaaggttttttgattcatttcttactccgctcctcgaaaataatgcccggtggtaaaaccttcaggataaaggtgtttaagagtttccagacttgtaatctccggttcatatttttcgcccaagttatttaaacgtttaatttcttttcgccaaatttccaccactttatacactttatccggatcttctgcaggaagttcaaggcgtaaatattctatacctggaagttcggtgaattccgagagattttttaaaatgtttaactttttattattaaaaatatgcattcggcaaaattggtcagtttttacaggaaatttgacccctaaccggtcttttaagtaataatcccccaaaaagcatgccttaccacatcctttttcccgggtcattcctcccgccacagatcctataacgcagtattcacttaccattaaaggtaaatccccaaaaaccactgcttccttagccattccagcaaatcttgccgtttccttaagcattttaaaggaaagctcgagggaaagtgttgctctatctatcgaccagccgtgcaaaaccacctcggtcagtgaattaaaaacattaaaagaaaaatccgcagcaagcctgtatccgaatttattggcataaaaaataataccgggatttcccgctaagattcccgaaaagttgtgatccttttgcatttcttcgaaaaataattctaattcctggtctttagtaatccttgggacgtgaagccaaacttcttgataatcctttttcactgaaaatatttccgcataattatacggttttttaaaaaacctttcccccgctaaataaacaatatcggcccctgcccgcaaagcattaatggctgcctcgttacttccaacttttaccgtaagtttaaaaatgttttgtttttgcttattacttaccggtaaaaaaagcttttggcttgtaatctgtctcttatacttatttataatcatagccgaaagtttttcaattgcttttcggcgaagtttatttaattcacttgcgggaactaaaaccccttcctccaagccttccgcaactgtttcactgagtgaaaatggggtattaccaaggcgattaagctggtcctgcaagtacttcaaatttgcaggatgttttaatgcagtttcaacaacatactccgactcaacttccacccggtggccaaagccgtcagaaagaattaatctcaatggctctccccttcgggcaattactttcgccaaaagcggaaattttcttatttcccgctccctggtaaaactttccctcgcctcttccagcaagcgccgactggaagtcttaaatacccggtcctggggaaatacccgctccggaagataaaattccacgaggtcacctttttctgccctatctactttttccttaccccggtagagggagccaatttctactccaacccttcctccttttttaacccaaatttctaccccgtctccttcttccagacggtcctctaacttcacccgaacgctatttttacgttcatcataccctacaacccgtccgacaaaaacccctcgattattgggacgctggtaactcattaattcctgcccgggttttcccaaaagatatgctgttgaaaaatttctattaaaaatttcacgtagctttctatcctgttcttcactaacccggaaattttgcgggtcattaaaatataaatctatcaattcacgataaactttaaccaccgtcgccacatactccggtcgtttcatccgcccttcaattttaaaggaatccacaccggcttttattagttcgggcaaaaacgcacttagatttatgtctcgagtactcaagagatactcgcctaaattctccccgatttctttttcatctttaattaacctataaggtaagcggcagggttgagcgcacttcccccgattaccactgcgctggccaattatactgctcattaagcactggcccgagtaagagatgcacaaagctccatggataaaatgctcaatttctatcccagttttcttctttacctcctgaatttcaaaaagcgataactccctggctaaaacaaccctttttattcccagctgtttaattaaggaaatcgcctcactgttatgaagcgtcatttgggtactggcatgaatatttaagtcaggaaaatactctctaattactttcgccagccctaaatcctggacaattacagcatctgccccttctttatagataagttgtaaaaacctgaatacttcttttaactcgtaatcagtaactaaagtatttaaagtaatgtaagcctttactccccgtaaatgacagtaatcaatggctttaactatttcttcatcagtaaaattttcggaaaaatgacgggcattaaaaaatttacccccaaaatataccgcatctgctccattttgcacagcagctattaaattttcataagctcctactggtgctaaaagctctggtttttttaacatttttttaccccctaaataggtaaaagagcgtggcctaaaccacgcttaccttttaaccctaattaaacctgaagttgcaattaccttaattccattttcctcaagcttgtcaagccacaaattcatccccagggagtcgctggccatatgcccggcaactactacatttatattatgcttttctgcctcttttttatgtttttccgatatatgcatggtcacaatggtgcctacatcggtagtagaaagtttggcaaacatttcatcggaaccactggttcctccggtcatatctacaaagattttgccgcatcttctttccggtgcgcccacaactatggtgggaccagccccaattttggtcgcttctttatattccggtaactccttcaagaaatcaacaacttctcctaccgtttcaggttttttctcgttaaaataattggttaaataagtagttacaagattatccgcaggagtatggacgctcataaaagcaaagcccaaaagcttcgccgcatcaatggcgcggttatggtttaaaggcattaaaccgcgctttacctcgccaattctcggtgccattattccttcagctacatttatgggtacgccaagctgatgtaaaatatcttcctgaagatgcattacttcataaagcttggcaatccccgaaccttccgggtggtgggttattattaaatctatttttgtccccttttcggtaaggcgatcagccagtaatacttcaccaacttccatatcaatcccaaccaatgcggtatgtatctcttgctctaaatcgcccaagtatacccgggtatcgctataaggattggtcaggttttctaagtcatactcttctttttccttttccgaaagcttttcataacgctttttttctttttctaaagcttttaatacttgttctttaccccgtgggtcactttccatccccatttttactgctaactcataaatttcttttaatttcattttcccactccttatttatttttttgaaacatacttattattctttaggtaaaatctataaggcaaatccttccccgcattaattcctatccgcgtcgtcacaacaatatcttcttcagctaccggctcccctttggtaatatataaaattttacccccggtcaaatcatgtccgtttaattttaaatcaatcgccaaaccctgggttaattttgccggtccacttaaaagttctctttcacttttacctccacgtaaagttttaatgatatcaataccttttaccggttctaaagctcgaattaatactgcttcagcccggcctatagcgccggttaccacattaaaacaataatgcatcccgtaagtaaagtacacatacgcatgtcccggcggtccaaacatcacttcatttcttttggttttgcccctgtaagcatgacaggccgggtcattttgatgataagcttctgtttcgacaattttgccaattaacaaatgtccgttatattcccggacaagataacaatttagtaaatctttggcgacaattaaaacatctctggcataaaactgtcttggtaagagcataagcacctctattataataaaaaacttaaatcaatttggcaatattttcttattttctccttaaaaatttttttagggattttaaatctttggcgtttaaaacatctttttttgttaaaagagcctttctggctacagtaactccaaattgcaggtcattggccagacggttggtatcatgagcatcggtattgatagcaattaagacaccttcacggcgggcatggcttacatattcatcatttaaatctaatctttccggagagctatttatttccaaagccgtactgtattttgccgcctgggcaattatttcttcaacatcaacatcatattgttcacgccgtcctagcaacctgccggtaggatgaccgataatatccacatgttcatttttaattgcctcaattatccgcgccgtttgttcttctttggggagtttaaaaccggtatgcaccgatgctaccaccacgtcaagctgcgccagcaatttatccggtaaatccagagaaccatcttttaaaatatcaacctcgataccttttaacacagtaattccttctaattcccgatttaacgcttctatttctgcaatttgagctaataacctttcttcgtcaaggcctttggccacggttaaactttttgaatgatcgtttacagagatatattcatagccaagcttttgtgccgctaaagctaaatctttaatagaatttattccatcactgtgctgcgaatgaacatgtaaatcccccttaatatcggaagcagtaattaaatcatccgtatccgcttcttttaaaaattccagcaatccctcagcagtccgcaattccggttcaacataaggtaagcctatggattgaaaaatcatttcttcatcactataacttttatccaaaaccccaatagcttttacaaaattttcaggaccagtggtcaagaataacttattcccccagctattaaaagtggcaaaatcaattttaaccttatatccttccggggctaaaaagagcagtccatcgttttggtcaaggagcttaaaaccaaaattccccataagttctgtaaatttttccttcgatccattaaaaattatcaaaaaatgataatagggaattatttcttcttttaatcttaaactacctgtactacttactttttctacaccgggtaagcttttaataaactctaaaatttccgtttgattacggctatacaagctaatggtgattttttcctgccattcccgcgctgaagctatccccactaaaatttgttgctcggttttactgcctattcccggaatttcctttagtttatgagcttttgctaaactttctacctcatcgagggtattaggtcggtaagtttcatatatttgcttagctgtttttaccccaatccccggtattttcaataaatcaaaaataattagcggaatttcctctcttagtttttcatactcaccaatacgtcccgttcggtaaaattccaagattttttctcttaaattttttccaatccccggcaattcttcaaggcggtcttcgctgataaagcgttcaaggtccttaatattccgcaatattctggcagcctggcgatacgcattaattttaaaaaaattttcctccttatattcaagcatcaaggccatttcatcaaaaatacgacttagttgtaaacttatcattctttgtccctactttcttcgtttaaagcagaagccaactggtcatatttttgttttaaatccttcagttctttttctaaggttaaaccaagcaagacatagttccagtgccagggaagcttcgggtacttttcctttagctctctaattctttcatccaaattccgagcaagctccaccacttcttcttccggtaactcactttttaaatagtatttttccccgtcaatctccacttcaattcgtttcaatttaccacctcgttttctaaagaaagttttttaaaaatacccccgaaaagccgggggtatttttaaaaggtcctcaattttgcaccagttttagcctctaaagctttcaggacttgggccatgaaattattaatttcttcctcgcttaaagtcttttcagttgagctaaaggttagtgaaatagcaatactctttttgtttggaccaagcttttcgccttcgtaaacatcaaaaatctcaatatttttcaatgtattaattgctaaaccttttatgacctcaatgaaagtggcagcaggaatttcccgttccaccaaaagtgcaatatcccttttgacctcgggatagggggataaaggagtatattttttctccgccggaatcaaagtttttaaaaggtcataatttaattcaaacacaaggggagtatttttaaattcatactttttttggacaagaggatgcagttcaccaagatagccaatttccgtattttctaaataaacccgggctgcctttcctggatgaagaaagggcaggtctttggccgcagaaaaactaaagttattaatccccagggaagtaaacaggctttctaaaatacctttaacataataaaaatcgtattttctgggcttattataccaatcgccatatctataaccaagggcaataccgccaattagtttggtttctttgggtaagtcttcgccatttttttcaaatacatttcccatttcaaaaagtaacaaattttcctgttgacgattttcatttcttttagcaatatccaagagtccgggtaacaaagtagtacgcatgaccgactgttcaatgcttaatggatttaaaagtactacactttttgtaagcacctcgtccacagaaagtcctaatttattataagagtccggattaataaaactataagtaatgatttcctgcattcccaaagcggttaagagattttttactttatactcaaaattatactccggagaaaagccagtggtggttataccaatgggcatggtatccggaaaattattatatcccagataacgggcaatttcttcataaatatcagcttccaaagaaacatccggacggtaactcggaacttcgacaaaaattttcttttcacctatagtaactctaaatcccaaagactccaaaatttcaacaacccgtttggcatccaaagaaatacctaaaaactcttcggctctggaaaggctaacagcaattacctttggtgtaaattttttgggatacacatccccatatcgaccctgtatagttcccccagctaattcgcaaatcattagtgccgctttaattaatgcccttttaatcccttcgatatccacatttttttcaaacctctgcgacgcatcggtgcgaagcccgagttttcgggcagttttccggaccgacaccggattaaaccaggctgcttcaataaaaacagtttttgtatcatcatccacttcggtattttgcccgcccataattccggctaccgcaatgggtttttcccggtcagcaattaccaacatttcggaagttaattccctttctacaccatctaatgtagtaattttttctcccgctctggcgtttctaacaattatttccggcgaagcaagcttatctaagtcaaaagcatgtaaaggctgaccgtattccagcaaaatataattggttacgtcaacgatattattaattgggcgaatcccggcctttcgcagtctctgttcgagccataatggcgaaggacctacctttacatttttaatcacaatacccatgtaccgcccacaaagttcaggattttgaatctcaatggaaaccggacagctaccattatcaagaggcaattccggctcagccagttttaacctgtggccggtcaaagctgctacctcccgggctacacccaaaaccgataagcaatctccgcgattcggggttaaatccagttctaaaaggtaatcgtcaagctccagaactttttctattttttcacccaccggtgcttccgggggtaaaagcattaaaccaggctccgcaccttttctttccaaaagtcccagttcctccgccgaaagtaacattccctgggaaacaactcccctaattcgccgttcctcaattgttataccgttaggcagtttagccccgggaagagcaaaaggatatttaaaaccggcaaaaacatttttggcaccggtaacaacttcaaaaatttcttttccggtagaaacctttgttttaaaaagctccgttccaggaagattttctacttcaagcacttcaccaacaacaactttttcataatttcctatataggtaactttttctaccgcaattcccaccgaagtgagcttttctcccagttcctgggcggtatacggtatctcacaaaactcctgcaaccagttataggaaatattcactgagaagccccccttaaaacatctgcaaaaaccttatgtcattatcgtaaaaaaggcgtaagtcatcaatgccgtacaaaagcatggcaatccgttctaaccccattccaaaagcaaatcctgtaaccacactgctatcatatccggccatttctaaaacccggggatgcaccataccggaacctaagatctccagccaccccgaacctttgcaaactttacagccaataccgccgcaaataacgcaagaaatatccacctcagcgctgggttcggtaaacggaaagtaactgggtcttaaccgcattttagttttgggtccaaacaattctttaataaaggttaataaaactccctttaaatcggaaaaacgaatatttttatcaaccgcaagtccctcacactgggcaaacatcggtgaatgggtagcatcatcatcccggcgataaactttacccggcgaaattattcttataggcaggttaggcgcatacttttccattacccgtacctgtaccggggaagtatgagtccgtaacaacacttcctcggtaatataaaaggagtcctgcatatcccgggcagggtggtctttaggtaagttaagggcttcaaaattgtagtaatctttttcaatttccgggcccgtagccacagaaaaccccattgaagtaaagatttctactatccgatgctgtacttgagtcagaggatggagcttgccgagtttcagagaataaccgggtagtgtcacatcaattgcctctttactcagtttctcttccagggccttctgcaaaagctcctgctctcgtttctccaaatcttcctctattaacttttttacggtattaatcttgtgccccgcttcgggccttagttccggaggtaaattttttaaatttttaagagcaagggtcacttctccttttttccccaaaaacttgacctttaccgtctgcagttcatttaaatcggaaactctaattacttctcctaagtatttctgccacagttcttcattatgcaaattcaatccctcctatataaaattaaaagctttcgcccgttttagggacgaaagctaaagttccgcggtaccaccctacttagccataaagctcactctgcagaaagggttatccctttcttacttgctaacggaagaatccgttgccgcctacttacctttcagcggaaagctcacgggcgaacttcagtcggcctgccataaaagggctttcagtccgcggccctttctccctggatggtcagcatccaacttactcctcccggtcattgccttttatagctaattaactttttataaattaagtaagctgtcaaggaaccggtagcctcaaatacgctccaccaaaactttgctaaatactcccccatgccacccaccccttgaaaattctacgttaattatagcacaattcaaaaaatactacaagttatacctgttttttgcccattcatatataataattccgccagcaagtgcagcatttaaagattctatttttcccggcatggggatagatattttttgatgcggaagactctttaacgttgtgctgatgccttgaccttcgttgccaacagcaacaaaaaattttgccggaaagtcaatagcagttagaggtatccctccttcgctttccgctaaaaataacggtatattattttttaagattatatcttttagttcgtccgcttccatcctcaatacgggaaacttaaaagcggtccccgcggaagcccttataacttttggattataaatatcaactgcgggaggtaacaaaattaccccggaaacaccaaacccaaaagcagctcttagtaacgtgcctacatttccggggtcctgaagaccgtcaagaaccaaaaaagcaccatctttaccggcgggccaggataaagacttcatacaagctaccgccagaatccccggtggcgtaactaattcggaaattttgttaaacaactggtccgttaaaaccacaatcttcacaccgtcatcatcaatttttttggcctgccagtagctttcacttacaactaaatattttagaggccaattatcagtaattaattcaaaaacaagcttttcaccttccacaataaacattccatttttgcgccgaaaggcactatcttgatataattttttcaactctttataaaatgagttttccgggctggatattttcttaatcaccaatatcccgctccaactttttaaagttttcgttccgcccaattaacactaaaatatctcccacttgcagcacctcatcggacgacggagaaattaccaactgctccccgcgttttatcgccaaaatggtaaaaccatatttagcccgaacatcaatttccttgattgttttcccagcataacgcggtggaatgtttatttccaaaatagaatattcatcggacaggtcaataaattccaatatgttgtttgccaccattttatttgctacttttactcccatttctttttccggataaaccaccacatcagccccaactttagccaatatcttaccgtgcaagtcgttctgagcttttgcccaaaccttctttattcccaattccttcaaaatcagagtaattaagatactgttgtgcatttcctgtccgattgctacaaccacttcatcacaattttttataccaacggctttcagagtttgctcatccgttgcatcggcacatactgcgtgggtgacaaaatcttttacttcctccacccgctcttcactactatcaatagccaaaacctcataccccaaatcacttagagtcttggccacactggaaccaaaacggccaagaccgataactccaaactgtttggactccataaatttcatctcctatccaaccattaccttttcttccggcaaagtaaacaaagcttttttccgccgctgcgcaagggcataagtaatggtaagcggaccaaccctgccaaaaaacatcattaatattattaaaatcctgccaagttccgataacttcggcgttaaacccatcgatagccctaccgtgccaaaagcggaaacagtttcaaacatattcatcaaaatattgtgtccttcagtaaaggtgagaataaaagtaacaatatttattaatgacagggaaatcatgacaatggcaattgctttaaaaatttgttccctgggcaaacgccggttataaaccaggatctcatcccgaccaagaataatattgatcaccgctaatgttaataccgcaaaagtagtggttttaacaccacctcctgtcgaccccggtgaagccccgataaacatcaggataataataaaatactgggttgccggatgaagagccgcaatatctacagtattaaatccagccgttcgaggcgtaaccgcttggaaaaaagccgccaaaattttctcaccaaaaggtaaagctcccagggttttatcgttgttgtattccatgacaaagataaccaaagtaccgaccaaaagtaaaagtccggtagtcattaacgttattttggaatgcagggataaccgtcctttttttctcaaattaaaaagctcggaaataacgtaaaaaccaattcctccggcaataatcaaaatagcaattgaaaggttaactataacatccccaacataaggggttaagcttttaaaatttccgattaaatcaaaaccagcgttattaaaggcggacaccgcatgaaaaactccaaaccacattcccttaataaagccgtaatctaaagaaaatcttaaccccaaaataactgcaaaaactccctcaaaactaaaggtaaataaaataacctgtttggttaatttaataattccctctaaactggcctgatttaatgcttcctgaataactatccgctcacgtaagttaatccggcggcccaaaagaatagcaaacagcgttgcaatagtcataaaacccaggccgcccacctggattaacagcaggataacaatttgcccaaaaagcgaccagtacgttcccgtatcaactaccacaagacctgtaacgcagaccgccgaagtggcggtaaataaggcatctaagaagggagtaaccgtaccatctttggttgaaatcggcagcattaataaaactgtacctaaaagaataactcctgcaaatcccaataccaggatttgcgaaggagttaatcgtctaaaaaagtttatttcttttttcgtattgattgccaacactttcaccaaaacccttcattttataaatttttcttggcaatttccacaagctcggcaaatgcatttttatcgttaaccgctaaatccgcaagcattttccggttaatttctaccccggctttctttaagccattcatcatcctgctgtaagtaagtccatgcattcttgcggcagcattgattcgggtaatccaaagctttctaaactctctttttctagcccttctatcccgataggcatacattaaggacttcattacttgctgtttggctactctaaaaagtttacttttggccccaaaataaccttttgctaactttaatatttttttatggcgttttcttgaaactacactactttttgctcttggcataataaaacctccttatgcttctttaataaagaaagtatcctttaatacggtaaaatctttttgataatcttcatatcccctttgctgactatagcagactttctaagtcttctctttcttttagacgttttgtgacctaataggtggctgtgaaaagcatgaaaatgcttaactttgccagaaccggttttcttaaaccgcttggctgcagcttttttggttttaattttaggcataatgtttcctcctccttatgactttggtgctaatatcataatcatatttctaccctcaagtttggcaggtcgttcaactaccgcaatactgccaacctcttgggccattttatttaaaagttcataagcaatttccgggtgggacaactctcttccgcgaaacattacggtaacttttactttatccccgtcttccaaaaaccgaaggacgtttcttaactttacctgaaaatcgtgttcctcaattgtgggacgtatcttaatttctttgacgttaatgatcttttgcttttttcgggcttctttttctttcttgctctgctggtaacgatacttgccgtaatccatgatcttgcaaaccggcggctttgctgtaggtgcaatttccactaagtcaagctccatttcttcagcaattttcagggcttcttttaacggcataataccaagttgagtgccatcttcctttactacccgcacttccttagccctgatttcttcattaatccgtaaatccttggtaataactgtccacctccagaaaaaatgttaaaaataaaaagcgggcttccacccgctttttcccaaaagtagctgaaaagcagacacacgttgcttttcaatattaacccaaagcctcaaacggctttcaggtgagaagcaggtggcttctactttgttttctttcccttgaaatgataacacggttaatttttactgtcaactatcttttctcccttatctctgccagaagctcctctataaattccgcaaagggtttttggccaagatcgccaacacctctttttctgaccgccactgatccttgttcaatttccttatcaccaacaattaaaagatacggtattttttgcatttgcccttcccggattttatacccaatagtttcattccggtcatctaattcaacccttaccccttgattaaaaagtttttggtaaatctcctgcccgtattcccgatggcgttcggccacggtaattacccttacctgcaccggagaaagccaaaccggaaaagccccggcgtagtgctcaattaaaatgccgataaatctttcaatactcccaaaaaccacccggtgaatcattaccggccgatgtttttgcccatcttcaccaatgtaggttaaatcaaatttttccggcatctggaagtcaagctggatggttccacactgccaggtccgtccaagacagtcttttaagtggaagtcgatcttaggaccataaaatgctccgtccccttcgttaattttataaggcaatcccctttcctctaaagcctcttttaaagaattggttgccaactcccataattcgtcgctacccatggaattttccggtcgggtactgagttcaacgtgatattcaaatccaaacagccggtaaaactcatctattaaattaattaccccgataatctcatctttaacctgttccggcaacataaaaatgtgagcatcatcctgggtaaagcaccgaaccctcatcaacccatggagaacaccggataattcgtgccggtgtaccagacccaactcagcaagccttattggaaactcccggtagctgtgaagcttattcttataaaccaaaatacttcccggacagttcatcggctttatcgcataatcctggtcgtcgatcttggtaaagtacatattctctttataatgcgcccagtgaccgcttctctcccataattcccggtttaagattattggagtttttatttcctgatatcccgccaaacgatgtttttcccgccagaaattttccagctcgtttctaatcaccatccctttgggatggaaaaagggaaagccggggccttcttcttgcaggctaaaaagatccagttcctgaccaattttgcgatgatcccgctttttagcttcttccaaaaagtttaagtagtcagtaagcatgctctttttcggaaaggatacaccataaatcctttgcaacattttatttttttcatttccccgccagtaagctccggcaatatttaaaagtttaaaagccttaagatacccggttgaaggcacatggggccctgtgcataaatccacaaactctccctgacggtaaaaagatatttccactccttcaggaatatcctttactaattccactttataaatttcgcctttttcttcaaaaaactttattgcctcatcccgggagagaacaaagcgttcaataggcaagtcttcttttacgattttttccatttccgcctcaattttttctaaatcttccggagaaaaactttcttccgggtcaaaatcataataaaatccgtccttaatagccggaccaatagcaagtttggtcttggggaaaagccttttaaccgcttgcgccataaggtgtgccgaactatgccggaaaacatctttaccctcgtcatcttcaaaggtataaaggcgaaattctccgctttcggaaatcttctgacttaaatcaattaatttaccgtttatcgaagcacaaagggcttccttggccaatctgggacttaacgttttagctacttccagagcggtaatattctcaggaaattcccgtacctcattattgggaaacttcaaacttatcattatcctgcctcctatctattttaaaaaaatattaagcatgacctgtattatcccaataataaaccctattactccaccaaaaacttctatgtaggaaagttccgttttcattaaagaagttaagattttttccagggtttttaaatcaaattgcaatactttttcttccactatttttccaattttaaccttattttgcaaatcagtttccaaagataaaattattttatttactactgaaggcagttcatttttaaaataatttaaaagagttctaattacaatttgtcgcaagtattccggtaataccggaaaaagagtgctaagcttttcttttaccgccagtagaattttttcagcaaataattgtttattttcttcagaagtcaataactcaataagctctctctgggataacaactgttcttcgactaactcccctaacgctttagcaatttcccagtgacgtttaggaataaccccttgaaaagtgagaaaacctatttttaaaggacgatacggacggaaaagcattaaaattgccaaataattcgtaagccaacctataaagccaccgattaatggtggaaggattagttcggatattttcacgataattctttttacctcctcaattatttaaaatatagcaaataattgtttcaaaagcaataaataaaaataccgcataagctcgtttaatttttagagcctctgcggtagtagatttttttataataaagcaattatgaaactgattttaatgtttgtacttttgtggctattaattctaaaaccttatctttctccatcctattttgaacatagttttcaataatctctactaatgcacttcccacaattacaccatcgcagtaatctttaatgtatgctatctgctctggtttcccaatcccaaatcctaaacaaacgggtaactcggttaacttttttacgttttgcaataaagatataacctctgctggcaaactatcccgtgcccccgtgaccccggttacagacacacaataaataaatcctgaagcttgacccacaatcttttcaagccgcttttgcccggttgtgggagcaaccaaaggaattaagtcaaggccgtatcccgcggccgacacccttatttcttctccttcttccaccggaaggtcgggaattatcagaccatcagctccagcccccgctgcccgccgcaaaaactcgtctacacctatttggagaatcggattgaggtaggacataatgaccagcggcaaagatagctcctggcgggcagccgctatcagtgccagtacttcttccggaccgctaccggcagccagagcccgctgcccggctctctgaatcaccggtccatcggctaaagggtcagaaaaaggtaagcccacttcaataaggtcggctccagccgccgccagggttttgataatttccagagaaaaagtaagatttgggtctcctcccatcgtataggcaataagggctttttcccctcgactccgtttttccgcaaatacttgaccaatcctactcaccaagggtcacccccaattcgcgggccacggtgtagacatccttatcaccacggccggaaaggttgattactactattttttctgactcaagctcccgggcaagctccactcccttggccacagcatgggcgctttccagagccggcagaataccctccgttttcgccagaagtttgaatgcttctaaagcttcttcatcggtaactgctgtatactccactctaccaatatctttaaggtacgcatgttccggtcctaccccggggtagtccaatcctgccgaaatggaatgagcctctacaatttggcctcgatcatcctgtaaaacataagatttagctccgtgtaaaactcccaccttaccccggcttaaggtagcagcatgccgcccgctttccagccctaatccggccgcttctactccaactaaccgcacatcctcttcaagaaaaggataaaacatccctatagcattacttcccccaccaacacacgctacaattaagtcagggagtcttccttcctgcgctaagatttgcgctttggtttcctccccgatcaccttttgaaaatcccgaacaatcgtgggatagggatgtggtccgccaaccgaaccaaggacatagtaagtatcccgaacatgagtaacccagtagcgaatggcctcattcatagcatctttaagagtacgactaccggaagttacactttccacttgcgcacctaaaaggcgcatgcggtacacattcaattcctgccggcggacatcctctgcccccataaaaatagtacactccaatccaaactttgccgccgccgtagcggtagctactccatgctggccggccccggtttccgccactaccttttttttgcccatgcgccgcgccagcagaacctgccctatggtattgttaattttgtgggcaccggtatgggcaaggtcttcccgttttagataaatctttgcccctcctacataccgggacaggctctcagcaaaataaagaggcgtaggacgtccggcataatgttgcaaataaaaggttaattcagcttgaaatgaacgatcatttttaacttcctcgtaagcctctatcagctcttctaaagctgccattaaagtttctggtacaaactgcccaccgtaggggccaaaataccctcgtgcatctggcaatttatagttttttaaactcattttccgacctcctgaccgcttggataaatgcttctatccggatataatccttgattcccggggctttttccaccccgctggaaacatcaacaccataaggtttgacctgctgtaaggctttcccaacattttcaggatttaggcctccggctaaaaaccagggcttttctatcttcagcccctgaagaatttgccagttaaaggttttcccgctaccaccaaatgtattgccggaagacgtatcaaaaagaaaagcgtgaacatacttttcgtaaattgctatttgcctcttaagttcttcggtatcagtttctatcggtacagggatacttttaataattttcgcgcgaattttctccttaagcttaccgcaatattcaggactttcgccaccgtgaagctgaacaacatctaaattgcaggacactgctatttgagccacatcctccacatccatattagccacaactcctacggtggcaacaaagggggggagaatttccgttatttccctgactacttctggcttaacctgccgcggactattagcgaagacaaaacctatggcgtcagctccagccagggaagctttcagggcagtttccttatctttaatcccgcaaatttttacccttaccctcatgccagcaacacctccaatgctttcccgggatctggagcccgcactaaagcttcaccgatgagaattccgtgataacctgcagtcattaaagccttgatatcctctttgcttcgaataccgctttcacttaccatcactactcccgcctcttttagaacgggggccagttttaacgaaacatcaatgttagtggcaaaggtacgtaagtcgcggttgtttatgccaattagccttgctcctgctgttaaagctttctcgacttcctctaaactgtgagcctcaaccaacgcctccatgccaaggccttcggttattttaatcatttcctttaattctactgacgccaaaagagaagttataagaagaacggcatctgcacccagtaccttagcttcataaatttggtaggggtccaaaataaaatcttttcgtaaaatgggcaacgaaactaccgccctcacagccttaagatactccggtgaccccaagaaataatcctcctccgttaaaactgaaatcgctgccgccccacttttagcgtatacctgagctacttcttccggatcaagctgctcccgtaacacacctttggaaggagacgcctttttaatctcggcaattactcccaccttcccttttgcattttctctaagtaaagcttgacggagggaaaggggcaaacggtggctgacctgttcttccgccatctttcgcatttcccaaaaaggaattttatttttggcctgtctaaccttttcccgacgaacctggacaattttttcgaggaacatcaccccgcctcctttatttcatgacttagacggcgcaatttttccagcttctctgctgccaaccccttatcaatactttcccgggccattacaagcgcttcccgaaaatcatttacacccccggccattatgccaaaagcagcatttaaaagtactacatccctcaatggtcccggtttcccatctaaaatttcctgcaataaccgggcattttcgaaagcatctcccccttgtaaatctcttaaactgcagtaagaaaaaccgtaagaaagcggatcaaaaaggtaactatctattttaccccggtttaattcaaaaacccgggtaggaccagttagcgaaacctcatccagtcctccgtgtccgtgaactacaaaagctcgttccacccccaaattatttaaaactttcgccagggtttcctgcagctcaggagtaaaaacccctaatacctggcccacaatatttgccgggtttgctaaaggtcccaaaatattaaagacggtccgtacccctatctcccgccgagttttagccacatgccgcatagctgggtgcaaatttggagcaaaaagaaaaccaatacctatttcatcaacacagcgggccgtgcctttagcatctaaatcaatgttcacccccagagcttctaaaacatcggcactaccggaacgactggaaacgcttcggtttccgtgttttgccacaggtataccggcaccggcaacgacaaaagcagctgcagtagagatattgaaagtttgccgaccgtctccaccggttccacaggtatccaccaatccttcagtttgagtaattacccgtcttgctttttcccgcagcgccagcgcaaaagcggaaatttcttcttccgtttcccctttcatttttaacgccaccaaaaatgccgccacctgcgcctcggtatactttccctccatgagttcgttcattgtggccagtgcttcagaaaaatttaagttttctcctctcatcaatctctctaatacttctctcaccaaaactcgcctcccctttttaccttaagcttgatactcaagaaaattaagcaataattctttaccatactcggtcattatcgattccggatgaaactgtaccccttctattgcccaagtccggtggcggattcccatgattgttccctctgcagtagttgcagttattataagttcctggggtaacccctctttttctacgaccagggaatgataacgcgtagctcgaaaaggatttggtaaccctttataaattccctgaccatcatggtatattagagaagttttcccatgcaccggaattttatcctggataacctttccaccaaaggcctgacctatcacctggtgccccagacaaactcctaaaattggtattttcccggcaaaaaagcgtactacatccaacgaaatccccgcttcattaggagtacacggcccgggagaaataatgatatgggttggcttcatctctctaatctccgaaagggttatgcgatcattacgccggaccactacccggtgccctaattcacccaaatattgcaccaagttgtaggtaaaagaatcgtaattatctatcagtaaaatcacttattaacccccccgttacaacgaaattcagctgcacccgttatcgcttccaccattgcctgggccttatttattgtttcttggtattctcgctcgggatccgaatcccaaacaatcccggccccggcttgaaaataaaccatttcatcttttatccagagggttcgaatggtaatgcacgtattcatttcccctgtaaagcttatatatcctaccgctcccgcataaggccctcgaggtaccggttctaactcatcaataatttccattgccctaatcttaggtgctccggaaacggttcctgcaggaaacaccgcttttagtgcatcaacgggattaaatttcttttctacttctccttgaacggtggaaacaaggtgcattacgtgagaaaactcctcaactttaaaaaactcagttactttaacgctgcccggtcgacaaactttgcccaggtcgtttcgtcccaaatctaccaacatcaaatgttctgcccgttctttttcatcggccagaagttcccgcgcaaggcgtaaatcttcctccggctgaccggttcttggtctggtgccggcaattggcctggtctctactatccccccttccagccgcaccagcatttccggtgaagcccctataagtttgagctcgccaaaatccaagaaaaacatgtagggagaagggttaagccgccgcaaacgccggtaaatattaaaaggcgcttccaggcaagggaaggaaaaacgctgggataaaactacctgaaaaatatctcccgctttaatataatccttggccttttccaccatcgtgcaaaaatcccttttagtcatagtcgcattacaaatacttcgttctggcttaatagttaatgcccaattttcagaagttgttagattagttaacttaccgattatctctttaattgaatcctgtgcccgccggtatgcggttttttcaccttctttttgaggaagggtatttatcacgattttcagggtatgataacggtggtcaaataccaaaactttctccggaaacattaaacgaaaaagctcttcatcatcccgggcatgtcggcaactccgcaaattttccagttcatatacaaggccgtaactaaaataccctacagctcctccgtaaaaaggtaacccggctataggcggtccttttaagttaaaaagctgtgacgaaacaacctccagattgcgaccggttaacactttaaacggatcataaccaataaaggaaaaacgggccattttttcattccccggtgcactttccagtaaaaaggaaattcctttatccagtgccaaatgttgatataaggtaataggggtaaaagtgtcggctaaaagttcaaccataaccggcacaacctggtaatgttttgcgtaagcgcaatactcttcccaattaggagttaaatctaactccgaataaactttgctcatctcgtcccttctcctctctttttataacctttttcccgctacatgcacccatggctttaattcgtttatcaactgttcgtattcctgaaaatttaaagactgctgaccatcacttaacgctctttctggctccggatgaatctctattaagagcccatccgctcccgccgcaaccgctgctttagctaacgacggtataatatccctgcgcccggcagcatggctgggatcaacaattaccggataaggagttagcttttttagtaacggaaccgcactgatgtcaagcgtatttcgcgtcatcgtttcaaaagttctaatacctctttcacatagaattatttttctgttacctcctttttcaagatacgcaaccgctcccaaccattcttccagggtagcagctaaacctctttttaaaagtaccggtttatcaacttttgctaaaagttttaacaaagcataattttgcatatttcgactgcctacctgtaagatgtcggctacaggtaaagctttattaagagaatcttcatctataacttccgttaccactaaaagtcctgtttcggctttggctaatgccaaatatttcaaagcctcctcgcctaacccctgaaaactttctggccgggttctcggcttaaaagctcctccccttaaaccaacagctccactgtccttaacaatttttgccgtctctattatttgctctaaattttccacagcacaaggaccggcaaaaactaaaaaccgattacttttcagtaaatcttcccaaatctttaaatccacaaacaacctcgtacctcctttaaaaccattttttaccacagaaacaaaaaaccagcaccaaactgagtgctggttttactctaatcccgtactaacccgccctcagctcagctcctctaaactcaactcgtctcaactcgtctcttagaaatattttatttttattgcaaaagtttaccttataaactaaccccaagtcaataatttttttctttttttacccttcccggtaaccctcacattttgtacatatctcaaccctctcctcaaaaatatctttaattggtttaagatcaaaatttatcgagtcatcatgccggtgaataataattttttctggagctaaagatattaatgcgctaattaagatatcttcaagaaataacctctgtctttgggttaataaattttcaataaacttgtcctcaactttcctttggtgttcatcgactaatactaaatatccattgacccaaaaaacctgaaccattcttactttaaccggctgaatttcaagaaaacactttactacctttataaactcctgatattctttttccaaaatttgttcttccaccgccaggtcaagggaatgataaatttcacttacctctttttgcaaacgaaaaagaataaagccatcaagattaatcagggaattttccagcaaaaactcataaatcttttttccgatttctctctcgcggtccattgttaatatttttacagcgttattttttattctttctaactcctcccttttaaagtaaggatattcaaaggcggcaatttttgaaattaaatctttctcccaaaaatcaacataaatctttgccaaaatcgagctcacttttgtcaaaaaacagtcgtttgtagaagataataaatttgtcttaataatatttaaagccaggaatttatacttcccggcttgatatttgtccaagtttaataaaccatttttgatttgctcggctaatccaatctttaggagcgcttctatttcctcaccataacgacttgtagcaattataatttggttcattaaaatcacctcttctactggtattatatgagtttaaaaataagcgtatacactaaaaaaatggctaaaaagctataaaaaaacaaaaaaaccggcaaatgccggttgccgtcctttattctggtgggcgggacagggatcgaacctgtgaccttctgcgcgtcaagcagacgttctcccactgaactacccgcccgtctgctcttttattattacttattttataaataaagtcaagtaggaaaataaatcataattttaacttttagtacataagttttatacaaaacccaccgaaaggagaattttagatgaaagtttttttctttaattacaaaaacctctggcaatatacccttatcctcatttttgccatcttaattggattggtattttaccattatttaaccgaaccggtaataaaaccgcaaattatcgatttttacccggtatacaaagtggaaaccagtaaaaaagttgtagccctaacctttgatttgagctggggaacaaaaacttataaaccaattctcaatactctaaaaaaagaaaatattaaagcaaccttttttctttccggcccctgggccaaacaacatccggaaatagttcgggaaattgtcaaggacggccatgaaatcggtagccacggacaccgtcatgtaaattacaccgggttaagtcccgaggagattaaaaaagaagtggtcctggctcatgaagccataaaagaagcaagtaataagactccaacaatcatccgcctacctaacggagattataacaaaactgttatcaaaaccttaagagaaataggttatactgccattcaatggagcgtagattctttagattggaaaaatcccggagaagagataattttaaaacgcgttttagacagtattcaccccggagctataattttaatgcatgccagtgatacctgtaaacaaaccggtcaggtattgccagaaattataaaagaattaaaaaaacaaggctatactttcattaccatttcccggttgctcacccttggtcccgctgcaattcagtaaccgaccaccaatggcctttctgaaaaaggtaaagatagattgacatcaagatgctccattgaagcacgctaaccatccaggcataggaaacatcgtatttatttaaaacgaacaaataccaaaataacggaagtctaaaaagccacatccccgcggtggtaaggtaaaaaggtatttttgtgttaccaactccccgatacaccgacccaagcaccatttcaattccggtaggaatctgttcaaaagcaccaatcttaaggcatacttttattttttcaagcacatcaacgtctttggtaaacaacaaccccaattgctggggaaggaaaaaaaagattattcccattaaacccatccccaaaattgttaaatttagcgttttttcaatgtagctttttgccttttgataattcccttcaccgtaaaatctcgcagcaaaagaataggcagcaattgccaggccgtaaccgggcatataagcaagggactcaatgtaaatggcaatctcgtttgccgcaaaactaactgctccaagcttaaccagaataaaacttaccaccacccgccctaacgaaaaactgccttcttctaaagccgcaggaatactaatttgtataatcttctttaaatatactcttatttcaagccattgaaattttaaacttaattttttttcaattaatccaatgtaacccaaagcgataatcgaccccaaagttagagaaattccagaagctaatgcagctcctcccggccccagtttcgggaaaccaagctttccaaatattaaaacataatctaaaaaaatatttaaacaattaataacaacagctgtataaaggggaaccctggtttggcctatagcccgcagtaaaccatttccaacaaaaaccagaagagcaaaaacagcaaactttcctattgtttttaaataacttatagttaccagggcaacatttttatcgattttaagggcaggcaagattatctctactatgtacggtaagaaaaataacaaaaacccggcaaaaaaagccaaaagcaacgagtaagaaaaaaacttttttacctcttcctttttttttgcccccaatgcctgagcagccaaagctccaccaccggtaccaattgctgcaaagacaaaaaatgtactaaaaattatctgcgcgccaagactaacacctgctactgcagttgccccaagccttccaaccatcgctgtatcaactatacctacaaccatgtgtaaaatcatttccagaaccgctggtaaagctactttaataatctcaaaatacacttccctccctcctttctctttagccacctttttcgattttaccatataaagggtggtaaataaaagaaaaacccgggccactttacacccgggctacttacttttagggaccatccgtctttttatttcatccagctcccgcattaaggacgataacggccttcctttagccaaaccctcggccacatggcgaattcttgttactgtatcggcatcagtagtaacataaaccctttttaagcgtggctccgctgatttaacacggttagctgcttcttctttaattttatcagtttcgcttttttccactcccgccaccaaatccagtcccacatacgctgtactgccggttattaccgcggtagcctttttcactttttctgtttttgctgcttcccgagcaattttctttgcaattttgtttaactccgtttgattagtgggtagagtagtgggtgaacctcccggaggaactgttggcgccggctttcgcgctggagtacaagccacagcagcaaagaacaaagccaaaagcagcaatatatgtaacccttttttcatataactccacctccgaaaatagcataaccatttccggaggttatatgcaaagctttttataattccttggcaggacgcggtcctcggttcaaggctacttttccggtgcgaacaatttctacaataccatgatcggttaaaacttcacataacgcattaattttatcttcatcaccggtaagttcaatcaccatggtttcccggtttacatcgacaatattggcacgaaagatatttacaatattaacaatgtcggcccgtttttccggaagagctcgcaccttaattaaagctaactcccgagcaatagtctcttccatcggcagttctttaatcttaattacatcaattaattttgataactgattaattacctgttctaagacaagatcatccccctggacaacaattgttatccttgtaatgttgggttcttcggaatatcctgccgttatactttcgatgttaaacattctacgacttaacaaacccgaaattcgcgccagtacccctggtttgtttaacaccaggacagataaagtatgcttcatattatgccctccccaatcttttcattttaaaagttctttgctaaaattttgcttgaagttttaatatggagaagagtaaaatgcaaaaaaagtggttgtattctactgcaatcctactaatactatttttaattctttttattgctgtggcatttaatttgggtcatttttttcgacaattttcttctcctgccgaacttgctcgctatttacgttctttcggtcttttaacagtatttattagcattttactcctcataattcaaaccttgtttacgccagtaccgttatttatcttagtggctgccaacgggtttattttcggtgttttgggtggaataataatttcactatctgggagcgttctgggtgcaaccattgcctttttagcagccagatttttaggaagaaattttctaagccgttttttaaaaccagaatatttagacaaagtccactcatttagctgcaaggatggccctaaagttgtattttttgcgcggttaattcccgtattaccatcaagtatcgtaagctacttagcaggacttagcaacatgcgatttaccccatactttttggccactactttaggaaaactcccggaaattgtagtgtattcccttctcggtcacggttttggtcatttagacaatctgccagctcaactttttctggcaatcctcataacacttatcgcctactttttttaccgctggcacaagaaaaccggtatttaacaatatttaaaaaaaaatcgctcacacgagcgatttttttatgattgtgcttgttctgccactactttatttaaatcagcaattaactcatcaatattaatcccgtgagctcgagctccctgttcaatattttcaaattgggccgcagcacacccgaggcaccccataccgtgcttataaaaaattgggatagttttgggatattttgtgactacttctgtaatggtcatttcttttgtaatggtcataagctacacctccatttcttactccttattttaaaattcttcctccggtttgtaaagataaaagtacttttcatttaacagttttttaccttctaaaattttgtctgagctcacaacatattctccatgtttaacccctacaagttctgcttcccggagaaggtcaagacaacctaatactttgcttataaccaggtaagtttgctcattgatttcatcggggtaaattttctgcgcaatttcaaacaaatttgccttctttagctctttaactttctcataaacctcaaaggttttctggaagtaatggatttttattttatctattacctcttgtaaattagaaaatttatcctggtgtgccggaaaaaccattttcaccggaaaattgtaaacctcatttaaactttccaaaaaaaggggcaaagtagcaatcctttgcccctcaacctggtatatcaggggattggggaaaatattttttaagataaaatcaccgctgaagaaatatttgtttttcatttcatacaatgaaatatggcccagggaatgtccaggagtataaataactttaaatgcaaactctcccgtctttattgtttcgccgggaaaaaggggtataatggaaaaatgattttgaaaatattttggaggtattctatattggtgctgaacaaccgcatcaaccagttgttgtggtaatccccaaccatcaaccacttttaataccttttctctatcctcattgagaaagtaaatctccagaggatgaatacgtactggaatatcaaacatccttgatataaaacctgccaagccaaaatgatccggatgaaaatgagttacaattatttccgacacgtcccggatttcatacccgaaattttttaatttagcttccaatgctaaataagaatcatccgtgggcgctcctgtatcaattaaaacaagcttttcatcttcgaccaaatatacgtttacatcacccactaaataaggtgtaggcaaagttattgttgaaatccgggccattactttcacctctttaaagcttctcagccactaactctgcaatatcgtaaactttaacttcctcggtcttatcaaatgcctttatcccatcttccagcatggtaaggcagtacggacagtttaccgcaattccctccgggttggtagctaaagcttgccgcgtacgctcaacgttaatccgttcccctaaagtttcctccatccacatccgtccaccaccggcgccgcagcaaaaactggtttctctgttcctgctcatttcggttaattttactcctacattctttaatacttcccttggctcattaaatacccggttataccgtcccaggtaacaggaatcatgataggtaaagcgacggttatcggtgctgtttaactttatcttattttccgaaaggagcttggcaattagctcgctgtggtggatcacctcataattaccgcctaactgcgggtaatcatttttcagggtattatagcagtggggacaggcggtaataattttcttaactttataattattcatggtttcaatattttcctgggcaagcatctggtataaatattcattaccaattctccgggcagagtcgccacagcatttttcttcggtacctaaaatggcaaacttaatccctgccgctttaaggattttaactaaggcccgagagacttttttgtttctttcatcaaaggaaccggcacagccaacccagtagagatattctatttcttcggggttttccatctctcccaggattggcacatctaaaccttccgcccagtccgctctactggcccagcccaccccccaggggttaccgttattctccatatttctaaaagtaagctgtacttcctgcggaaaggagctttccattaggactaaatttcttcttaactctactgtcttgggaatgtgttctacatagaccggacagacttcctgacatgcccggcaggtagtacacgaccaaatcgtatcttcttcaattacctccccgattaatgcccttgtaaccgcaccttccacttcaccggttgccgcttcttcccccaatccttttttggccagttcggctttggctctggcaattatcaccggtgctctttcgtttagagcctctttcaggtcctgggtcattttcttgggcgataacggctttttcgtaaggtaagcaggacaattgtcctgacaccgtccgcagcgggtacagctatccaaatctaaaagctgtttctgggtaaactcttccaccgtcgataccccaaaagattctgcatcttctgcttccaaatcaattaacgggaaggtcttggcactctggggatccgccaaagcctggttgatgggagcggtgaagaggtgaattaatttggaatacggaatataagcaataaagccaaaggctaaaagcatatgcccccaccagagaataacatgccacagcctgaggattccttcatcggctccggcaaatagctgggccactaaattaccaaaaggcgaataggctgcccagttatccccggccactgccatgcggattccttcgacgatataaccggtaaccaaaattgttaaaattaaaagcaatgaaattaaatcatcaggcttgttatcgagacgatctggctttataatatagcggcgaataatagccattaaaataccaatgattgctgcaaccccacctacatcggctaaaaagctaaaaagtaaataaacgttgccggtaaatactttaataccgaagtctgcctgaattgccactattaaagtggttaaaaacaaaacagtaaaaccccagaagataccaaaatgcattaagccgggatacagttcgtttaagattcttctttggaaaaaggtttcttttaagaatcttccgaaatcccacttaacactggctttttgccctattttccagtattgataccgctggtacattccataggcgaaaattgccagggcgattaaaaacaacgggtacattaaaaacttggctgtgtggtttatattccagtaaagttcccgctggggaattccattcaccctaatccctccccttttgtttgcaattttttctaaacaaaatttattagagaaggaaggcaaaaatgccttcctttacgattttaaaagctttttaaactcttcggttaaaagcggaactatttcaaacaaatcgccaactatgccgtaatcggcaactttaaagatgttagcttccgggtctttgttgatggctactattaccttggagctgcccatcccggctaagtgctgaattgccccggaaatacctacggcgatatacaaactgggggatacggtcttaccggtctggcctacctgataccggtgctcccgccagccggcatctaccgctgcccgggaggcccctaccgctgcccctaaaacgtccgccaaatcttccagcagcttgaagttctccggacctttcatcccccgaccgcccgatactatgatatccgcttcggttaattcgggacgtccggatacctgcttgactacttcctttactatggcttttaaatcttccggcataaagctgaccgctacttcttcaattgcagcttgcccgccggctttctccgctgccggaaatacgttgggccgtaccgttactattaacggatggctggtggcccccactttggtataagctttcccggcgtaaatgggtcgtacaaagactccttcttcgtaaccggtgatgtcgcttacctgtcccgctcctacccgctgggctgtccgcggtgcaaagtccctcccctgagcggagttggcaattaacactacttccggcttttctttattgattaattccgccagtacccgggtgtatttggcggtggtgtactgctctaaatccggatggtcggctacatatactttccctactccgtattccccaagctcagaagccaggccttttacgtcttttccgattactaccccttcaacctctccccctatttgccgggctaaagttaccatctcaaaggttactttctttaacttaccttccctttgctctgctactacccatactttacccattagctccaccccctatattaccttggcttcttcccgtaaggctttaactaacttggctaccgctactgccggctcatcggtgaaaattttccccgcttgcttgcctttgggaagaaagatttcttttatctctactttaggagtagcatttaccccgaggtccacagcgtttatgacctttaactcttttttcttggcctgcatgatgcctttcatggaaggataccgcggctcatttaacccccgctgggcggtaacaagggccggtagaggcacttctaccacttcggtaccaccttcgatttcccggtggccggtaatcttgccttcccctacttctaatttggtgacaaggttaatttggggtaagcctaaaatctcggctacccgtacccctacctgggcggaactgtcgtcaatggcccgccagccggctaaaataaggtcgtattccatttgctgcagcactttcgccagtacttcggctaccaccatttcatctaactgcaaaccgtcggttttgaccagcaccgcccggtcggctcccatggctaaggcctgccgtaatgcttcctgggctcggtcactgcccgccgagactaccactacctccccctgcccaagtttttctttgatccttaatgcttcttctaccgcaaattcgtcgtaggggttaatgattaaggttaccccgctgtcgtcaattttcccgtcctttaatactatcttcgcttcggtgtcaaaggtttgctttaaaaggactaccagtttcacctaatctccctccttactctcctttaaattcgggttttcttttatttaagaaggcatccatgccttctttttgatcactggtcgtaaagcagagggcaaacatctccgcttcatacgccagtgcccgttccaaatccatgtttaacccttcgtttaaggcagccttggaataaaataccgcaagttttgctttagctgctattttctgagcaatttctaaagctgttggcatcagttcttccggttctactaccctgttaaccaatcctattctcagggcttcctgagcatctatcatctcaccggtatataagagctcggctgccataccttttcctaccaatcgcggcaacctctgagtaccgccaaagcctgcagtaacccctaatcctacttccggttgtccaaattttgctttagttgaagcaatcctgaaatcacaggccattgctatttcacagccaccaccaagggcgaacccgttaaccgcagcgataaccggttgaggaattctttcaagttttgataacaccttttgcccaagcttagcaaaatacctggcttgccggggagtaaaattcctcatttgcgaaatgtcggctcccgccacaaaactcttttctcccgcaccggttaaaattaccaccgtaatgctttcatcctcagctattttatccagtaaagaatctaactcttctaacacttcagaatttaaagcatttaatacctggggtcggtttatggttataataccgacctggtctttcttttcaaacaaaatcgttttgtattccatactttcccccctgttcccctattttaagaggtggcgagcaattacaattctctgaatctgattggtcccctcgtaaatctgcgtgatcttggcatccctcatgtagcgctctacgggatactccttggtataaccgtaaccgccgagcagttgtacgcaatcggtagttacccgcattgctgtatcggttgcatattttttggccatcgccgcttctttgctgtggggtaacccattatttttcagccaggcagcccggtaaactaataacttcgccgcttcaatctccgttgccatatccgccaccatccactgaatcccctggtttgcggcaataggccggccaaattgctcccgctgtttaatgtagttaagggtatactcaaaagcgccttccgcaatgcctaaaccctgggctccaatcgcaatccgcccgccatctaaaagttgcatggcaactttaaagccctcgccaattttccccagaacattttcttttgggactatggcattttcaaaatacagctcgcaggtaaccgaaccattcagtcccattttttctaccggtttagaaatggtaagtcccggtgtatttttttcaactatcaaacaggtaatcccttccgcccctttggtagcggggtcagttcttgcaaaggtaataaaaacgtcggcatagcttccattggtgatgaaaattttactgccatttaagacaaagtgatcacctttatctaccgctgaaagcctcaagctggccgcatcggaaccggaattaggctccgttaaagcataagctccaagcattctcccctgagccattggaactaaatatttctgtttctgttcttcggtaccaaacatatagatactcatgcagccaagcccaatgtgtacagctaaaatcaccgcagttgaggcacaaaccttggcaatttcttcaataaacaaaatgtaggaaaagtagtcagctcctgctcctccgtactcttcggaaatgggaattcccattaaacctaattccgccaatttatctaacgtctccttgggaaaacgatgctcccggtcggtcttttccgcaattggtgcaatttctctttgggcaaattttcgcaccatgtcaacaaacatctgctgttcttccgaaagctgaaaatccatctttcccctccccccgtatgaccccaaaaaggattaagaatagttataaaaccctctaccggtttttcgtccgagccatcccgctttaacatattgccgcaacagcggacaaggacggtatttggggtcaccataaccgttatatagaacttctaaaatagcaagaactgtatcaagtccaattaagtcagccagggccagaggacccatcggatgattcataccaagtttcataatggtatcgattccctctaccgatgctaccccttcatagaggcaccaaatagcttcattaatcattacctgcaaaactctattggacacgaaaccaggaacatctttacattctaccggcactttatccattttgcggctaagttcctcaattacctgataaacctcatcggaggtttgcaaaccgcgaattatttccaccaatttcatcaatggtacgggattcataaaatgcatgccgataacccgttcaggacgcttggttgttgccgcaatttcggtaatcggcaaagacgaggtgttggtagccaaaatcgcatgaggtggggcaatttgatccagttcagcaaagattttagccttaacttccattttttccacaaccgcctcaattaccaaatcacaatcggcagcattttttaagctatcggaaggcttaattcttcctaaaatttcatttttttctgcttcagttattttccctttttcaacaaacttagcaaggctcttttttatcgtttctaaccctttattcacaatatcaagatttaaatcatgtaataccgtttcaaaacccgcttgcgctgcaacctgggctatcccactgcccatttgtccggccccaacaaccataatttttttaatatccatttaaatccctcctattccactttaatcaacatggcatccccttgggccgctccgctgcaaatggcagctattcctgttcccccaccccgacgtcttaactcataaatcagggtcattaaaatacgggccccgcttgcaccgatgggatgaccaaaagctacagctccaccgttaacattaactttttcaaggttatacccggcaattttttgactgaccaaaactaccgccgcaaaagcttcattaacttctaaaagatctatttgttcaattttcattcctttcttcgctaaaagcttgttaatcgcctgtcccggtgcagttgcaatatatttggcatctaaagctacttcggcatggttaaggtaagtcgccagaggtttaattccaagttcccgggctttttctctactcattaggaccaaagctcctgctccatcatttacaccgggagcatttccggcagtaacggtcccgttggcatcaaaaaccggcggaagtttagaaagagcttcaatcgttgtattgggacgcggctgttcatctttttcaatgacaacaacctctccttttttcccgggtacctcaactttgacaatttcatcgttcagccgtcctttttccattgcttctttagccctcatttgactaatatatgcccattcatcctgagcttgccgggaaataccatattccttggcaacttccgagccgtgaaccgccatgtgccggtcataaaaagcacaccagagaccatcatgcaccattaaatctatagcttcaaaattaaacattctctgtccccagcgggcactgggcaatatatatggggcattactcatgctttccattccgcctgcaactgccacgtcaatttcgcctaaagcaatcatctttgccgccatagctaccgcgattaaaccgctggcacatactttatttaccgttactgacggaacttcccagggtagacccgcttttcttgccgcctgccgggaaggtatttgacccgctcctccctgtaaaacctgacccatgtaaacatagtcaaactcttccggacttactccgcttctctctaccgctgccttgatagctattgcccccaggtcaaccgcttttaaagccgaaagtcctccaccaaacttcccaaagggtgttcgggccgcacttacaataactacttctctcattttctcccctcctcaaactcccaatgattaaaaatacaaaaaattccgttttttctctttctaatccaccacccctcgtaaaagagtaaagcgaaaaccatattattttaaatacgtaacttaagataaaattcctgctggtttgactaaatattttttatattgttaatttttgaaattgtttgtgtattttaatctactcgttattttgcttaattataccgtagcaaaacagttgaaaaacatcatcgctaagtttagccagactataacggcgggacgataataaccaggaagaaactgtttcatccaaagttccgaaaatcatccgccgaatgacctttgtagaaatatctttacgaaaaattccctgttcttttccttcttctatgacactttcaataatataaaaataatcctttaataactccgacaatttttgccgcaaatctctatcagcctgacgtaattcaatctgggtaacctgggcaaaattgcggtccttttcggagttctccaagtgcatagttataagtttttttagtttatcaagtggcgttttagcagcagctatctcgacttttaagttagaaataaactccccatatctcttttgaaaaagggataaaagtaaatcctgtttatttttaaaataaagataaattgttccttcagctacgttagcttcccgtgctatttttgaaatttgggctttatgatagccaacttccccgatgatttttgcagcagcatctaagatagcttcatatttatctatgctctttttggccatattaccctccgttttttctttaaattataacacaataatttaaaaaagtgaatgagtattcattcagaatttaagatttttttcataatttttaaaagttttaagatctaaaacaaaattaggactgccagcttgttatttttgaggagcttttctcctccggctaaaaaataggcacttaccggcaatcggtaagtgcctaagaacaaggcgggagcggttactcccgcaattattaaatgggagaggagaaaataagctaagctttatagccaaggttatcaataataacctctgctacctcccgggctaacttaattgtattaaccggcggaagtttcgcaaactttctaaccaccgccagataagttctctgctcatctccttcggaaacatacgccaggaggtctttagcaagtttttcaattttagcaaagctctcagccacaaagatcttaacatacttttcctgcaattcagatccggtctttacagcccttaaataagagctttccatagcataaatttcaattgccatatcagctatcattcccagaacttcctgttcttgttcaattttctccttaaatttctgaactgccagccctgcagccattaaagctaactttttagcccggctaattgcttctttttcccggttaagtcctgacacatcttccaccggcggcagtggagctacaatttcacccatcaacttctggacagcagccagaagcggaagctgacccttttgggcttttcgcagtaactgggccggaataattagcctgttaatttcattggtaccctcaaaaatccggttaattcttgcatcccggtacattctttccgccggatattcctgggtatagccgtaaccgccaaaaatttgaacggtctcatccactacaaaatctaaagcttcggaagcaaacactttgtttatagaatactcaatagcatattcctcaatgcctttagccacttcagcaccggatttgcctttaacatcacctaaaatcttatccatcattccggcagtgcgataaaccatactttctgcagcaaaagtataagctgccattctgccgattttgttcttaattaaaccaaagttggcaatgggttgaccaaattgacttctttcgttggcatacttaacagcagtacttaaggctaatttgcaggagccagcacatccagctccaagcttaaaccgcccgatatttaaaatgttaaaagcaattacatgacctttaccaacttcgcccaaaacgttttccaccggaactttgacatcttctaaaataacctgccgggtagaagaccctttaatacccatcttcttttcttccggtccgaaagataccccgggaaaatcccgttccacgataaaagctgtaaacttatctccatcaactttggcataaacaataaatacgtctgcaaagcccgcattggttataaactgtttggtaccgttcaaaatgtaatatttcccatcttcacttaacacagctttagtttttgctgccagagcatcggaaccggaaccaggctcggttaaacagtaagctgcaagtttttcaccgctggcaagtccgggtaagtactttttcttctgttcctcagtaccgaaatatacaattggtaaagtacctataccggtatgtgccccatgcgctgtggcaaagctaccctggccagaaacattttctgtaacaataacagtacttactttgtccagttccataccaccatatgcttcgggaatatctaccgacaaaagtcctaattccccggctttacgcaataatgctggaactacaccttcaacttgattttctatttcttcactttttggcaatacttcattgttaataaaatctttaaccatttttgccatcatgcggtgctcttcggtaaaatcttccggtgtaaaaatcgattgaggctcagcatctttaattaaaaattcgccaccttttaaaacttcagacattataaacccctcccgtttgaattaaattaattcaaagactccggcagctcccataccgccaccgatacacattgaaaccacaccgtattttgctctacgccgctgcatttccgaaagaagagttgccgtcagtttagcaccggtacagcccagcgggtgaccgagggcaatagcaccgccgttgggattaacttttgcaggatcaatttctaaagtttttattacagccagtgcttgagccgcaaaagcttcatttaactcaaatacgtcgacctgatctaaggtaatcccggctaattttaaggctttaggtatagctaccacaggaccaatacccataatttccggctccactccgcctacggcaaaggagcgaaatacagcaattggttttaagccaagctcttcggctttttccgccgacattaataaggctgcagcagcaccgtcactggtttgcgaagaattccctgcagtaaccgtaccaccctgccgaaaaaccggctttaaccgggccagagcctcaagggtagtatcaaagcgcggaccttcatctacttcaaacatttcggttttttcaataactttcttaccgtcaaagattttttcaactaccggtaccggaacaatttcatctttaaatttaccgcccaatattgcttcctttgctttcatgtgacttttataggcaaactcgtcctgttcttcccgggaaatattatagcgagaagccacattttcagcagtaagacccatgctgagataagcatcgggcattacattcattaattccgggttgggcaaaaggtcatttccgcccatcggtaccatactcatactttcgataccgccagctattaccacatcgctcattccggtcataatcttcattgccgcatcggcaatggcatttaaaccggaagagcaaaagcggttaacagtaacaccgggaactgagtagggcaaaccagctcttaaagcaaccacccgtcctaaattcatcccctgttccgcttcgggaaaagcacaaccaatgataacatcttcaataatctccgggttaattcccgtctggttgataatttcctttataaccaatgctcccagatcctccgggcgagtatttcttagttttcccctgggagcttttcctaccggagttcttaatgcttttacaattaccgcttcacgcatagcatcacctcctaatttctaagcggtttatttttaagaagcatatggcgaatccgttcctgtgttttccgttcgccggctaaacttaaaaacgcttccctttccaaatctaagagatactgttcagttacataggttcccggatggacatttccaccggttaaaacataggcaatcttcttggcaatatgagcatcgtattcagtaatgaaattgccttctttcatattgtgaataaccgaagctaaagctgcataaccggaggtacctaaaacttttacgggcttgggaaccggcggacggtaacccatcttcgacatataaagaacccgttctttggcatcatgaatgagataatcccgattcatcgtgacaccatcacagggtctcaagaagccgagtttttttgcttcctgaccgctggtagatacgcgtgcggttgccgccagttcaaaagctctaaagataaacggcttgtaatctaccgctccggctactctccagccaccggtatcgctggcgtattcggtcatgcggtagaccaactctttaagtccgccgccagctggtaccaggcctactcccacttcaactaagcccatgtacgtttccgctgccgcctgaataccatcggaagccaaacaaacctcgcagccaccacccacagtcatcccaaaaggtgcagctaccaccggtttgtcgcagtacttcaacgttaagaggctgtcctggaaggtctttaccatgtaatctaattcatcccaatcttcatcttcaatggtcatgagaattaaagccaggttagcacccacggaaaagtttttgccatcattgccaataaccagaccccgccagttcctgctgacctcttcggtagctcttctaatcatggaaagtatgtcatcaccaatagcgttgcttttggaatggaattccaagagagccacatcatccccgatatcaattaacgacgctccctgattttcaaaaataactttattttgagcttttaagtccttaatcacataaaattctttcggcagctcaactggcttataatcttcggtagcaagatcaaagtagtaagtcacgcccttttcatatttgtagaaactcttgtacccttttgccaggagcttttccacaatcggcggaattacttctccttcttccctcattcgggctacagttttttctaccccaatagcatcccaggtttcaaagggacccaactgccagttaaagccccagcgcatggcccggtcgatattaacaatatcatcggcaatttcgggaatcttagatgcagcatacagcagggtctttttcattattctccagaccagagcggccccttcatcttttccagaaattaaggtttgcagtttggcttttaacccttccgctgctttagccgcttctaacgatgggtaattaactttttcctggggcttgtattggagagttttgacatccaggcttaagatttctttaccttcctcggttttaacttttttgtaaaatccctgaccggtcttatcccctaaaagcttattggcaaccattttttctaagaattccggcacccggaaaagttctttttccgcaggatcggtaacattatcataaacgttttttgctacgtgaactaatgtatctaatccaaccaaatcagcggtacggaaagttgcactcttcggacggcccatgacaggaccggtaagagcatcgattgcttctacagtatagccttcttctaaagctttcattatttgtaaaatcccgtagactccaatgcggttaccgataaagttcggagtatccttggcaaaaacaatacctttgcccagtacccgttcgccaaatttagccatgaaatccactatttccggtttggtctcatttcccgggatgatttctaatagcttcatgtaacgaggagggttaaagaagtgcgttcccaggaaccgttcccggaactctttgggcatgtgttcaaccattttgttaacggaaattccggaagtattggtactgatgattgccgtcggctttaaatagggagcaatcttggtaaataaatttttcttaatctcaaggttttctaccacaacctcgataacccaatcacagtcctttaacaggtgtaaatcatcttctaaattaccaatagtaattaaatcagcattttccggtacggcaaaagctgccggggatgcttttttcgccgcttccaatccccctttaacaatccggtaccgaacctcaggactttctaaagtaagtccctttttttcctcttcgggggtcaagttaaaaggtacgatgtccaacaaaaccaccgggataccggcattggttaaaagtgcggcaataccgcttcccattatcccggaacctataacccctactttgttaatcttgtacaccctcatccctccttgagttaaaatatgaatgaatactcattcattatgctggtaaaaaaagaaaaccttcttactttgtaattatattcttaattgccgcaaaattcaatatattgtcctaaaattattctaaatctttcagatctccttttgccacataaataatcgcccatttgctttcctcactatcccgccagagttcaaataggaagttttccccttccagatttacctgcacccagctggtatttttactttcagacacagcggtaacttcaaagtttatcttcttattcttcattatatcttcaaattttttaaaactttcatctccggagaagtaaatctgggcaacttttttcttaccctttttgaagttttctaaagctttttttaccacctctttactatcttcagggtaattttttatggcttcttcaagttgagctttacctgaaagcttgctggctattttatctaaaatctggatatccggaagcttattacccagactctcaaaaggtgtaccttctaaaatggtgcatcccgaaagatatgtacttaagataagtaaaactaatagtttaagtatatttttcatttaactccctccaaaaggttaaaagccggggtgccagaagctggcaccccgaaaagttcaatttatcactttaagttatttaaatcatatctgtaatgttctgtagcatcatcagtataggttgcatcgccaactgtgtagctaaagacgtgagcagcagttgggagatacttgtaagcatccgccggcggagtgcccacagcgctgtcgtggcagctctggcagagagcggtgtagcttgtagccttaatctgctggcctttggcattttctttgtgcggatcgtggcaggtagtacagctcatcgcacctacaccaaagtgcttgctcttgtaataaaaaccattatggccagcaatatttttaccaggaccatggcaggaaccgcaggacattgcataattgtcggtattatagccaatcattgtggtaatatcggtaatatctttccatcgtaaatcctgaccaacctggagatagtagggtaagttcttccatccagtgatgttcctggagcttggagatttgacgtggaattctccaggtccgtggcaggattcacagccaatacctacttcaattacacctctattgtttgaaccttttcctccgttttcaagtaagctctttaaagtagtagaaccttgagaattattcacaacataatttccgatgtttttcttggttccaaccccacccaggctgttgttaatggaggaagtattcttccaggtgacgttgttaacaatatggcagttaccgcaattatattttgagtcatttttctctttcttattgtttatagttctatagagttcagaaggatcgttggtgttaggagttaatagataaaagtcggtactcaaatcttttccaacaatatagattttcgtcggatcacttgtatcataattttctccaactgttgttttaatataatttgcaatatcattgtttaaataccagctataaatttctgcaaccgaagtaagcggccggatgatattggcatgccaggtttctttccagccttcgtattccgctttatggcactcagcgcaggctttagagcctacatacttggcgttagcttgagaagtaccatcgctaactcctgggattggagttactgcattggaagcaccagcattggcagcataaccttcgctagcagggcctttccggtggcaggtttcacaggtacccatattgggtgcccgctttaacgctgaagaaccggcaatctcatcaattacctgaccggaccagtaatcattggttagtgttcttgtccagaaatctttggaagtaccgtgagcataatgacaggtgagacaggtcatgacatcgccgtcactccgcttttcgtagaccatgttggttaaaggcaagaaggctttaaactcgtcaaccttaaagccaacctggtgccggtatgcttccgtatactgaccggttaacttatccgaagaaccggtactggtagctatatttccggtatcggtattgtaatcggtgtgacaggcaccgcagaattgattgattccgtaagtgtgctggacgaactcgctggattttaggtagtcttttacttccattttgaccttcaaagcgggatagaagtaagcgtacaccaccgtcacgcttccattttcctggagtaatttaatcttggtttcgccgctggtaccatctaaaatatagtccacgccttcagttttcaactgcccatttacccaaacctgagtccctttgttatatggatagcttctgacccactggaatttttgggcgttttcataataccctgttacttcattatagatatactctacatttgacttatagttaaggtaactgtaagcattaacgttggggtttaagattcgggcattaccacctaaaccgtgggggctgtggcaggattcgcaaccaaaggtgatgtcccaggcagttgcattagctttgtccggagtattgttgatttcataattaccggtagtgtttccgcctggagctgcaaaaatttggacagaaccgaccacattgtggcgagatagcgaagattcagcaccggtaccaaacataccaccaaaggtagctttcccggtgctggcaatgtaaccctcttccacgttataagtagttccaatagtaccgtcatggcaggccatacaggtatcatatactgttccccactgcaaaagggtttggcctactgcggtgtgggtagcatggcaggctgcacaggcgtcggtatttttggagtagttgctgtgaatgcggtaactggcaggattttgttcattggggaggtaaatttcattgggataataagttgtaccatcataggtaaatttctttacggtagcttcatactgacctatgccgtctttatagacgctggaataaacgttatttgtaatagtagaatccgttttatcatacggcaccagcacctgagcggcataagccgtggcggtaaaaataattagcattaataccgccaggattaaaacaagcccttttctcatggtaaacctccttgtttttattactaccccaagaaacccgcttcctcttctcctctcccccctttccggaagtagactgggtccctctggggcggaatgtacctccttgtgtaacttttctctttttaaacccactaatatatttacgccaattgtaaatattttcctcctattattaaaaaaaattttagtaaaactatatttaaaaaaacgacaaaacccctcacatcttttgacatgaggggaataaaataaactatttatttgtattttcgccacgcaatacctttttcattatttttccggtagcatttttcgggagctccggcaaaacctctacataacgcggaattttataagcagcaagtttatctcttaaaaattcggaaagttctttgcgggtaagattattatacccttctttcaaggttataaaagcttttaccgcttctccccgcactccatccggaactcccaccaccgccacttccctgactgcagggtgatcaagtatcgccctttccacttctgtaggataaacattaaagccgcttactattattaaatcttttttcctatccacaatatagagatatccctgttcatcctttttgcccaggtcaccggtcaaaagaccgccatttaccaggacttttgccgtttcctcgggtttattataatagcctttcatgacgtttttaccaaaaaccattaactcgccaacttctccaggaggaagctcatttaagttttcatctactatttttacctccatccccggcagcactttgccgatagagccgggaattcgaggcccccttcttgggttcaatgtaacaattggagatgcttcggttagcccgtagccttcgacaaggggaaccccaaatttttcctcaaaggcataaaaaaattgcggaggcagagatgagccgcctgatacggccaaatgtactgaattaaaggcttcccggggtaaatattcaagaaggtacacaaacatcgaaggtacacccagaaaaatcgtaattttttccgctaccagtactttcccgatctcccggggattaaaaccatcttcaatggtacaggttgcaccggtataaaggggtgccagtaaacaggcggtccaagcaaaagaatggaataaaggcaataccgccaggtagttatcattttcatcaacttccgcaaagcgcgtaaccgaatcggtatcaaaaattaaattttcgtgggtaagcatggcacccttgggaaagccggtagtgccggaagtatacagtatggtacaaacatcattatatgttggttcaataaactttgcctccaaattcattatttccgaagtcaaagcttcatttaacactattaccatttcttcgggtaacggaaaacgctcctttaatgtaagccaaattttttcctgaattgcaacaaaacgggcctgagcgtcaccaaaaatatatctaatctcttccggagctaaacccatgtttaccggtatgataatacccccggctttgactacaccaaaataagtatagacaaattccggagaattacctgagactaagagaactttatctcccggctttaatcctttttgctgccaaaaaactgcatacttttcaataattttcgccatttcccgataggttactttccttccccgaaaacttaaagccggatgctctggacgaaaattatttttaaaaatttcgtgtagatacattactttgcctccttagaattggatttacattatttttaaacgggtaatcccatcgccaataaattttgctcccaaaacaactaaaaaaatgccacagataaatattataaaaagataagccgtttgtttaagatgttttcgaccgcgggcaatcaagtacgaaataaaaccataccagctaaaatccgcgagcaagtgaccaagtaaaaaggcacctactccaaaaactccaacaatcagggacctggttaaatagcttaaaccaattgtcgcccaccaaagggaccagtagggatttgccaaagaaaccaaggccccattaagcattaaccgacccggcttttggggtattgaagcacttccggttaaatcaagggaaatttttttataaccggcatctctggtcatggtaaacccaaaataaataagcatcactccgcccaatagtccaatggctccagagacgtaagaatttgtaaggattttccccaaacccaaaagtattaccaccacaagcgcagtctctaatagcgcatgtcccaggattaaaagcgggcctgcccaaaatccccgccgtaaactctcgttgatatttaccgttagaagcgggcccggcatcatcgccccggaaaagccaacaataaacgccgtaacaaacagaccaaatacttccacctcttttccccctgtctcttaacattaaatttaatatttattatattctatatcttataaaaaacagagtttttccgtcaaatcgtttttaaaaaacaaaaaaacctgcattgctgcaggcttttctttcaagtggtgccggagaccggaatcgaaccggtacgggcctttaagggcccccgggattttaagtcccgtgcgtctgccagttccgccaccccggcgaatttataaaaaattatttgattgttttcattgtggaggcggcacccggattcgaaccggggaataaaggttttgcagacctctgccttaccacttggctatgccgccaggttagataaataatggagcggaagacgggattcgaacccgcgaccctcgccttggcaaggcgatgctctacccctgagccacttccgcccgttttttaatggtgccacgggacggaatcgaaccgccgacacgaggattttcagtcctctgctctaccaactgagctaccgtggcaagctttatggcggagctgacgggattcgaacccgcgatctcctgcgtgacaggcaggcatgttaggcccctacaccacagctccgcatctttatctgcctgtcggcccaaccgacatttattataatacatgacatttacttagaagtcaactactttttttgagttttttattttttcaatgttttgatattacctggtaatattaaaagataacaatgcccggcgcaaaattttggccgccaagagcgatgtacgttccgaaggatcatagacgggcaatacttcaactaaatccatgccaacaatatttaaagaactaagttttacaatggcttccattatctcaatgctggtagctccccccggttccggggttccggttcccggggcaaaggccggatctaccacatcaatatccagggaaataaacaccggcttttgcccaagtttttccaacgctttttctacgcccgccaatacgttttggccaagatagtttgatttttttgtaataaactccttttcctcttgggtaccggaacggataccgatatgataaatgttttgcggcccaataatttccgctacacgccgcataaccgttgcatgggaaagtttttctccctgataatgatcccgcaaatccgcatgagcgtcaaagtgaactacagctaaatcgggatacttttcggcaaattccaggatcaccggataagtaattaaatgttcgccaccgataattagcggaattttaccgtcactcaacacttttttcgttactgtccggatgctggtaaagctttcttcaatcctgcccaaagtaagcgctacatctcccatatcgtaaaagtttacgtcattaagacttttttccaaatcccagtcatactcctctaaaccaaaggaaacctgacggatatgctggggagccatgcgggcacctggccgaaaactgacggtaaaatccataggaataccaaataaaacaaaggcagcaccttcataattgtcggaactgcccataaaaccagtaaatttttcaacaggaagcattatctcaccttctatttgattatctcggcaataaagtttggcagcataaaagccccaaagtgaacctcagcattatagtatttattgctcggatcaacaaatatatcttctttttttaccgccagcgggtcgtatttcttcgaacctaaagtaaaagtccaaactccgctggggtaggtgggaacagtagcaaagtaaagcctggtaatgggaaaattctttcctattcttgtaaaagaatttttaattatatctcgattgaaaaaaggggattcggtctgggccaccataatcccgtcatcttttaagctctcataaacatttttataaaaatcttcactaaaaagttcaaccgccggtcctaccggttcggttgaatcaatgattatgacatcatattcccctttatgttcttttacatgtttaatcccatcttcgactcttacttcaactttagggttccccattaatgcaacggcaatttccggtaaatactgcttacttacctcaattactctttcatcaatttccaccaaaactgctttttttaccttgggatgttttactatttcccgaatagttccgccatcgccgcccccaattaccataaccttttcagggttgggatgggtatttaaagccacgtgggcaatcatttcatgatagacaaactcatctacaaccgtggtttgaaccatcccatctaaaacgagcattcgtccaaactgcagagtttcaattacagctaactcctggaaaggtgttgtttccgtgtgcaatgtcctggtaattttacaggtaatacccacatttggagtttgtttttcggtaaaccagagttccatccttatccccctctattagtaccagagcggtaccgcggcgaaagcacagccgattttttcaaccctgtgttcagcagacttaattatagttttatttaaagcaatgcccctcactttaaaggcttcctctaacatttgggcaattctttcttccgcctctttggctgaacatttacccgaaaactccataattaccccgaaatgatcagcttctgaaatacccacccctacagcagcagcaattaactcaccgggagtgtcagaaattattgccccataagctgttggaactaatgaacccggaggaatcacaaggtcattatccagttcgcaattgggcggcaaaattgaagatacccgcagcaagttgacattcccaatccgggcttttaataaggcattgtcaaaagcatttaatgcagtttcaccttccgcagcggcggctgtcacaaagtatttctttggggttggtaacatgtttttgcctcctttttttaactttccaaattaaacaatgaatattatagcaaaaacctgaaaaaaataaacatcttttaacattattcttaaaaatttttcgtaatggcttaataacccgtaaatctgctcccgaattgccattaaatgcacagttttaacgccttttcgtaaaactccatgccccttgcttccatgttttgagccagtttaataaattcattaatcttagccaccataaccctcctgctttccaattgtattgtcataaaaaattagggtacgaaccagctcttcatgactaaacccctgggggaaatttccccactgttcgccagtacgcgggtcataatgctccgccattaattttaacggacttgccgattttaaagtcctttccaaaaatttctcagctttctccaagcatcccattcttaaatactgacggattaaccaaaacgtacaaagataaaagggcaaaactgctccttcaaaccgcaaaaccgcgccgtgaaaattaagcttttgctcaatatactttactgtatttatcattctttcgtccatcgccggcagcacaccaaactcggttattgccagaaccgaactatcagcaggagcatcaggaccataatgctggagaaaagcttgcttttcttcactgtatcccctagataacagattttcttttatttctccggcagtttttagatattccctggcccggggataatcttttaatgccgacgcaattttagccccggcgatcattccggcataacacattaccttgccaaaaacccactgccgttttttatccctaaactcccagatgccgtgctccggtttatcccagttgcgggcggtaaactctaaggctttttttatttttggataggcttccgccagaaagttcgcatccctggtaaaaagccagtgtttccacaagccataaacgatattcccttcattatcgagctgcagctgttccgccgctttgttgccaaaacgaatgggtttttcaccctcgggccccgataactccggcaaaattatttcgtaggaacacaatccttcaatggtatataaggggttttcaaagtgatccgctttctctaaaagttttagagaaaactcataaaactttcgggattcttggtgaaatcccgccagatcaaaggcataagcggtataaaaaccgtctcttaaccagcaaaaacggtagtcccaattatcctctccattggggtaggctgggaacgaagcggtgggagcagcaataatagctcccgttggttcataggtcaaaagttttaaaaccattaaacttcgctcgtaaaactcctgccaagaagctggaacattttttagctccttttttggtaaaaaccagcgctcccaaaatgccattacctcaaaaagttctctatcgcttatcttaaccaaagcctgatatgcctgttccaaattattaccataacttagcacaatctgcaacctgtcgtcggaaattttcctgaaatcaataaaaaaacccactccaggcccttgcacctgccattgctgctcagttttttttacagcaaactctaagtgattaaattttgttaattctacctcaacttcaattttagccacgtccccaaaaacttcgcgaaccaagagattttttccccagggcatataatccacaactctatattccccggaattagaaacaattattgtttctaataccgctccctttcccaaataccgttggtcttttgtaaaagtcttttcccctaatttaagggttattccccctccaacttgcggcgatagagcttttgcaaatactggtaagccatcgaacttaggcaagcagagccagcatattttggcttcgctatctattaaagctgctgtgatcccattaccgataattgcccaaccctttttctccataaacctcaccctgctttcgcaagcttaccagtaaattagtaagtggagtcagccaaagataaaaagcgtataaaatgtaagcttttgggtttacctgtaaagccgctcctgataaaattgctgccatattccagggaataagtggcgctaaaactactgccgaatccgctaaaattcttgaaagttcgttagcattagccttacgtttaaactcatccctaagggtcattccgggaatcattatagctaaagcttgggtacaggtcaccattaaaagcaatactgctaaaatcattatgccaaaggtgagggaaaaatatgacttaatatgagctaaaggtcgaattaacaaagtagtaaatactcccgtattaattaatattcctgccattgctgatgcgaccaaaataatcgaaactaaagataaataccttagcacgccacctcccgcaagggctttaagccccttaggagcttcaaaaccagtaaatgcctctaacagaagtttttgtattggaaccttttgataaacaattcccaaaataaaacttaaaactacatttataaaaaggttaatttttatggaaactctaaccaacgctaaaataaggaataacaaaggtaagagcaacaaaaccggacttaagtaaaagttactttgtaaaagttttaaataagtagaagttattcccgcttctttagttggacttaacatgccgaaaacaaagtaaagaaaaattgtaagtacaaaaggaaggtaagtagtttttaacataagttttagattatcctcaaccttggtgccggtaacttcagccgtcaaataaaggctggtagaaaccggcgatatccggtcaccaaaaaatgctccagcaaccaccgcaccggctatcatttccggaggcaagttaagcccccggccaattcccatcaatacaactcctaaagtactaatggttccaagggaagtaccgataactaaagataaaagaacacttaataaaaaaacctctaccaggaaaaactttggttcaaccaactgtaaaccataataaatcatggtggcaatggtaccaccggctaaccaaagagcaattaaagccccaagcaaggtaaacattacaatgatcgtccaaaccgacttaattccttctaacgcagaccgataaataaatcgataatcataaccatcaattaaagcaaaaattattgtaaagaaaaaagccagtaccatcgggtaaaccggtgacaggtttaacacggttatcgccaagattaaagtaacaactgcaataaaaggcggtaaaaaagtgagtcggggtttaattgatgctgtatccgtcatttttaagctgctccttgattttaaaaccgttagaaaattggttaagagatatgtaaaaattttcttgggtagtagcaatttttaaaccttcatattttccatcttttaacaatattatatttttaatctcctttttgggaaaaaccttttttccttcctgactttcataaattaacatttccggagttacctcaaaagttactgaaagttttttaaagtttttccgagaaacaagccagaccggaatatttatgagatataaactaagcacaattaaaacaaatgcagataccgaaattaagccacttttaaccccttgagggtataataccccggctaaaaccaaaggtgtacccagtaataatattaacgatgacaaaaggtatttatctatcctactcttattatcaaacttcatccctatccccctttaacctaaatatatcttacttccgttatcattccaacaccaaaaatatcataacgcaatttaaaacctcccagagagccagggaggctaaaggtatacctaataatttacgctcaaagctttaattaacatcgtggcataacttccccggggaaggaaaaattttaactgtaatttttgttttcccgggtaaagttcatctttgacaaggtttcctacatgaaacccttcgggaattaccaccgcaggtcttaaaaacgatttaaaataaaccttacggatttttcgtaaattaaaatcaccacttttcaagccttcccgttccaagattttaaagtactcccgccgcacttcctcgttggggaagggaactttttgggctgctgttggcagcattaaactttttaaataagtaaaactctttttcggtagtgttaaataaaataaatagtcatctactacccccggatacgctcttagctcaattccttgatttaagaggacttcttttaataagttattgtaaaggtaaccttgataagcagcaaagtaaagagaaagctgttctttaggaattaaatttatcgctcccgcaaagttttttggttccttttctaataaactaaaaatttcccgttccactcgagttttagaagcttcaagacacacggaccaattaccccagttagccataaaaaacctttttctttcctttgcttcctttgattcttcgggataaatcgaggttaaataaatctttaaagctccattaagatgacccagcaataatttttttgcaaaaaagccttgttctttatcgtaacttccaaagcgctggtcatcaaagtaattgggaaaaccgtactttttaacgttttctcccctttttatcaggtcgcgcccctcttctccggaaagagcccgtaatgttatctcaaaatgatttcccgcaattaattccgggctcattggcaaattaagataacccattaaagtcaactttaaatttttttcccgggtcgttaaatttttggtagctctgactgttatgtattgaaaagtatggccatagcggtccttccttccgccataaccaatttccgaaagtcttaaaccgttttcggcagcaattctctgcaaggcatctaaagtattccaatagcgtttttctaaaagataaactttaaaatctccttcttttaagattggtgccttgatttcctctttgacgataaaatcgtcaggtttgactttaagcttcatcctgtgacctcctgtcttctctctaattttatcataacctggcaataaacaattaaaaaattgctgtccaaagcaaaattacattgcagcttccaattattgccgttaaaaaccatcccaaaattaacagatatttattggcaatattatttaaaaaccagaggagcacgattaaaacaaacggcaaaacaaagctcaaaaccacctgacttaaaagcaaaagctctatttcacccaggccttttaaaaagaaatacagcgccggggttatgattatcatttttctcgaaagtgccgaaagatttacgggtaaaaacttttctaaaagattttgtcccgctatcgtacccgtgagggatgaactaaggccgcatagcaccagggccaatccaaagatcagtgctgcccaaccgtttaacaccggttcaagggtatgataggcaagcctcagggaatccaccgctactccacaatcatagaacatatctttggccacaacaatcatcgccgaattaaccaaaaacgccagatttaacgcaattaaattttctaaaaaaaccactgggaaatctttagtagttattattctctgctttagtttttccgctatcaaatcactgtgcaaaaaaagattatgaggcataacggtagccccaagcatactcaacactacaaaaagaaaatcaccatccagcttgacacctaaattaataaggttataaatcttgggttttaaaattaacagctccataagataagtaaaacctatagcagctaaaaaacccataattaaaaactcgactttgcgattcccctgcctttcaaaaaaataaccacaaacaacaaataccacggcgattataacgctttttaaaagatccaaccccagaattaaactaaatcccagggctgctcctacgaactccgccacatcggtagccattgctccggttaccgccaacactccgtagaaagcgaccagaggtttcggtaatttttccacaatattttccgccaggctttttccggtctttaaagttaaataggcaaccaacgattgaaacaaaatagctaaaaaattgcataacagcaccgttattaacatgatcgaaccataacgcgaacctccagcaaagtttgccgcccagtttcccggatcaatataaccaatggaaactaaaaaagccggtcccataaaagcggtaaacttgtaaaaaaacctactccgggcttttatctccaagaccattgttctccctccagtcgtctactattttatgaccggaggctaaaaaaggttaaagcccggcttaaagccgggctattagccttttacttttttctcccctttccattctaagtttcttagaacaaatttttggatcttacctgtaggggttttgggtaacgcatcaacaaactcaattttctttggaaccttaaatccagccattttctcgcgacaataagctattaattcttcgggagtaaccgaagccccttcccttaaaactataaacgctttaggaacttcaccccagcgctcatcaggagatgctaccactgctacttcatataccgcaggatgggaatataaaacgttttcaacttcaactgaagagatattttctccaccagaaatgataatatccttggagcgatccattatttcaatatacccgttaggatgcattactgctaaatcaccactgtggaaccagccgccagcaaaagctttagccgtatcttcgggtgctttataatatcccgccatcacaccgtttcctcgcataacaatttctcccatggttttgccatcagctggtacatcattcatttctgcatccacaactcttacttcaccggtagtaaccataggtactccctgccttgctttgtaaatagccttttcctcggcggataaattatcccactcgggatgccattcgcacacggtaaagggtccatacacctcagttaaaccatagacgtggacaacctcaaccccgaggcgttccattttactaataattgtaggtgaaggagctgcaccagcaataaaggcccgaattgggtggttaaattttaaaccttccgcttttttcgcagcagtcatagcattaaaaacaaccggcgccccgcagaaattagttattttttccttttcgataatttccagggctgcttccggttcaaattttctaaagcagtaatgagtagcacctactgcagttacggcccaggtaaaacaccagccattgcagtgaaacatcggtaaaatccagaggtatttagaatactgatttaaccccatctcaattacttctgaaagactgtttaaataagccccccgatgggtatactgtactcctttgggaaatccggtggtcccggaagtgtagtttaaagttataggctcaaactcatcttcaataggtattggtaaatcttccggctctccctcctgcaaaaattcttcataatccaccgccggaagtttagtttccctgggaacctgatttatcattacaatcttttgcaccgtttccaactggtcgtaaataggttcaattaaagatgcaagctccgaatccacaatcaagattttactttcggagtgatttaaaatatacaggatttcattggatttaagccgggtattaatgctcaccaataccccacgtgccagcggcaccccataatgcccttccaaaaagggatgaatattcggggcaagataggctaccttgtcccacttgccaataccatattttttcaaagcagaggccaggcgatttaccctttccttaaactcccggtaggtaaatctcctctccccatctacaacagcagttttctccggaaacacataagctgctctttttaaaaaccagagcggtgttaaaagttgtcgattaacttcaatagccataaatactcctccccctttttttaaaatattttttgttttttgaatatttatattattttatatttttatttttttgtcaataaattccttaagtgtatacaaaaaaccggtacattcgtaccggttagaaaataaacttccttaatatttgccttgcttcctttaaatttgtaggtattcccagttttccttcaaaatcctcaaaaagctttaccagtaatggtgcttttaacccattttgttctaataattggcgattggttaagatgcttttatccccttccgccaccacacgcccagcattcaaaaccaccacgtaatcggcccattccagtgcccagtccaggtcatgggtgctgacaattaccgttttcccctcattatttaacctgtttaaaatagcagtaatttcttcctgacctcttgggtcaagataagccatgggttcatctaataccacaatgtccggctccatcgctaaaactcccgcaatggcagcgcgctttttctgtcccaaacttaaatgatggggcggtctttctcttaaatcccacatatccacggctttcagagcttcctcaacccgcctcaaaatttcctttttatcaagttcaagattttgcggtccaaacgccacatcatcaaaaatggtagaagcaaaaagctggtcatcggggtcctgaaaaacaagcccaaccttttttctaatctcccggatattttcctcattaataacttttccgaaaatcttcactcgtcctctacttgcggtataaaggccatttaaatgcaaaagtaaagttgatttccccgcaccattatgacctaaaataaccgtttttgacctttccggtataacaaaagatactccatctaaagccttatttccatcgggataaaaaaacgttaaattttctatttccaccgctaaattcatcccaataacccccaaattaaccgccaggcaagcccatgatattcaaaatcaagtaacattaaaacccaaaacactatcaacaaaaaaaacacaacatccttccgctttattcttttttcctcaagtaccggccacctgccattgaacccccgggccagcattgcccggtgaaccctttcacctcttaaataagctcgataaaaaagcatgccaatagtctggcccaaaattttaaaagttcttttatgccataaatttttaccttcctgaaaaagccgtgccttccttgcggtttgtgcttttttcaactcctcggaaaataaagctaaataacgtaacataaactcgatagtacctatgaactcctggggtaaacgtatccgtgaaagagcccacagaaaatcccgaaaaccagtgcttccaagcattaaagaaataaacaaccagatggtaacaagcctaattccaattaccgctccttttataagcccggtcttggaaaaaacaaccggacctaaggtaaaagctacctctcccggagtcacaagcggtagcaggataagaaaaattccagcaaaagcaaaaaagtacaaaaaccgggtaagcaaaaagtttaaaggcaaacgggcaagaagcaccaaggtaattgccagccataaattaagaaatagcggtataaaactttttatgatgctgcttaagacaattaacaaaaaaaagcctgtaactttaatccttggatcaagtttgttaaaaatgcgactttgtttttttatatcttccaggtgccagtgactttttttcattttacaccccttttccattatgacaaaaaaaagaaaaatagccaataagcgaagctgcttaccggccgggaattttatctaaaatgccaaggtttagataattttaccggcttccaagcttttttccaatgaaccaggcaaccccaaaagtcagcaatgtaccaaaaactccggctacccctgttgccaacttttcgtttttaataccaggaaaaacataatcggcagccggtgaaactaaaatcgtcttgctcctttcttccaaaccaaaatccttaagaactctatctaaaccatccggattagccgaagcaaaaggcgacaataatagcgccagcaaaagggcagtaactaaaccaattaatattttatttttcatttattgctacctcctttatcccttgaaaaaaccctacaccaaaaatcttttccagatacgttaccgctattaaagtaataaacgcttcgcctaaaccaataaaactatgccagaaaagcaaagccccggcagcaactttaaaggacagcaaccctgataatgaaatttcaacggatgctgctaaagctccagccaccaccgaaagccagctacctccaattaaccctaaagttttcccggtttttcctggaattattctctgcatcaattggtaaaacaaataccccgtaaaaactcctattaccgccatgttaaagacattagctcccagagctgtaatgccgccatccgagaaaaataccgcctgaacaaataataccgtggtaagggctaaaacggcattccagggaccaagtaaagccgctgccagcattccccccagcaaatgacctgaagtaccaccaataatcggaaagtttagcatttgtgcggcaaagataaacgcagaaaccaccccaagcatggggatttgccgctctcctaactgccctttgcttttcttaagcgaaagccctaccactcctgctgaaactcccgccgtaattatcaaaacttccgggcttaaaattccatcagcaatatgcataaaatcccctcctgaatgtttataaaaacaaaaagccaccgaaaccgagcttcctgctctcggccttcgtggcttttttgtccatttataaaattgtcctttttgttaacaacaaatcgatgctaaacccttctgggtttgttttctaatgtaaattatactacatttattccttttttccttcttaatataaaaatatttttttcacaaattacctttccaccagtaccgccatacccataccaccgccaacacataaggtagcgatgccccgtcttaaattccgccgttttaactcataaagtaaagttactataatccgggctccggtagctccgaccgggtgcccaagaccaataccacttccctttacgtttaccttattcctatctaactctaaaagcttttcacaggcaaggtactgggcagcaaatgcttcatttaactcaattaagtcaatttccgctaaactaagccctgtcttctttaaaagtttttgaaccgccggcaccggtccatatcccattaactccggctcaactcccgcccaggcataagctctaatataaccaagcggctccataccatactgccttgccgtcttctcccgcatcattaaaaccgccgctgctccatcatttaaaccggaagaattccctgcggtaaccgtgccgtctttaacaaaagtgggaggaagagccgctaatttttctaaggaaatatcccggcgcgggtgctcatcggtcgtcaccaagactttttcttttttgtttttaacttccaccggcacaatttcctcggtaaaccaaccattatctatagcttcaacggcaagtttatggctcctatatgcaatttcatcttgttcctcccgggaaatattatatttacgggctaaattttccgccgttacccccattaaaattttatgcagcggatcagtcaaaagctcccagagagcatcggtcatctccccgtgggtaagcctctgcccccaacgggcggtttttaacacaaagggagccgtactcatactttccacaccaccggcaataattatgtcgttatcgcccaaagccaattcctgatacgccgaaacaatcgcctgcatcccggaactgcactgacgctgcacagtaaaaccggtggttgtgtagggcagtccagccatcaaagccgcagtccgccccaaatttggctcatcggtattcatcaggcagttccccagtataacctcatctactttttccagcggaaagggtaaatcccttattaactccttatataactgtcgccgctaaattacctgcagatacatttttaaactgtcccccaaaactcccgataggcgtccgtttagcccggacaatcgccacatccaccaaagcctaatcccccttgttttaaatttatgtctctttttatgttaaatgacaattttaaatatttcaacaatttagctgaaaaaaattaataaacttcactggttatagaaacgggtatatctatagctaccggagaagttggtaattccattttcattccaccatcttttcgtttttgtatcggcaaaaggtagtattgataatggctacccggagtaacctgagtgtcagcaaacgaacctgtggagctctccccaaccataaaggtcgaactatcttcatttattcggtatatttggtaagtatatcccggttttggttgccagcttaaaacaacccctttgccttcaacatacactgccgttaaattactgttttgggttgcaggatttggaggggtttcgggagaaatagacttaggttctttccccttggggaaaacttcgtcaactacctgtccagaaggagttaaaggcccagcaattaacccggttttttcatcgatacttacccgcaccaaatttcccgggatggtaaaaggcttttccccgtgcagttgtacaaagtaagacactattttacgtaaaatcaccgcaggatacgatcctccagtaacaccccgtaaataatgaaaacggtcggttttatcgtaacccatccaaactgccaccgaaatatccggagtataacctacaatccacgcgtctttggtacccttctgtcccggagttttaaagggtacttcggtagttccagtttttgccgctaaaacacccccaaaatttgcccttctggccgttcctttttttacggtgtcaacaagcacatcagtaattaaataagctgtttcttcagaaatcactcttttttcttctaaagcattttttcttggaatctcatttccatctttatcaatgattttagtaatgatatggggcgtcctatatattccgccattggcaaaaacggcataggcagcagccatctgcagtggtgatgctccccgctctaatccccctaaagccagtgacaggtttttatctttcgcagttaattcaaaaccaaacctttgagcgtattcatacccggtgtcaactccaatctcatttaaaagctttactgcaggtacatttaaagactctaccagtgcttttcttaaagttactctaccgtgataagcaccatcaaaatttttgggtttataatcaccaaaaactacaggttcatcaactataaaatcagatggtaaataccccttttcaaaagccggagcataatcaacaatgggtttaaaagcagaaccgggttggcggtacatcataaagctgcgattaaacccaccaaatcttccataattccggcctcctattaagaaaacgatcccgcccgtttcagggtcaactcccgcagcagccccttgaactaaaatttcgtcggtatttggtggaaaattctgggcattagcaaagactttttccgcatacctttggatttcccggtcaatggtagtataaattttatagccaccggtatttaattgttcccgggaaagtccaaaatcctcctcactttcctgtaaaattttatcgataaccgccgcatactgattgccttgattttgagccttaggattaatttttatttcttcccttttagccttctccgcctcctcctgggttatataaccctgctccaccattttatccagtacaagattttttcgacttaccgctgcatcataatttatggtcggtgcgtaataatttggtctccggggtattccggcaagcattgctgcctctcccagggtaagcttggaagccggtttaccaaaataattctgggctgcttcctcaataccataatttccattcccaaagtaaatcacatttaagtacatttccaatatttctttcttggtataaacccgctcaagctgaatcgccaaaagagcttctttaattttccgggcaaaagttttttcctgagttaaataaacattacgcactaattgctgggtaatggtacttgccccctgcgcaaggtcttgctttaaaatattaactacaaatgcccgcaaaatacccacgatgtcaataccaaagtgctgataaaaacgagcatcttcaattgctacaaaagcctgaggaacatatggaggtagttcatcaatttttacataagttcggcgctcgcttcccgaaatttgggttaaaaaacgaccatttttatcataaatcgctgaactttgctgtaaattataaagcttatcaaaatctttagcagatagcgtaaaactcgcacatccattaataaacaagctaaataaaattaataatgttagcaaggaaaattttttgccaagtaccttactcatacccgtttccacctttctcctgcaatgatttcttttttaaatataataatacatcttacaacatttttcgaaccagttttcttacttgtaattatttccaaaaataaattcttgacaccgtttaaatgtatctatataataaatcttgcgagtcacgtcggagtggcggaactggcagacgcgcacgtttgaggggcgtgtgggaaaccgtgtgggttcaagtcccacctccgacaccataaagaaaattaacccgtaaacctttaaaggtttacgggtttttgttttaacatgacgttactatctgccagttacatcttcatatttcctccacccaccattaataattcaggatttaacataccaaagatcattgctatatgagctactgctaaaaaaattgccacaaaaaccgcatgtaaaaacatcttttgttcaggagttttatttttataaatagcacccagctccaaaagtgccatacccataagtggtactactccggaaagataaaacccaactgcaataatatcaccaataccacgccaaccgccttttgtagttaatggaattactgcattaaagaaaagatagataaaaactcccaagaaataaaacccacctatgattcccgcaactttgttaagttttcttattccactaccagtatctcgcttaaataagataaacaattccgtaatcgccacagtttcagccaaaataacgggtatggccataaaaatgattaaattccacggttgattggtagctaaaagctccatataatgagtcattgtcaccttttcaccctcccttctacactatgtagttctaaggttagattaaaacaattgtgttacaaatttgttaaaaaaatgatgcaaaatttatacatttaataccaaataaaaaaccgacggaagaatccgtcgataaaggttaaaataaacgttttaccggttcaatacattgaggtacatccacctggggcgagttaaccagagatgatacttcaaaaatatccatttccttttccgggtaaggagtaagtaagcttttaattaaatttacatctttaatccccaaatctaaccaaattgaaattgcctcatggttcaatattactggcatccggtcatgtattgacctgataagtttgttagcctccgtagtaataatcgtacaggaatacaccattcgccctccgggatcttgccagatatcatacaaccccgcaaaagcaaagggctttctgtttttcaacactatcctataaggtattttctttcctccgctcttttcccactcgtaaaatccatcggccagcaccagacagcgccttcggataagaagatttttaaaactgggcttttggtccacgttttccgcccgcgcattaatcattttctggccaatagcagggtctttggcccatgccggtattaacccccagcgaaataactttagacgccgtcccccctcccagattaccaccggtacatcctgagtgggagcgatattatacctgggttttaaaggaaaatctataggttctaaattaaaaagtttttctaataccgaaaaatcttctgccatggaaaaccgtccgcacataatatcaccttgacaaaattacataatgtaagataattaaaaaaaatctaaaaaggagtaacagcatgaaatatctcatcttaataattttgtggcttttattttgctttcttcatagctttttaattcatcctccggtggaaaattttttaaaagataaatttttccctaaaagctaccggattttttataatttaatttccttatttagttttaccggtgcatatttatatttaaaaattaacttttccgaacccaaacttataatcatacccctttggctaagtactatttttataataaccggaattttgcttatcctttggagtttttcctgctataacctcaaagaatttttaggtttggctgcgcaaaataccaaaaaccttgttaaaaaagggcctctaaaatatcttcgccaccctttatacttagcagctctccttttaatctggagtgaaagctttaatttaccaagacttctggtaaatataattttaagcggatatatctttattggtattaaattagaagaaaaaaagttaattaatatttttggcaaggaatacgaaagctacaaaaaagaggtaccggctttatttccgctaccccaccgtatttttcgtgaataattttccctttctttaaacttttttgggtcgaccccgttttcttgctcctttttcttcaggagcttttttaattttattttccattaactccaaagtttctttaatatcttttaaattgttaagaatttttaaaagctgtttctcggttttctttaattggttttttaaaagattatactgttttttggcaatcaaaactttttgctccggccttcctggggaacgcttgctggaaattttattaaaatctacatccggctgcagcaaaataatggtatttggatcccggcgatttttccctttctttatttttataacaccattttccgctaatttctgaattgctgaccagatattaggtctttgatacttataatcccgaccctcaagagcaattttctgatttattaactccgtaatcctttccaaagtcattttaattgtttgttccggagcttcctttaaaagttctataatataatgctttgccgtttttctacttatattgttagcattatttgcggtatttttatttttttgagtttcagaaatattaatattcgcgctctcctcggttatttttgtagccttctttcgaggcattttttcacccctttcgttttattataattatattatcactattttattaaaattttaagtagcagaaataattttttaagaaaattttttatttttttgtttaactttgtagttgactttttttactttacaggttatttttaaataaaaggttaacttcggaggtgattaagttgacaattaaaacagttatttatgctgctttattagcagccgttaccgcagttttagcccagattgccatacctttacccggaggagtcccctttaccctccaggtctttgctgtttttcttggaatctttttgctgggaaaaaaatctttttggggaatgctcacctatctccttttaggggcaataggtctgccggtctttgcccaagctcgcggtggtataggcgttatcttaggcccaaccggtggctacttgctgggattcgctttaagcggattaatcggggggtttattgttgagcgcagcaactttaatatcgggggtaaaatcctggcagttcttgtttctcttattctcatctattccctgggaacaatccagctggcttatatcttaaaattaccattaagtaaagccatcgccgttggtgttaagccttttgtcccttgggacataataaaaggtgtcatggccatcttactggcaacacatcttcagaaagctctaaccaacgcaggggttaaattaaatggttaagctaaggccccatcatctgctatgttttttaggtttccggggcttgggctataacgaccactttacccaaaacttttccaaaattcgtatcaaaattcttaaaagccccaagcttcttcttgagcttgaaacccaacccgacgacatctgtaaaaactgtccggaactcatcaacggtttatgtcgcagcactaataaggtaagtaaaaaagacgaatttctcataactttttttaataccaaggcaattgccgttgaagatgcctacaaaaaaataaaggccctggaagagcgtaaatttatcgctctctgccaggactgtgagtggtatcccttaggtttttgccttgaaggtttccgcaagttaaaaagtacttctttatttccataagccccgggagttttcccgggcttctttttggaactttacaaacagcttggagtattttacattgggaggaacagtcatcacctgagcatacccctctagcaaaagatgggcattaaacattttagcccgaacctcctcttcagtaaccttaactggcttttttaaccagacataagctaaatctcgtccgtatttatcttgcttttgcacatcatactctaaaaaaataatccggcccttgtagagaacttttttggtataattgaaagcttctttcccgtaaggctgttccttaatcccaagttccggatgggaaagttccggtgtatttaccccaatcattcttacccttatttctttaccggaagataatttaacttttaccgtatcgccgtcactaacttttactactttagccggaataaaatttgttgcagcatcgacatccccggcacacccctgaagaaaaagtgcaaaaagtataaaaataaaccaaattaccttaactcgtacccttttcatctccttcaccttcttctacaattttagtgcaaaaatttccgcaaattaccttttgaccatcctcgctaaaataacgggataaagcccagaaagcttttcttgtaaacttcaccggaagattattaacagtggtataaggaatccggtttttaaaataaaccggcccttccatgggaaacattaatccaccttttaattttaaatacagccagctatctttttccacgaccccttcagcaaaatacggagcatcctcaacacagatcttttgttcttcaccgttataaaccagataataatgcccacttttacaggtcaaacttttataaaataactcaatgaccttctcatttattatttgttgtcctgcgtaataccagttaccctctttatccagcaaaatcttaatatttaccaccccgtcttaatacaaaaagcggtatactttataattccataaaacctttttgacaaaggcttttgtttcattaaagggataaaggttaggattttctgctttgttttttttcagccaagtatccatattggcaacacccgcattgtaggcacctaaagctaactccaagttaccataacggtcaattaaatactttaaataaaaagttcccaaaaccaaatttttttcggggtctaagagttcttccggttttgccagaggttcattaatctccttagccagccagaaagcagtctccggcattatctgcattaaacccatggctccttttttggaaatagccctgggattaaaattactttccgcttttaccactgccgccactaatagcggatcaaccccggcaaaagatgcggcatcgtaaagtttatcgctgtattttatgggatacaatattttaccccaaaagggaaaaagcaaaatgacaaccagcaaaactgtcagcgttaaggaaaaaccatttatttttttgaccaatctttccacttccatttctgcaaaatagttaaaatctgctcccgggtggattcgatacttccgctgttatcaatcaccacatccgccagtttcactttttcctctaaaggcatctgggcccgaattctggcaagagcttcgtcccgggaaaaaccattccgggccataagtcgctttaactgttcttcttcgggaacgtaaaccacccaaatttcatctaccagtgaagtcatttttgcctcaaaaagtaacgggatatctaagacaatccagtcaatccccgacgaagttaactcctttattttttttcttatttcctttaaaacttccggatgagtaatgctgtttaaaaccaaaagcttttcccgattgccaaatacaatctttcccagtttagcccggtcaatttgtccatcttccgttaagatatttttaccaaaagtatcaattaccttttgatatgccggatgtccaggggtcaatatatcccgggcaatccggtcagcatcgataatcgcaaaacccagttcctgcaggatccgggaaacagtgcttttaccggatgctatacctccggtaagtccaatgatcggcaataccaacacccctaacttaaattatacgtgaaactcccaaaaaaattaaaaccagtgaagctaagtagcgggaataatttttaataaaactcacctttccatttaacttaccgataaccaatcctgaataaaaaaggcaaaacttaattaaccccacatttagcatcgttaaaataaccgggtaaccggataaacttaaaccaattccagccccaaaggcatccagagcaagggccacacctaacaaaactgcctctttataagacagtacccccgattcatcccgatcggctaattgcggagagcgcaaaatttgaaagattaaaccaaaaattttaacactaaaaaccacttccgggtctatagaagcctttttctcttctttacccccggaaaaatatacatacaaaccgatggcaataagtaaaaaagcccccaaatagcgggtaaaactatccggaacaaaaaagtttataaattttcctaaaagcatggcaagcccaatgatcaaagcagaagtgctgcttaccaccagtaccgacagggtcggtacgatcaatcctcttagcccataagctaaccctgcaccaaacccatctacactaagagctaaagcaaacaacgctaaataaaattccatcgccggcacctccccgtcttttttaaattatttaaagacggtaaagaaggtgcctgtctcccctttatttctggcagtgcggacagtagtgggtactgcgaccggcgtgacgttcgcggattaggacattattacatctaacacagagtgaaccatttttcccgtaaacttttagcaggcgttgaaagctcccctgctgattttccgcatcaacataatctctaatagacgtcccccggtactcaatccccagggctaagattttccgtatagctttaaataactcttctgcctcatcttccgataagctggcggctatccttttgggagaaagccctgcctcaaataagatttcatcagcgtaaatattaccaatacccgcaattattttttggtctaataaaacggccttaagatttttctgtgacgcctttagttttgtttttaaatactcaggggtaaactcgtcttctaaaggttcaggacctatttccggcatctcaaaagaaaagccaccaaactggcgtatatcattaaaatgtaactctaaatcgccaagatcaaaaatagcatgggtatgtttatctttcggcgaccctttgggtagtattaaaagtttcccggtcatcctcaaatgaaccgttaccgtttcctttccggaaagatctatcagtaaatacttcccccggcgttttaaagctactatttctttccccacaacgcgccgggtaaattcttctaccgaaacatttttaataatttttggaagatatacttctacccggtaaattgtttttcccaaaatttttggggcaagggttcttttaatggtttctacttctggaagttcaggcataataccctctccttacttcgcttcataccagtttttgcctgcaccaacttcagcgattaaaggcactttcagttcaaccaccgactccataaccccttttaccagcgcttttacctcttccagctcttccgccggcacttctaaaactaactcatcgtgcaccgaaagaaggagccgggacttaagcttacgggctttaagttctttttctacattaatcattgcaagcttaataatatcggcagccgagccctgaaggggagtattcatggccgtcctttcgccaaaaccctgaaccgtgcggttttttgaagatagctcaggaatatagcgtcttcgcccaaataaagtggtcacatatcccttttctcttgccgtacggacaagttcatcgagatactcccgcactttgggatagttggcaaaataatttttaatgtacttaccggcaacctcccggggaatctttaagtctctgcctaaaccaaaatcactaatgccataaacaatgccgaagttcaccgacttggcatgagcgcgcatctcgggagtaacttcttccaaagatacaccgaacacctcggaggccgttttccggtgaatatcctcccctttttggtaagcttcaataagcttgggctcttcggaaaaatgggcaagaagccttaattcaatctgggaataatccgccgaaacaatataatcataccccggtgaaggtataaacatcttgcgtaatttccgaccgagttccaaccggatgggaatattttggagattgggctccgaagacgccaggcgtccggttaaagtaccggtctggttaaaagtagtgtgaagtttaccggtacgctcatttattaaaggcattaagccgtcagtataagtggattttaacttcataagctgccggtaattcaatattttgccgataatttcgtggaaaggcaagagctcttccaaaacctccgcatcggtagagtagcccgttttggtctttttaattaccggcagcccaagtttttcaaaaagaataactcccagctgcctgggcgagtttaagttaaactcttcccccgccagcacataaatttcccggattaactcttcaatttgctctcccagctctaacgacatctcttttaaagcttcccggtcaacctgaatgccggtatgctccatttgagcaagaactggagttaaaggaagttctatttcataaaataacctttcttgctcctgctcaaagatttttttcatcatttctttttttaaataaaacaaccctctaatgtttaaagatacatcttcatacaccggtaagtcatactttagataaagccccttgaggccgggattttggtcggccgggtttaaaacataagctgcaatccgcgcatcaaaacaaacttcgggaaaagtcagacctttttctaaacagacatgataaattcctttggcatcgtcggtaataatttttttattcctaaatatttcctctatttcattcagccggtctaaagagtaaaactttgttttttccccgtcatcaacataaaatccatcactaaaaactactgcaatctgtccttccgtttctacagtttcaacttgcaccaaatctttaccttcctggtattctttctttatttttggttctatttcttttaaaaagcttttaaactcaaggcgaagaaataatttagcaacttcttcataattaggttctttaacttttaaatcttccagggagatttctaacggtatttcccgcaggattgtagctaattgtttcgatatttttgctaaattttcgtgttcggcaagcttttctcttaatttaggttttaactcatctttatgggccaaaacttcttccactgagccataagttttaattaaatctaaagcagttttctccccaatcccgggaaccccgggtatgttgtccgagggatctcccattaatcctttaacatccacaagctgtttaggctttaagccgtagttttctaaaatcgcagctaaatccattttaaccagttcggtaatgccttttttggtaaggtataccaccgttttttcatctaccaattgcagcatgtcccggtcagcggtataaatcaccacttcatgtccttgtcccgcaaaagcccttgataggtggccgataatatcatcggcctcataaccgtcaagttcaatatagggaacatttaaaacctttaatacttcccgcaccagggcaaactggggtacaagctcatccggggcttctttgcggtgccctttgtatgcagtaaactgctcggtacgaaaagttttccggctaatatcaaaagctaccgctaaatattcgggtttttcatcttttattacccgaaaaagcatcgttaaaaacccgtaaaccgccccggtaggctctcctttagtagtttttaagggcggaagggcaaaaaacgctctatgtaataaactatttccatccaccaggactacttttcccataattacctccaaaataataattttaagtttattgtaccaaataaagctgactggtaaaagaaaaaagctgcccaaaaaggacagcttaagtaccggactttttctttttaaagcggtagacgaaaaatattattaaaagtaagaggatcaaatacagcagtaaataaatccaacaagaagaaaagttgaaaaaagtttcatcctcgaccgctaatttttaaaatcttagcccgggtcacggttttatttccgtatttatggtttagcctatcgattatcggataaagattttcccgccgcaggtcttcgccaaacagtgatatttgccgccctcctcctaccggtactaagggagtagccgtaaccccaactaatcttaccggtagttccccgtggtaattttctaaaaacagccttttggcttcccggtataacacatcatccatccaggtcggctcaaaaaacctgctgtgccgggtataggttataaagcttgaaaggcgaatcttaacgctgattccgccggcataaaatccctcccggcgaagccccctgcccactgccatagtaagccccaagagctttcctaaaaggtaatccacatcactgctgtccttttgcaaagtaatttctttgcctaaagatttcggtactctttccggaattacctcccgaaaatcaattccccgggacaaataatataagttctgccccagaaccccaaactttttcctaagaaaaaactccggcagttcccagaaatcctggacggttttaatccccatgtcattaagtctttctttcattttttcccctactccccagagcatctctaccggcagcggagccaaaaaatccagtacgttgtcttctctaacttcacaaaaaccgtcaggtttatttacttctgaggccaacttggctaaaaacttattgggagcaacccctaccgatgccgtcagttccgtctcctcaaatatccgtttttttatcttttttccaatttcggcccctggtccaaaaagtttctggctaccggtaacatcaagataagcctcatccaacgacaccggttctactaaaggagtgtattcccgaaaaatcctgaagattttctccgatacttcctggtattttttatggtttccgggaataaatataccgtgggggcaaagtcttgccgcttcccataaagacatcgccgaccttactccaaacttccgcgcttcatacgatgccgctgccaccactccccgctctcccggaactccacccacaatcaccggttttcctttaagctccggattatcccgctgctccaccgctgcaaaaaaagcatccatgtccacatgaataattaccctctttttcatctttcccaccctcgattttagtacatatgttcgattacattataaaaaaatttttcgggcaaaacaacctgcccgaaataattttcctgttgcaaaataaaaagaagtttactataataagttttgcagagtttatggacagtgccgagatggtggaactggcagacgcgccggactcaaaatccggtggggtaacacccgtgcgggttcgactcccgctctcggcaccaggtttcaagctacttagagccgtttgtgcaaaaacggctctttttgtttttattgcttttgcaaatcttttgcaaatccaacaaaaaagtaaaatcccccggcctcaaccgggggttttcaattcagaggcttttaaatgcatcaagggggaagttgcgtccgggacaggcggtttttgtggcagtaggacgcaagcttgcaacttccttatgcccgattacttttggcttgttaaatattttgtattttagccagctgactaataacttaccagaattaatctgttccgaagtaggtttttcttcttcaaagttacctgaaaaacatatgccaatggattcatcattcaaacctaaagcatgtgcacctattacatttaatggcctgccggcgtaaataatacccgccttgttaatataaaaatgataaccaaagccagcaaaacctcgtgctttatgttcagagttaatctcctgccaacttaaatccctcgttgcagctgtatgatgtaagactatataatccacattacttttctttaaaggtaaacctgtaatttttaccggagcgggttttataactggtattgatgtaattgcagcagtttttaggctaaaatcctttcgtaatagattataggttaccggtcctactataccatcaattgcaatctgctttgttcgttgaaaagattttacagctgcctcagtatttgccccaaatacaccatccactttatcttttaggaagcctaactgcttcaacattttctgcacttctataacctggctccctttgtccccaagcttaatgagcattcctctcactcctttttgctaaccattgagccagttgagcaaccgcatcaacaaaaccctcaacggctatatacccgagagctactcctgctaaagtataaagtgcttcatccggaaagtctggataataagcctttataaaagccgttaccgctgctaaaagagccattaaaaacttccggctcttaattttatccagcattgttctcattattttctcctcctttggcttcctgggatttagtaagccacattgcagccgattcctgaacaaaatagccacccaaaattattccgaggagcggtaccagggtttgaatcacctgcaaggcttgctgattcttagtcgcttcccaggagaaatataaaaacgtgccggaaaacatcactgccagcacgtctttaaagcttaattcgtttggtctgctccaaaaggaaagcttcattgttcccgcctcgctctttccaaaagttcatcgattttagcttcctggcgtgtgagacttaactggattgcttgtactaccgctgttacctgttcgagtgctttagtattgttctgtaccacttcaaccaaatttacttcatctttgcggtccatccagcggctaataatgtagattaaccccgctaccgtaaaaaaagcaattccatactgtgcaacatctgccggcatattcattcctcctctcttaaataaaaaaacagtgcaaaagcactgctattcataggctaatattacccttacctggctttgcccacctgtataagcccttactttgagataagtgtaatccggtaactgcatcttgccgccgacgaaaggttcccactttatcccgtttttggactgccagaaatattctgggtttaagtcgctttgggcttcgaagatgggaaggttgtttacgtctatcacctgcaccttaaagatcgcttccatctttaccccttgggtatccgccataaagacgaagtcctgccaggcgtattttatggcatcggtaggttcagttatttctacgtttaagctcgatattaccagtggccctaatccaaattctttttgaaagctatttgttttgtcctcacccatatagtcgtaaaaacaaaggtttctgcccgtattacttacaatgctatttttaaaggtcattgtagcttgaccgaatttaccaacaggcaatttccatttgagtttatatgtttttgtatttactggcgtgatactaaaatctttcgtattttcaccggctacaaatttaaaggatttctcggttatattaaagccagttggcaaattgctggcatatacttggaaataaatttccacatttggcgcattaactaatttggggctcccatattggaaaaggttatgtatgttaagatacacaatattactattttcaggaattacccattgaaaagtgattctgtccggattagttcgtgtcctgtaataacagatattctcaaatgtgataaccaactctcgaggattttttgtgttatcgataaagtagtaaatttttccatcggcaggaacgtataaatcagcattatattttaaaagagaataatctgcattataaatcgttaaatttgagtttgctgaaatatttatactattcgctgttgtgccattgtactttattgtaaaatcacctaaattgatacctaaactttcatcatcaccttgtcctacccagagattggttacttgtgaaggagcatcgcgccagaagtaaggaacttcacttatcccgacgtaatctaaataaatgccatttaataaagtgtttgaacttacatcttcgctaaactctaatgtaaactctgtatttgttgcccattcctggttggtttggtcgccagtaatagctggagtaattgcttttatcccaaaggtttcgttgttaaatattaatacctggcccaaaccataaggggcaataatatctcccgttgggcttataattatatttctttttcttataggcgtgtcccatgcataaacattgacaagatttttgaatgcatgaatgagagtcccaattgaagaaagttttccacaattgcctccggcatccataaaataaatattaccagctccatcaactgttaagttgtctatgtcattcgagtaaaccagaacgctaccatctgtattataaatttgaggaacattttctcgagtgttattgacccattcaaagattttactaccaaaaatgttgaagactattattttatctctatatgaagtcacaaatttgtgattaagtgggtcataacaaatattataggttttgctgtcgccagtagttatttgcgttctaattattaaaaccccagttgctatatccactgccataaaagctttaccgttttcgtcatatcctacaaagtagcatttatcatccagaataactgcttgggttaaacagtaaataggagttccatcttgctttgtagctttccacaccaagctcccgttggttgaattaattttgcaaagtctgttttcgccgtctataaaatagatatacccagcatcatcaaccgtaataggtttatcaatattgttagtctgggtccaggtcccagcaaagtatttccaagaagtagttccatactccttgttgattgcaattaaaatccgttgttctgaatttggatagtattgactataatcaacccctccaaatgtcataagaagtaagttattcacaatagaacagtgatatggaggtccccacatatcagtgagagttacatttacaacttgttcagtgtttatatcaataatgcaaaaaccagcaccattaccagcgtctttaaatttcccatacggacataaaataaaatctccaccaaccatcaatggattattgctaaaatcttctccaggtggtggattatccacccgagggtcccggtcaaagtgaattaatgctgggtagccaaaaaaccaccaccaatattcgccagtgatagttcctatattgatgagttcttttattatattcatatgattatcgacaatatatagcgctgtatctgttgtcaatagaaatctattatcgctcaatgttaaaattgagtttgcactgacattagccttataagctggataaaattcatccaatccaatataaggattattgctccatccttctttatttcgtgttacaataggccataagctattataaagtcccatctacactgccccctctggcggacttgttggttctaaatgtatctgcaacaaaaaaagcggcaaagccacgccgcttccagtgtctatcttctcaaatattagcacgtctcctgcttctaaaagctttgtcttatccgccactaatatatctgtttggaatggttctatatccccgtttatggtgtttgtcgcaattacttccccggtccgctggttcttcagtattaactgcgtataattgcttaagtcggctgtgacactgccctgcggtacaaaataagcacctgtaacctggtaataagtccctgcggcaaaaaccggtattgccccgtaatacccagccgggagcgggccaaataagaaggacaccttttccccatatagcaggtcatttgcaaggttttgctgcaggataatgttatccacaaaactggtgaagtccttaacgaagaaagttaacctgacctgggttatctctttttctgtgtttttaacatttatcgtctcttcttttatcttccattctacctggaaagtttgattaaaaacttcggtaaaagccatctaaatttccccctcgcagggtaaaattgtttcttctttcgtcccgtcggcaaaaattatttcaactttggcaaataattgtggtgttttctttatttcatcactggccccgggcaagtattgaaacttcagtttaaaatccggtggcttgccggtgatagctacatcctgccatatcttaccccctggcagtatgcgaaacacctttaaagatgttggcggtccgccatctattttatccgcgttcatatactgccagtattcctgtgcatcctcggcttttgggttcttgattaggtttttgctgtatatcggttcagccatcttttatcccaccttccggccttcgattgttaccgaaaggccgcccgtaaaatctatattctgccggtaaataagtaaattcacgatccccagcttatcagcattatctattgccgttataatgtcaccaagttccaaagaagggtcgcctcgcgtctccaaaactactgttgcgtatgggtcgctgattacttgttgcaaattgtttaaaatattctgagccaccgcatagttttgaatgtaaatactgtcaatctccaactcacgctcgtcaaatactaccgggttagcaaaagatatgctggacattttatcctttaatgccgtcccggttatggtaattaaaggcttttctgccactgctccgctgttgtttacggttaaaattacttttgttgcagtatattccactgcattggcagtaatatttgcggcctctgttatggttatgtcttttatgtttaacaccggcgacatatcgaaagcatactctggcagtgccgtagttcccggtgatatttcctctccgcttatttccaatagcttatcttctaccggtgtaaaataatgaattctggcagtaagtttactgtaataattatcatatcgttgcgggttttctccggctataatcaaatcgttgtccgtcatagttattaccggagtcccggctgttgattgccttttaacgttaattttcccatcacggccagcataaacattggctccggtaacaagtgccaatttctgcaatatctcgccagcggtttcgtcggttagccagaaatacggaatagttataatagccaaactatcatcaatgtaatattttgttacatcaaaggcgttgaaaataatttcaaaagccttttttgcggtaacgctggtataaactttagatgaattccccttttttttgcctatccaaaaaaggtcgtcataacaagtaaaagttgcctcgacgctgtctgctggcgcactcaagctgtaaaggtaatattggcctaatggtatatattcggtcccggtgcttaatcttacccctaaatacgggacaacttttatcctgggattgattttattgtaatacggcgaagcagtattggttggtgtaaattgccgttcgtcattgcgcaatgtcagtattagttcattagcggaaatcccacctaccgggacgttaacgaagctctgcaattcttctaagatcctcaggctcacaatgtcatcctcggtaaaaacagtcggggtggcatcaaaatatacttccacttttgggacaatttctcggtaatcagctttaattttttctttatactccccgctggtatttatcaccgccacccctccttactgttcgattagcgcaaattccacattctcgtacaacatttccccggagctatccctcgtaagcggtttagctttgattgctccggcatagcaggttatcgttttttcgccgtctgtatcatcataagttaccgtgaaaaaaaccctaccaggctggtaaatttgcgctttaattgcgtttagctgactttcttttaaaagtgtatacttgcagtttaattttcgcttctgggccacatattccattgtcattttcccagaagctacccgcccggatttggttaacacataccactccaggcctatatcctgtggtgttggcatgacttggccgttaattttaaatgccactcattaccacccgcctttgttcgtcaattcttactcttgcaagtctgcgttccaattctcgtaaacctgcttcatctgcgactaaagtaccaatgttcaaatttattactgtttgctcgccctgtatgctgctaagtaatgcatccagttttgagagtggaattattgcttctggttctttctcccctaccagagcaacctgtggagtggttacgattccaccggaggcataagctgggattgggatattgggcagtattcgtttccctaatgcagctaaaagcgcggccaatccgccacctgcaagtgcgcttaactcggtttttaatcctttgaccttttcccatattccgcttaaaaaattaccaactttagtcgctattccttgcgctaagcccggcaagctcccgattatcgtattaaagtttgtttttatgttttcccaaacgcttctaacagtagcttttaacggctcaaatttttgcccaatctgtgttgcataagtctgtgcaaggctgggaatactgcttattatttccctgaatttttcttttgtggtgttccatacctgctgtgcctttgtttttaccggttctaatttttgcccgatttgcgtcgcataagtctgtgcaaggccagggatgccacttattatttcccggaatttttcctttatattgccccaaactgtgctggcacttgtttttacggtattccaggttgtttgcaaacggcccggtagtgtggccaggtttgtggcaattccggttaccagcgacgggacgccaactacaattccgtttttgactgtttcccagccgcgtttaattccttcccagacattttgtaactttgtttgccattcaggagctaaagctggtgccggtatcggccattgcaacctgctttttacttcctcccagcgccgttgtaattcttcccatatctcacttatacggtttcttactcgctcccaagttcctgctgtttcttctgctggttgtggcgttgcaccccagggaggttgctggtttcttgccgggggtactatcggcggtggttttaatggactttcattttcccctgttccttccgttggcgttgtaggagtggttatatcccattcaggtagcaggttctctaccgcactccccaaatttgcttgctccgtttcttcgataacgttatacacttcatcaaatgctgctaaaaacttctttatttctttcgttgtgttagctgtggcctttgtcgcttccttaaaaatatcggtatattttttatagatttcgtttggattggtcttggccatgtcttcattggcttttttagctaattgggcatttatccagtacataccgaaagccgcagcaagcgccataactattgcaacaatcgggtttcttgctaaaactgtacttaaagcagcaaagccagctgttaattgtggcaggattgttaccagtgctccgaataccgttaatagcggaccaacagcagctattaacaccgtaaaagcaacagtcacaacctgcaatggtcttggtaattgctgataaatgtaaatagctttacttaaaaggtctatcattcgagtaattacaggcagtaaaatactgccaatcgttaccgataaatcccgccattgttcccttaattttctggcctggttagccgggctttctgctgtccgtgccaggtcgccttgtgctgctgcggtttgttttaagataagcccataccttgcaataactttttgagtttgggatagttcttctccggtctttgctataccagtctggtaggcatattgcttggccgtttcttcatcaacaagtatacccagcgctttcaatggttcagtttctccggtaattccagcacgcagtttctcaaaggcttcttcgggctttaaattgtaaaagctagccatatcatacgataattgggtcaagctttccgacatacggagagcggcatcgtttgaaaaacccatgcttttaaacatggtaaaaaacatcccggcgttttggcgcagggaataagcgctaattcccagcgctttagctgtttcttcgctccatttacgggctgcatctgccatgttaccaaaggaaacctcgaataagttttcgctttctatggcatccatagcggtgttaaccatttgccggccaataaaagtcaatggtgctgttatggcaagcgacattttttcgccaactttttggatgttttctcctaaatctttgaattgttttttggtttcatcagcaaaatctttcacccttaactctgcttcttttaaacttcttatgagattgctcatatctacgcccatcaaaacaaaaagccgtcctacttccatttacacatcaccacctaactttttctttagttcctccagttcttcccgcatttcttcctttgtcttttgcttcttcttttcccacggtggcggtccaataaaatcttctatttcatacgcttttccttttttcccggctaacaaattagccattgttgcagctaaaaatgcaaatttgctccattccttataatccctaatagaaataaaatcggtcagagagtttagaatatcgtttaactctctgaccgttaatccgtccactatatccggcgtccatccaaattcactggccagtaacactattatttcggcgtaacctgctggctgaaggatagcaagggctttattatttttttcacgccgaaaaaattcacatcaagccaggcctccactaactcttcaatttgcgacatatacgcttcgtctaaatcttcctgagttagctccgggaataatttcaatagattttcctgtaaaaacgggataagctcatcaagttgtttatttgttatgttttcgccaaaggcttcggtgataagcgggattactgtttcttttatttcctttattttcaattccctaacggttacagttttttctgcaactttaacagtcttaacgcgcattatttcacctcgttattaagcttttgttaaagccccggtcccggctaaagtacctttcacattcaccgggtcatcgtgaggcccatcataactaaatttttctatccgtgcatttccagtataggttgtcccgctgggcatttccagttttacctttatggtttgccggttcatgtaagcggtttctatagccgataacccgttatcactttcaagtgctaacccctcaaagtctatactccagctattaaaaccaggaacttcttctttccaaccgttgctgtctttggtggttacatctattccatcatttgacaggtttaaagtggcacctttttgaccgccaactaaaacccaggtaggagttgccggatccgtactggtattaacgtaaagtaaaaaatcaacacccatttgcgccatcttacctcaccccttaaaaagtttttgtcaccttaaaattcacgctgaattcataccgcccgtttttatccgtgccaagataggccgggctctgctgggcagcaatcaaataaaaaattgaagtgttcccgtgtaatgttttgtaaatttcgtttattctttgccgtgccgactggtattcacttccccgcaccatcacctgaaaggtagggtattccaccaaagcagctgttactaactccggcttaaaaccgccagtttcaaaaagtgcgacgcaatcgtccggagtatcaggcataatgccaacaaacatatctactcttaacactgctaatccttgctgttgcaggtaatttgcaatggtttctaacatgttaatcacctatttcctcatggatggcattagcaattaatttttcgtatttatttacgttttctttataaggatcttcaagatattttgcttttcttcctggcactgataacttacttcttgggtttggatgccttagagttaagtcttcgtgttgttttatcgcataaggtaagctgtacccaaccgtgacataaaatcgattgccttcatttttaatatcactaactttgcaatctgcttccaggtcaccgtattcttttggcgcttgctttgctgacttcctttgcaggtcggctccagcagtaagtaatgcggtccttatagctttatcaaccttgcttaataccttctccccgtgccattcaaatttataatccgccattatacccacaccttccggtaaacaaaaacaccgtctaaatcgacggtgtcctcgtaattcaggattgtatactctctgccttcatattccagtttatcctctatcccaggcttaaatgtgacgtaaaattttccctggctcactgcatccttgccgtttttgtctttgattagcttcatcccaccttcaaacctgcaaggcacttcaaccggagctgcataaattggcttaccgtaagcatcagtaccgatttttttgtaccattttgcagtttggttcaagtattccgtcattttatcgccaccgccccggcaagatagggctttagtagctccaatgcttccttgctcagcagttttaagcttgctttatactcttcgcttacgtctccaaagcttacccggaccacattttgttcctgcgcttttgtcctggcactattgccgtatttcagcaaagccagagcttcttcgcaggttgcggcttttacgttttcgttaatcgtgtcttcgtaaacgtaaccaatgctaaaaccaaagcttaatcccttgttgttgttttgtgtaccaatcgaaggataagctctgggaaattctaaaagctgtgtcgggttggcttttattcctttaaattgcaagcgattaattcgttttgttgcttcaattaaagctttttcttttgttttgctatctacattatgccactcatctgcgaaaagcttcccggcaaagtattcttctgcttcggtcaggtctacatagcttaaggccataaggcatcactccttaattgtttttgccgggagatttcttctttggttgcgttttttcctgctctttggcaacttttttctctgcttcgtcaaactgtttttgcatttctcgccttcttctattgaatgctgtaacgctcatattcccacctcttaaaaagagcaggagacaggattgccctgtcccccgcttaaattttgtgaatgaatgctaccatacgaatcgctttcggttcatagacacgttcccagttggtcccgttctcaagttcggtattgctggggttgggtgcgcctacatacttaacaccccgtgggtgtaaaatgaaggttttccgggtaatcaggtaatcttcgccagccagactgtcccggtcggtttcagttggtacaaagccaacagggttgccgttaccgtatccgatagccccctgggcgaagatgaaagtggtaaatacaccattagtggtatcaacagggcaactatcatctacgattacccgtttgcccatataggttttaatttgaggcatattctcagacggctgaatagtttggataagattttgttttgaaagcgcagcttcaactgcagaatgcattactactgctgtaagcttttctttggcatctcccagcttttgcaaagcatcaataaaagtcgcgccagtaaacttggcagcatctccggtattagcagaaatatcgtgtaaattagttgccattgtcggagcggcgaatacacctttgaggatactgattaaagccgcttgcatccgccgtctccagtagtcagctacaaggtcgccaattaccagcattggatcgtcgccggctaaagctgcggcaaggtcattagctccccatgcacgaccccgacggagaattactgcgatatcttgtccagcagtaatcttgccaggtgttaatgccccctggtcggttaaaacctcgtcttctccggtaaggtcgttccagaagggcatattgacaacatgggacgagctggaggccaagcggtcaaactcttcaccggtagagagaataccgctttgataaagttcagaaagttccatggttctttgtatcacatacggattaaacacctcaggaataatcacatcagcgattttggtagtcataattcatcatcctccctttcgttactttactcccgcttcagccatgagtttttgagccaaagcaggattttctttgagaattttaccttgtaaagtaaggttgaaagtttccttacgccagggattttgtatcccgctatttgttgttgtcgggttagttcctcccccaattggttttgaggctatgccaagcagttttttgagcgcttccgcatcctgccggattgattcttcatcttctccgaagatgcgtccggcaaggtctaacggtaagcccagttcagtcaataccttcactttagttgcctggatttgagcttctttggtctcacgttctttttcctggagtattctttcatactcctggagtttggcctgaagtttctcctgttcggtcatctgggcttccttgagtttttgcagttcttctgccgccttctttagctcggcgtagtctttgaatttttccctttcccgcttgaggcgttcagcgataatccgctctaactcctcttgcgtaaaggttttagtttccgcctgtttgttgttttgattatcctgcccggcgtcagcaggattggaattggttttgtttaaagcatcatcattcataaatgctacctcctttaacttattccgtgcttaaccggcgcacgttgccgtaatataaaaaccacctaaataagttatgagctaaagcgcagttaaaattttttctttaatggtttcactgcggaataccttcccatcatcaaaagttaggcttaactccataaacataaccccatctgttttcagatcatctgcctccatatcgtagtaaacctaattatttaccttatcaacgacgcactccctcgtccatttctgcccccgcaactcaaaagtaatggtggcgctttcaagatattgcagcgatattgtattcccatcattgcccttgaagcgaaatatcaaccgcgttcctttttcgccgaccttcatcttacgccaccacctccttttgagttatatccagtcgcagttcgtagaccttctggtcatccagtcgcagttcataaactttataagtcaatggccttatcctgccgtcgtctacccgtgccggttttatcagcgtcagcgtcacggtagaaactaccgccattatcttcgcttctccactcgggatagcttcattggcttctgcggtaatattgcttgcctgtacttctatccttaccccggccattactcttggtgcggttgctatcgtcgtggttgccgctgttggtgcgattatcacagcttccttctggccggttactgctggtgcatttgcatttgccgtcgtcgttgccgctggtgccggaattgttgcctttactgccacattcgggcttattgcttctgctgtcgcttctgttattgaagcgcttactaccgcttacccagcgcccagtattgccggtgccggtgcttgcgctgtcgcggttgcgcttgtggcctgtgtcttggcttcgttgcttaccgctggtgctgttgcgcttatatctaccgttgctgctggtactgccaccgttacaggcactaccacaaccggacttatcgcgtctccgtttactccggtgtttaccgccgttattaccgcatccactttcaccgctgggctaattgcggttatctgtgtatctgcgattgctccggttatggcagcgttctgctgggccgttattgccggtgctaatgctgcatttgttgccgcggccacaactgcattgacggttaccggagtagcggaagcaccacttaaaacaattccctctacccggctattataacttccgccaaaacgaaatcgtgcgtaaacctcatattcgtctacaacttccttttctgtatagcgataaaatgtccacgttgacgcttcaaggttggttttgtttagctgttcggtgataaatctactactactatttaagctaagtttaactgtttcggttataacgattgcgtctgttgtggcgagtgttcgggctggacagttccaagtggcaacctgaaccccacttcctgcaaattgcctactgaccgtcgcaacgtttgaaccgattagggtttccactccgttgctcgcacgaacataaaccatactactccagattccgggataatctatgtcaacaacttcaacatattctgatgccgtgctgtttgtggttttaaacgcctttgctgttaacccgttaaccgtcaggttatcgttcgtataataccttatttcagccatttatatcaccgccttatccggtgatgcctaagtgttctttcgtcaccccgtaagtgttgtaaagccattgccaatcttcctcggtgctaatttcctttaagacctttgtttcgtctatctctccgctgtaaattactgctattaccagcacaggaaccgggctgtcggctaattcctccggtgttgggaaaaaggtaattgtgccgtctgccgccgggtatccgtgcttgcaggtcatgcttacgcttatatttatttcttgctctatcatcccggtgttcgggtcttgaataaggtttatctcccacgggacgcatcttgggacaaaaccatatcgtgcggaagggactgcttttacttggctaattactacccgcataatttagcccccttatgccgctgtaatggtaaatattccgcctgcgtcccattgaatggtaaagtttccgttactgctggctacatccgccccaaagtcaatatatcccagtagtaaactggtcgccgcgttgccagtgtctttgtatattaccgcataccgggccgttatcgtgctgtttgcccaagtaacgtcgtcggcgtctaaaatcgttttgttgtttgcggcgtcataggtgattgtcttgttcgctaatgttgcgccgccagctgtataacccgtccctgcaacttctccagttacactacttttaaactggtgagtgtcttggtcgggcgtgtaggcgctggtgcaaagcattaccttaatcgtgtctcctgtccagtttactccgttgccgcttaaaatatttttaagtgcttggccataccatttggctgttaccgccataatatctcctcctttttaatatgcttataacgcaagaagcgcctaagtctcacttagacgcttcttaggaactccatctactcttggtagctgagcttataaaaataccacctcaaccgctttggttgggtggttattaattcacttgtgggtttagttttccttcgacaacttcattaagataccaccaccaatgagttttaggcttatttttttgttccgcctccaaaaaaccctttaacaccttataaaataatggtgccctttcaacgagaatcttatcatattctttaactttttccttttcgtcatccgaaaaagtactcattcgttcttcgataatatccctgccgttgagttcatatatatgttcaaatgggcttaaatcccattctccttttacaaatagctcataatctttaattaacttatcattgtccattggctctcaactcctttatggtacccatatatttcataccctcttttttaatgtattcctcataactcattttatcaattttaaatgcagtatcgattatgccatcttgcccaattatcgcaatccattctttatccccaaaaacataatatttttgtttaaaaccctttttataatataaatatacttcattattaggattagagcataattcacgtattttatggttatactcctctaacccccaactttcaggaatttgcccaagcctttttcttttcctaagatgttcaatatctttgtttttcttccaacttgggccattattgataatgttttctgttataattataacattgtatttatcttcattcaattgataatgcttaattatttggccatcaaccccaacaggttttttccccgtgtattcataagttttatttagtaatttatacgcttccattttatcttgtaaagaataatttttacttaataatacttcccttgcccttctcctgttagtcgctattgtcaccgcatcccgcatttctttgtatgcttgcttttcttcttcgcttcttgggtctttcgtgagtgaggtattactatatttctccactttttccgcgtcagggtcaagttctcttatataaggttgcagggtatgccggcagtttggatgaattggcggcctgtattcgtccgtcaactttggatagcgcttatcttggccggagatgctaaataccttaccctggagcggagcacatttctcacaggtaggataatgcgtcgttatcttcaccaaatcaagtcccgcttctcggcaggtgtttatcgtggccgcgcttgccgcttccctggtagtcgttctggccaccatttctgcgtagctatctaaccgccattttctccccagcttatccacaaaagctgtttgtccctggtcaagtagccgctgaatcaccctctgtttcatatcctttatcgtggtaccgctggccattttgcgtccggtttcttctaatgccacctgccggaatacatcgttaactcttcgcccaataaactggaacgattcgtgcatactcgataccatgttctgggctatcacgtctattgccctttgatgaacttgggcaaagctggggttttcttttactgccattcccaagctgttaaggtaagcccatgtttcggccgaggcctgcgaatacacttgccctattacctgctgtacccattttcgcgtttcttcatcaagctggtttaggatgtcgtaaacttccttgagcatatccttccagtagcttattgcctgccctttggcttctttggtgattatgatttgcaggatttcctcaaagccccggcggtaaagttcaataagttgttggattaatttttcatccaatggcattattcttcaccgccagcattagacggcgttatttgctctggttgttgtatcgtcggcttaaataccaacggtacctgtgcatttgcctcagcagttatccgcataagttcttctctcaaagtatccgcttcaaactggaataatcgccgtattgctgtttctcggctttccagcccattttgtaccagtatggaatgaatttccgcttgttctttgtcgtcctgcggtaggccgtcgttccaggttatctcgatattttccagcttcacagctcccggcttgccctgggctacttcaagctcactcgcaagccggagaactttcttgagcgccgggtcaaaccgcattctaattctatttacttttgccagcggggccatcataaggcgacggagtgcacttccactttcggctaacccagctttaagctgcccaaacgccgcaggtgaagtttcgcttagaatgtaaagttgttccatcaaaatctcaatatgcttaaatgcagcttcaagctggccatcccaggtgacgtaacccggtggcttttcgtccggtcctacgggaaagtacttgccaccacctcggaatgaccattcgccagttttaggatcttgctccagcgccgtatccggaccatacatgtttggatccgcgtgcttgtcaaggattctgcttatttgcgctactcttatctccagttcttgaattatgctgtccaaatccgagtaatcgtcaataccgtggacacggtcagaagtgacaatgttgtttaccggcactattaggaagtcatccactccagttaaaacttcttcctcctccaatagcccggcaattctgccatctttaagcgcatatcttcgagtagtgattttccctttctcgtgaatttcggcaatcaaatactgctgttttttctcgcccagcaaagtcgaagcggtttcttcaaccacataagccaggacatgggccacaatctctttcacattttccggcttcactaccggaaaccataccgccggttgctgggcctcaatgattccccgcttgtcgtagcgcaccttaaagaggcccgtcccaaagcggcttgtatctaaaaccacttcatagcccacattataaagctggttttctttgattaaccgctccaaattttgctgctccgggctattcctgtcgcccgccgatattctcggaggttcgcccagaagcaggtctgcccaaagtgtgctcagtcgcttaggccagtttaggattatctccagcgttgccgcttggtcattccggagcagtttaatccactgcgaataaacctggtcgtgcttgccctcgaacagtttccggttgttgtcgtaaagttgaagcctttccagttctgtcggcggcggccatttatggcctaccgcaagaaaatctaagcttgtcagcaaaatcatcaccaaccttttggtttgtctaccaccgttctatttcgttcaaccatgtcattttctaaagcatatctaacagcatcaatgctgtggttgtttttatcggggaaatcggctttgaagttgccgttgttatctttttctaactcgtaattcaaaaactccctggctgtattcgggcatctttccgggtctatcactatttcctctaaatcctgtaaaaacttaatcccaaattcaacacttccagggcctttctttgcaccgtatactttcagcccataactctttaactcggcaatagatttaggttctgcactgtctgcggttattggtgagtttaatttgttttcctccttgattaactcagccaggcgcctgtttgataaaccaacctgatgtatttcataaaaaataaaaagccgcctccgagtgcggtcataatggcaaactgtataatgaacggggtctactgcataaccccagtcaattccccggcggatgcggtcaaatgcttttatttcatcatcggtaatttttcgaattgtaatgttactaaaaatttccccaccagttccggtaatttcccctaaatactcatgtcggtaagctctctcgttaatccgttttaaatgctctgcttcaattaaaaactgttccccaagccattcacgaggaacagttaaatatgtgctgtgatgaactttcctgtctggtctctcaatcaatatctcttcgtttacccacgcatttactctgttaggtggattataagtgtaaaatacaacaaattgttctccaccccgcatcaatgattgattgatgattcgtatttcctccatgccgttaaactcgtcaacttcttcataccaaatgaacttgatatagccttttgatactttcgtagatctgatttttttaggcttatcagcacctctaaaaagtattttttgccccgttgggatatatgtcatctccattgggttatgtttaatatcccaatagtcgcttactttcaatttctcaattgcccaaatcaattgttcaaagacactatcctttagcgtttctttaacttttctcaaaaccactgcattagcgttagggtctttcatcatcccaagtattatctctatgcttgcaaaagaggatttaccgctgccacgtccaccttttagccaatagtgtgtatacctgttgtgttttatatcgttgtgtatttcataaaagctcggtgctattaattcactgagcttaattttctccatcattgttatcatcctcaatgtcgtcaacaattaccacgcccatattgccgctaacgttgaccttttcggtaaacagtgcatatcttttgcccaataactctgctgcttttactctatcttttgctgatacttgttttttgataatttttgcctcgcttatataatcccccttgttttcagtaacaacaacctcctcggtttctaatccccgcataacccttgtaagaaattccaagacttcatcctgtgaagcaatgcgttcgttgtctttctgcttcatcttttcttcgatgtaaatcctaagttttactaagttttggcttccaataacatctaagttttttcctttatatcctgcccttcttgctgcttctgctgcatttcctgtctcgatatagtagtcaataaaccttttttgcttttctgttaattttgccacatcacctcacccacctcgttatccaacaaaaaagacacctttacggtgccttattttcctttacatcccatgtataattacaatctttgcattgccaaaagcttttgcctaatggtgttataatgcccaacaaaattaatattagaacagcaatccacaacggtgggattaaaaaagccacccaaattaaacatccagcactactaagaaaagctattgacaatgcccatttactcattttttgcacccggtttgacccgcaccttgggcatggggtccagttctccatcattacccctccaattcatttttatgttactttattcgacaatatggagggattttcctgcacttcctatattccctctcacccaccgcccccaccctggcggtttttttatgcttgggtgttgtacccgcctataaaggcactacctttaccaataaaaaaagagcccgaaggctcctgcttaaaattaattatttttttaacttaaaattatggtttttgtatacaagttcttcatcaaaatcaaatccacactcttgtaatattcttatagtacctcgcgggccttctcctacatatcctgctgtgcaatcgccaacaatataaactaaaaagcacccggctttccgagtgcttacactattctacggtagtattttactacatatttttgcgaaaaaagtcccgaactttttaagctattctatcaactttaattaaaccatactgtattgccaacattgcagtataaagcactatttcgttcttccatgtaaagtatgtagtccgttcaatatgcaacttgttacaaatatatctttctgcgtactcatcaaaatatctcatttgcaacaatttccctttttctgtccccttaaagtgttctatgactttttcaataaccttaatccatttttcatatttttcaatttccgcattgcttgccagtttaatcgctttaagcgcagtcggatcggaatggcggcttatacctcctccgccttgctcaataagctgtcgtccgctattaagaacttcatccctgtattcattgatttctctacgaatattaaagtaattaaaaagataccattctatttttttataaatactgcgttccaacaccgccattccggtccctccttacccagcttttttgccataccgtttactgtgccaaatagtctttttaaatccgaattcatctaagtacactgccttaccgcaatcggttttccacaacgccatcagccaacctcctcaagctctatctccgccctttcttcctctggacagtccaccaagtatatcccgattcctcccctccaaaccatagtttgtctaccacagcaagatagtccggggtagcccggccgcccagtctggtctcccattccggacacatctgttttattgagattgaagcaggcccttcctcgtatttccatcgaaatataccatctctccaaaactcccacggtacgacgaagaaccgactcatgttaaatcctactaggataaagctaattccgccgtctctggtccaatcttcaaggaactgcgcctgatggtcttccacacggtcccatctgattcgctctccggcgcaatgttttgcatcaaaagcaagagagcgaccgcggtaggtccctaaaaaatccaccgcggccttttcctctacctttgcggttactattcgcccccggctatccctgagtggtatccatgctgtgggtactttgtggataaccgcccggcgttgtgctcggtactgccggttggccatgatgatcagttcttcaagcggtcggccccggttggcctgctgccttatcatcctgccgcctccatatcctttttgaataccgctgaattctgtggcgtatagcatctttgctcataccgtagatttcagcaatttgtttatatgttagtcgatgttcattcttcaactttaccatatccaagacatcctcttcggtaatgtcttttcgtttccgccatccaataggcttccctttgtccaagtattcaaaagctaattcagggcttgcattagccagaatactcacagccagggccagataattctccatcagtggatcggttcccatgtggtaagcacctcttggccttctgtcagctttaatgcaatcaaagcatttgtcaattaaccccgctttggccatatttactcccccattaatctgtaattagcttcatggtcctggacaaccaccatgtggcccttgccccgctcgacaatccgcgaccctattgtgccgttgtcaatctttagcaattgttgaggggtccgattactgctgattatagtgggcttaaggttcaaataccggtaattaagcacttcaaaggtaatttccagctcaaattctcttggttgttcttttccccaaaagaggtcgtcccagatgagaagctcgaccttcttcatttgttccaacttagctgctataccctcttctccttgttttctaagcaaatcttttagctctccaagaccctctacatgctggaagtacaacgttggaattccccgggccaataaccaatttgcaaccgccatgctgaggtgagtcttgccggctcccggttctccaagaaataccaaccagttattttcttgcttttgaatttctgtaaagcgctgggcataatctcttgcacattcaaacattgctttgataatgggcggccgattgtccgtcacaaagttttcaaaggtctttgcacggaaggccggggtaatctggctacttttaaaaagcctttccaagcgtttttgttcctgacaatggcatatccgggctgtgttgttgtcaattatgatgattccccggtccttacagtctggacaatactcatgatcctttccaaaggaatttgtcaaggttgatggcctctctcgcatcaggaggttggcggccttgtccatttaacttcactcccttttcttcaagttttcctttaagttcacgctctttaagtaaacggcgcattatgcctgccgtataatcttcctgtttgctctggtatttacgcaagtgaatatccagagcttccattacaatctcaacaggaaagcgttcccaatagtccatctctttggcaacgacagtcggtgcaatctttgcagtttttctggtaaatctaatggtctcccagtaattgcgaataatagctaactgctcatcggtatatcgttggtaacggctcaggatatcctcgatgttttgtggctcgtttttctttttggggggaagtggtaatatacacaccccagtattttctttaatattttctttcggttccctgtaaccgttggggctcaaggcttccgtggcacgctcggttactgttttggtaacctgctggttactgttttggtaaccaccattttcagggcaggttactgttttggtaacttcggttaccatttcagtaactttttcatcccttgaagttaccattttggtaacctgattgacctgatggttaccattttggtaactatcttctccttcctcagttactaaaacggtaactttttctctatcctcaatgtttcttcggagaacttcatcgaagcgttttttgtcagcgccctttactaagctaattctccattggtcgtagtccttatttattgaaattctatttccatctattatcaggactttggcttttactaaataatctagttcctttcgtacgtgagttttgtaaaccccgacgagttcgaaatctacaggtcgtagaatagcgcttttcttgccgcatccatagctcatacgaattacaaggtcaataatattcctttgtctcttggtaaaatcggcctgcattatggctgtataaagttcgtttgagattcttgtaaattcatcaggttgtgggtttgccacttgtcagccctccagcccataattattttaggcacttggatactcattccaaatctttccgtctaactcgggcatcttcactatcctaccgctgatctccatctgctttaaaaagaatggtacaccggcggctacgcattggtctcgtaaactacgaatccactgaatgtttgcaggtcgtcgtttgggaccggtttcgccgccgacaatgacccaattaagagaccaattaagatagaaatcgtgagtacattccggacaacatttttgacctttacgccataaaacaggtccgcatttggttgctggcattccgcaaccttcgcatattcctaaccattttgataaatccactggatctaataaaggttcacaactaacaaaccgtacagttgctggtatctgaagtaatattggaattcgtttattggccattttttggttttcaactgtaacacctagccataaatttttaattgtgccatgaatacatctcttaaaaaagtcctgcatccgttctggtcgcttggtaagaatcataaagatgtgttgtgggttttgtttcactgtaagtaaaacccggaaaataaattcatctggaacatcggggtggaataggtctgacatgctacacacaaaaacccgcagtggtttacgccaccgatacggttctaataggcgatcctcatgcaacgtaaccataaacggctcatcctgcggatacccgcacctaccacgcagcctatatgccatccttttggcatagcagttctggcatccttctgataccggtgtgcaacctgtaattggattccatactgcatcggcccattctatattagtccgcctcattaattctcatctcctttagttttggcgggcaggctgagtgggggaaagatgggatagatggggaaaagcccgcccgccgtgatattatttatgctcctggtaaatccggatcagactcatattccggtacttcttcaatttctaattcattgttttgtaatttatcaataagctcactggcttggactctcgtcagttcctttgtactgtcgacaccgtacttcgttagaatgattgcttttatttcgtcttcagagataccttgttttttggcaagcacaaagatcattttgcgctgtttttcagtagccttatcgttaccattttcagacgggataatttctggttctgcgattctattttgttcaggtatataactttgccccatttcttcatgcgcataaataccagacaaatcttggggaaaagcctttcttatagccaatgcttcagcacattttgctagcatcaaatcaggcattttagcccaattttcaaaaagttttccatcactttttctttgagcataagcatcaaaccttgctacagcccagattggttctttaaaatcagatcgcaaaattccaaccttagctgcaacaggaggatctggtgataaccatacatcgcgccattgtccatctttaccacaccaatatggccctaactgacctgcgtattttccagacctttccgcaataactctgaagccatctatcccagtttgaatagttccgacttcaacaatgcttccatcaggctgccgttgttttctttttacaaagtgaatttgtcttgttagcggatctaatccagtacgctttgcttgatatagaaaaagtgctaattcgtcatccgtagcacctcgtgccacagttcgtttaattagttctatttgatctcttgtaaaagtcatattaggtaacccttgtttttctgacaaagcaactacttttgtgttctcatccatatgctatccctccgttacttttccttttttttagtaaccttaaagccttcaataactcgctcccgaatatacggagttaagtcaagtattttagctaactcttctttatccaagtcccttcttacttgcttatatatcgagcaaatataccctgatatttctgctttctctaaaccgtttttcctcatccagtttttcagccgttcttcatgctgtttcttttcagcttccagctcctgaatcatccgccgaagcctatcaatttcagctggcaattcatttatctccagctctctcacgagctccaccgccacctaaaccgcctcctcattatgttgtaattttccggtcaacttgttgcgtccatcataatgttttggtaaattaagcattttctcaactttcgccaaacaatcaaaacatatatctaaatctacttcacgccaaaaacgcgcgtcaggtggaaaacttgaaatcttaagtgcataaatattgttttctgtagtttcacgattgcaaacatcgcatgtataaaaaactttccgcatttaaaccgcctccttgataatctcaatctctaaatccgatgcttttaaaaagctttttacaatttccagcacattcgcaatgtatcgttttgcatgatattcattctgaaaagctcttcttgcgaaaactatttcctcgccagcagttgttataaagtaaactgatgcaataaagttttcgtggtattcatcaatatccgaggatattttcgcaacattgtccatattgaacatttctccattatggcctatccacatgcttaagcgctcctttccaaattttgataaattactttaagcctttcccaagctttgttgcatctttttaagcctttaagccattgtctgaattctcgatttttccctacaaacttggccatcattttcattcattgacacctcacattgtcagtgataaaatgaatttgggatgttttagtatgcggctttgaaagccgttttttcttttttaaagaactctccttggcggataaaagcgtctaatgttttcatcatctttaaatgcctgagattcaagccattgaagaaacaatcttttcggtattcttatttgccggccgattttaacttttggaaacgatacctggttcactatctcgtaagctttgttggtgccaatcttcaatactttcttgaggtcctccaccgtcagcacttctggaatatcctcataattcatcttctcaccctccctcattaacctgagaaaaccacagttaatgctgcccctgccatctcgttgatttcttttgtaatgcgctgccatcttggcttttcatcttcatcaatttctccatcacaaattatttcaattatttccggattaattttctctacatcgtttagttctttttgcagcttaagtacagccctggaaatgtcatttaaactaatatccggcaaatatctcctgccaattttagttgagtttttcaaatgcatataagctaagtactttgcatcgtaaatttcaatcattctttctactacatcgtccggaggaattgttttaccgctttcataatcggctaaacttctaacgctaacgtatagcatttctgctgcctcttcttgtgtcagccctgcattttttcttgcaattttataaatattgctgcaatctcctttcattgcctcacctcccttcgtggaagataattaagttaagaaatcgtcattatcgctttccctcccggccctaccccgattccccgcaagcggtggggctaaattaagccacaatgcaaactttggttttgtcccgataaccttgtaccatacgaaacttatcgttatcatcccaaccagttgctcttagaaaaaatccggcatattctctccgaacaatctcccttacctcccaaaccatcccatcaggatccatcaccttatcgccttttttaagctcccagatgtcgatgtactttttccccactctccctcacctccttaccccgctttggtctggtgtttttcttggcgttctgcaaagttagagggtaaaaaaaggtcattaggagtaactttcaaaattgcagctatatcaagagcagttttcaaagacatccttcgcgtaccattttctatttgacagtaataactttcagatatacctaattttttggccatctccatctgggtaagcccattggctttgcgtaattgtttcagcttattcattgtctccctccttccttgcattttgcaaatctttgattttattctaaacctatctttgcatattgtcaagttttatttttgaatttgcaaagaaaatttttttatcttatcactttgctatttgcaatgttataattttggtaaatagaggtgattctggtgaacttcgggcaaagacttcgacaattgcgtacagaaagagatttaactcaggcagaattggcaaaattgctttcaattggggaatccacaatatctttttatgaatcaaataaacggcagccagatttcgataccctcattaaactctcaaatttttttaatgtttcaatagattttcttcttggtcgcactgatgaaagtaataaatttattcaaaacaccaaaactatccctttacttgggacaatccgtgcaggcattcctttattagctgaagaaaattggattgaggagattgcattaccagcaggtataaaagcggattttgccttacaagttgaaggagaatcaatgatttatgctgggatcttccctggagatattgcatttttcaaacaaagcgaaacagcaactaatggacaaattgttgctgctggagttgtagaagaaacttggaaagcgaatcttaaattttatgtgaaaacaaatggaaaagctttccttaggtcagcaaacccaaaatacaaagatattgagattacaccacaacacaaaataattgggattatgactgggcttgttcgccataatcccccttcaatgacagattatatttcactagtaattactaaagacgaatttgaaaattcttggattgaaacaattgaaacagctttatctcttggaatgtcacctattcatgtaaaacaattaattgagatacaagctactctttcaaaaatgatcaaacccaatgagtaaattttaaaggaggtttttttattatgagttttaaaatggatcaaccggaaaagtttccttggtttagaaaaattcccggttttagaagtggtaaacctttaaatatgataatagcctcaatcttttatcttacatacctggttatggcgattagcataattcgtgaatcatctaataatttttgggaaactgttgcaattttttcattagtctttttgttaccaataagtttaattgcctcaatatttttagcttttaagcgtgatcctctttggaaaaagtggttagctggagcaggaattgcttttttagttttttttgttagcgtaataaattccccaacttcgcaagcaccgaataataatgcctctaagcctacttcaaaacaagaagttgtagctacctcccagcaaaatcaatccactactgattcaataagctctgaaaaaacacctaccatagcccctcaaagccaaaattcacaaacaaatgaaaatactcaacagtcctcccaagatcagcaagcccctatccctttaattgccgctaaagttacaaaagtagttgatggtgatactatttatgttcgacttcccaatggttctgaagaaaaggttaggtttatcggagttgacactcctgaaagcacaattcaacatgagccatatggcaatgaagcttcaaattatacaaagtctaagttggccggtaaaactgtttaccttgaaaaagacgttagcgaaagagacaaatatggaagattgctccgttacatttggttagcaaagcccaaagaaataagtgaaagcgaaattaggtcaaaaatgtttaatgccattctcttgctcggaggttatgcccaagttgccacttatcctccggatgtaaaatatgtagattactttgtcaagtttcaacaagaagcaagagaagccgaaaaaggactttggggaatttcaccaactcaagaagaagatattagcttagctattcagtatgtcggaaataaaaatagtaggaaattccattacgaggactgccgctgggctaaaaaaattgcaccttctaatagggtttactttaaatcgagagaagcagctataaatgccggatatgttccttgtaaagtatgtaatccatagccttaaggcaaaatccttgggggtatttagatgagttctatagaaaaaattaaacaatcattaaaagaacaaaaaagtttattaattggattatgtttttttattttggtatacgttataggcttaacgcacccccaaacaattcaagaaaaagaagacaatgccgttaataagacaactacaacccaaaaacaagaacagcaatctacctccgaatttgttcctgctatagttgtcagaattcatgacggtgaaacaattacagtacagctacctgatggagctaaggagaaagttagactaattggtattgatgctcccgttgaagatactcttataaatttaagcagtaaagatccagcaaagttaactttagctgatttatggggtaaaactgtttatcttgaaaaagatgctgttaatagagatagcaatggttacttgctccgttatgtttggttagaaataccggatattaaaccaaatgtaataagtgattccgaagtacagaaaaaaatggttaatgccattctcttattaaatgggtatggcaaatatattagcacttcgccaaataaaaaatatgaaagtgaattagcgcgaagcgaatttgaagcttttgctcataagaaaggaatatggtcaataagtacagcaccacatgccccacccgattcaaataaaagcgttaaaaaacaaaatattatagtttatgtgacattaacaggtcataaataccatcgtagctggtgccgatatttgaaatacagtaaaatcccaattagtcttggtgatgccattaatgaaggatatgagccttgtagtgtgtgtaatccaccccaataaactatcttgttggcttgtttaaagaaaaaagtagataaattgcaggaataaatatgctaattaggaggtaacaatgcccacgttaagcttaatggaatatattgaaagtgttgtagggggattaggtggcttttttcttggaatgttttttctaacacttattatgtatttaacttttccaaaagcaaattatggaattgatattattactgttctaattgtagaagcaatagctacagtatttttcttcactgtaaagtattttataagtagctttatagatagcatttataaaaaatctggaataaaagatgttgataaaatgagtggcgaacagtttgaacactggctggaactattatttaaagactatggctacaaagtcaaacgaacccgcaaaaccgctgattacggagcagacctaattattgaaaaggacaatataaaaattgcggtccaagctaaaagacataaaaacaaagtaggaataaaagccgttcaggaggctatttcagcagtaaaattttatggttgccaaaaagctgcagtttgcaccaataactacttcactgaaaatgcggtaaatcttgcaaaggctaataatgttgagctaatagatagggataagttagtaaagctttctatggatagaagaaataattaataattatgtcttattagtagacgtggagcattttaatcaacttactttttacttcaaataaaaaccaaaagaatataaaagaaggagcgataagctacgatttacaaaatttattgcgacgaaagtagacaaactaattctgaatatatattagttggtggaatatggatattaaaagaaaaaggatggaattttgtaaacgatttcgaaaagttttgccaaaatgttttaggcttaaaaaatcctatggggcacatgaaatggactaaagtccccccatcagcaaatagtaagtacttcaaagcatacgaaaaattagttgacttatatttcgaatataattcaaaaaatataatgttttttagaaccttaatagttaataaaaacgattatgattttactcatgaaaaattttataaaggtgattacgaggaaggtttttataacctctattgccaactaatattaaactggcttcaaaaatcaaacgaatatcacatccgaatagctcatcgacctataaaaaaagcttctagagatgattgtgaagagtttagacttaattggttaaaagaaaaacttaataataagtttgaaagtacaataaataaatattcatggtttttcggttatcaaaaagtaaagcctccagtaataactatagaaagtagagaagcaagagaaaggagacttatacaaatagccgatatattaatgggagcagttggcttctattggaataaagaacatttgaaaagtaacgtcagaaatggtaaactcacactcgcaaaatacattgcatcaaaattaggaagaaatgatttattgtttactactaaatggaatgataaaagatttaacatctttctttttgatacatcaaaaaccaagttaaaaaaataaattaggcgtccctgggctaactgtgtcataattcacagttatatctccgcaggtgacgccattattctcaatttattttggaggctatggggaccatcctacgcagggacagccctgtttcagatggcctattaatattatacgccattatccaaaaaaaatccttcttttttgaaaaatttttatgttaaattttttgttagtggggaattttttattttcttttctttcgaacatttgttttggaggtgttactttgcgcggacacataagaaaaagaggcaattactattcggtcgttctctacttaggtaaggatgaaaacggcaagaaaaaatacaaatggattggaggattcaaaaccaaaaaagaggccgagaaagttttggcggaaatgataaacaaggtagagaccaacaattttatattccctgaaaagattaccttgaaggagtttttgaattactggttagagaactatgtccgtcccaacctctcacctactactgcttatggctacgaggccattattaatttacacattattccttttttcaaaaacatcgagcttcaaaaagtacggccaattgatattcagcagtactacaattcaaaaagggatgagttatcagggaaaacgctattgcagcaccaccggatactacataaagcgtttgactttgctatgaaattgcaattaatccctaataacccaatcgactttgtcgatagcccgaaagctaagaagtataaagcaaaaatccttgatttgaaagaaattaaaaccttgctaaacgctttaaaagatactgacttagaagttccaataaacttagcactttcattaggtctaagacgcggcgaattgcttgctttaaagtgggaagatgttaattgggaagaaggtacgatccaaattagaagaaacttggtccgggcaggcacgaaactaattttaaaagaacctaagagcgaaaccagtatcaggaccttgaaactttctaaaacacttctaaccatgttaaaaaatcaccgcaaaaaacaaatagaacttaaactaatgcttggcaatgaatacaaagacactggatttatttgttgtaaaaacaatggtgaaatgataaacccaagcacttttagccatcaattctctgatttcctaaaaaagcacgggcttccagacattcgtctgcatgatctgcgacatacaaacgccacactaatgctcaaaagtaatattcctgccaaaattgcaagctccaggcttggccactcaacagtagccatcactcttgacttatattcgcacgttttaaccgacatggatgaagaagtcgcaaataaaattgatgacatcatttaccaaaaataaccctgcaaatccagtgcaaatccaagagataaaattagataaaaaatgcagtgaaaagataaaaagttaaaatagtcgtagtgcttgatattcctgagttatagggattttttaaaatttgttaaaaccatttaaaaagcaaaaaataaaactcaaaatccggtggggtaacacccgtgcgggttcgactcccgctctcggcaccatttccaaaaaatatattaaacagccaaaaaatccgaggtggcatctacctcggatttttagttttttacttggccaaggcaagggccagttcttttttaatcaccttgatttccatttcatgggttcctgtaatctccgccaaagcgaagatatttttttggttttgctttacttcctgagcaatatcgcgaactaccgattcaataacatccattcttttgtttagttcttctcttaattccgcaatttgtctttcggtttgctcgcgatgagcttgttgaatttcagcaagcaattgaagctttctatttacttcctcaattaaagtagcatttttagaaatatcttgtttcattccctgcatttcttgccttatgtcttgtatctcttgtttcattccctgcatctcttgccgtacatcttgtatttcttgcttcattccctgcatctcttgctgtaaatcttttatttcttgcttcattccctgcatctcttgccttaatccctgaacatcatttgctatttgctgtaaaacaaccataatttggtcatccataattaaatcacctcttacctttgattatacaaccataaaaacattttttctataaattttcctgtttagaattggaaatttttaaagcttcaacttccttttttaaagctttaacttcccgaaccattttaaaataaaccccaaagccaagtaaaattgccgtaacaactccggcaagagctgaaaggaaaatcactaaaaccagcggtatttccggcaaactccaggccagaaaattgatcgcaaccgctgtctggttttgaaaagcaaaaaccgtaatcaagattgcgaaaattaaagctaaaataaaataagcctgtcctttagacataaaaggcacctcactcaaaaagttttataatctcggccatttcatagttaccgtaaacaccgggcttttttagcaaataggccgcaatttcttccttggttaaattatatgtttcttttatgccatagccaatggtttttaaatattttttcgatggacgagaagccaaatatttggcagaagaagtaaaagtaaacatcggataaccttcttcctcccccaaatatatcactaaatcataccagctagtgacaatattttgtgatacttttcttcggcagcagtctttaggttaataccatccaaatttttattcccagaactttgaccattttcttgagctaaaacatctataaactgattaactgtgattaaataacctcgttctaatgcaggactaactgttaggtgccaatctttttaactcgttttctgccggaataagcttagtctcatattcttcaattttaaaatttaacctttccagcgctctctccatttctttaatgcgggaaagaagtttctcccgttgctcgataaggatttgttttctggcctctatagttttgtcgccttgctggagcagcgtaacatattctaccagcgtttcaacttgaacacctgcgctgcgcatacatttaacgaattcaatccacttacagtcttcctctgtataatcccggataccgctctcgttgcgatttaccctgggaatcagtccaatacgctcatagtagcggagtgtatccggtgaaaggccaaattttttgcttacttctgcaatcgtcatgtggcttcacctccaatgttcaatattatctaatactttgagttagctccaagtcaagggttttaaaatagtagcactaattgtgctactatttaaacaaacctctaagaagtaaaaccgagtctcttaagccagtctgcaatatctttatctgctttgctaacattacttcctcgaatggctaaaccgggcagtacttttgcattcggacaaagtttcttgatgtcgcgctcactgcttcccattccgctgccttcatgtgtgcaaaatggaacaatggtctttcccgcgaaatcataagactctaaaaatgtaaacacagccatcggcattgttccccaccaattgggatagccgaggaaaatcacatcgtaagaatttatgtcgtctagcttatttgcaagttctggcctggcattctgccttttttcttcctttgctacttctgttgtttctgtataatcttccggatatgcctttaccgttttaatttcgaacatatcaccaccggttagttcctgtattttttttgctattacctctgtgttcccaatcggtagattcataatcctgccacctacataattatttcccctacgagaaaaataagcgataagaatctttgaatacgccaattcctacactcctttcaaaatcactgtttttcatttaccaactatacatcaagtttaagcgtgccaagccgtttcacagtttccggatcattatgcgataagaacaggcgaagcccagtattggcatttcaacaccattgttcaaaactaccttttgcatgttaattcctcctgttgaattaattacattgccatacgcagtatttctacaatatcttcctttcgcagagggggacgacctggaagccttccttcttcatcctgaagcactttcagcgtctcttccgcataacggaaaagcatttcctcggtaatttctccaatacccaactcagacaggcgcgtgggacaacctattgaacgcaaaaactcttcaaacttatcaataccttccatggcaaggctcaaggtgtctttgcctgttgctgtcaaaccaaagatgcgttgagcaaattgggcaaatcgttcggggcggaatcttgcagcaaagcgcatccaagccgggttcacgactgctaaccctgctccatgggggatatcgtagagtgcggaaagtgtgtgctcgatcatatgaacagggtaagctccgtttgttcctacttgtacccagccattgagagcaactatcgacgcccactgcacctgagtgcgcgcttccaggtcacttccatcactaaccgcctttggcccccactccaagacagtaaggatcactccctcggcaaatctgtcctgaagaggagtcccatctataccgttaaaatatccttcggtcacatgggttattatgtcgcaaatcccataagctgtatgattcttgggtcctgttacagtaagttcagggtcaaccaccgcaacacgaggatagagagcctcggcctgaacgaatgtttttagcttttctccttcatcgtcaattgtgatcaccgcaccgttgttcatttccgagccagttgccgccagggtaggaacagtgataataggaagagctcgctccggaagcctgggcgctttccctgcccgcacaagcatatctttgggatgtccttcataaaggactgaggctgcaattacttttgaggcatccatgacgcttccgccacccatacctataaccatatcacattcttctttttttgccagttctgaagcgcgaaccacagttgacaaacgtgggtttggctcaacaccagagaattccaccactgaaacacccgctgctttcaggctggataccgctcgttcaaatgctccgcttttcttcacacttcctccaccaatgacgagcagtgcttttttaccatatggacttaccacttttcctaactgcgccagcgaacccgcaccaaagatgagccgggttgggttataaaattcaaatttcatcataggtaacatctccctcccaaatattttgtaagattagtttaatgtttggagttaactccaagtcaataccttttgaagtataaatagaagatgataacggatggccgctgagattgcaggtaccatcataaaatcgactccagccactacccgtaatataatatcattgggaaataatctacggggtgattcgattggctaatatttttgaagacttctcaaaagagttttaccagcttctaaaaaattttattaaaaagcaggtttctcaggaatccgacgtggaagacattcttcaggaagtaatgattaagatttataaaaacattgataaattaaacgatagcagtaaactccaaagttggatataccaaatagccaaaaatacaatcatcgactattaccgtaagcaaagtaaatctatctttctccatgacaaccttgtgttttactcgagtcccgttgagtctacatttaataaggaaattgctcagtgcttaaaaaatatgattgatcatcttcccgacccgtatcgccaagcaattttactcaccgaatatcatggctttacccaaaaaaaagttagtgaaaaactgggtctttctgtttccggagtaaaatctagagtacagcgagcacgcaagatgcttaaaaacatgcttgaaaactgctgctacctggaatttgatcgacttggcaatataattgattaccagcataaagacacaaactgcaaatattgttgaaaaaaggacgtaaggcagatgcgtccttttttcttttttaccgtcttaattaataaaaatgtatttttaggaggaggatttactatgggagaagataaaaataccaccgactgctgctgtacaaataaatctacctgctgcggggaaagtagtgaagtttcaaaaaaccatgaaaatcgtgagcgtctagtcatcgactttttgtatctggaccttgatgtttgcgtgcggtgccagggggcagaaaaatcgctggaaagtgcaattgatgatgtaaaacatgttttagaattggcgggcatcgaggtcgttgtaaataaaataaatgtcataaatgaagaattagcaaaaaaatatcactttgtaagctctcccaccatccgcatcaatggccgagatattcaacttgaagttcatgaaaatacttgccagtcctgcggagatttatgtggcgatgaggtgaactgccgggtctatgtttataaaggtcaggagtacaccgtcccgccaaaggaaatgattgtagaagctattttacgagaagcattcggcggaaaagaaaaccaccgggcagaagaaaagcaggagaaatatgttctgcctgaaaacttaagacgtttttacgaaggcttaaaaagcaagccaaaaaactactgctgttaaactcttaagaaaagaaaaaagcctttggaacattcccagaggcttttttctttttttgatcaccctttccgcaatcctaaatttccgctcttttctgagccaatcttaactttgttagttagcaaacaatgtgctacctaaaaacaatcgtcaagttgttaattttgcaaaagtactcatttccttagcgatattcttaccattttcataaaacttaaatattatctatagctttctttaacctccgctaacgttaggaaagaagatgacttcatctttatcagataaaacataatcctcttccaccattttgccgtttacggaaataaagtgaacttcatttacagacaatcctaatctttcttgcaggtctctaaccgtttctcctttctcgatttcaacgtatcgaaacttactaaatgctggatatgtaaaagacagaatacctaacaactttaccttaacctgcatttattgtaaatacctcctcttattcttaaatccctaataatttaatcaataattcgaaaaacaaataaagtcttaacccatcactttttcagaataaacgattaatttatttttctacaagggaagcaataatttttgtatacatgcaggttaaactatgatataagttttagcatgccgattgtatgtattcaatttctccgataacttatagggccacagtaagattatctcttgaaaagagaagcttactgtggccactatatataaatctccaacaactgacttgttgtttgttaatttaacttgacatgattgcaaattccaagcccaattcctttaatttttcaggcgtaggattgccggtagccttatcccaacccatagcttcataatatgcatcaagcatagcgtctaaatttactaccttaagtccctttgctggaccattcggaattgccttggtaaaacgtttaggcaatttgtcatgctcccgggtaaagccttcacgagcattaaaacagcgtttcagattccaagagcgttcagctgctaacattaactcttctgctgttacatcccatccagtaagagcgctaacaatctcagcatacagctgcggtgtaatacagctaccttcagttccccacgagtagaaaatacaagctcctaaaatttcactgatttcaccttgtaatgctacgtagcggtaagcaactcccttttgcggcgattcatcctggatctctttgggtggccagggcatcccgaattctttcatgccgcaatcaagttgcccaaagtcccatgtgcttgcccagttggggtgcatatgacaacctccgcgcggggagacggcatactgcaaagcaagaaccttagattcagaacgtggctcgtgagctggtagttcaagtccctttacatggatagctgcctcctctgcagcaggcccaagttgttcagccatacgttttacaccctgtgccaaaaactcaccaattccttcccggtgggcaattttttcaactaattttaccattacttctccatcgccccaccgcaacggcatcccttccgtatccttttcagttagcaatcccttttcatagcactccattgcaaaaccaatgctcatacctgtacttactgtatccaagccataaacattacacaagtaattagctctaataattgcctctagatcatccaccccacaaattggtccaaacatatctacagtttcatactcggggccctccataggaggtgtagcatattttccactcatcactgaagtataccgtccacaggcaaagctacagccatagcaagcccgtcgtttaatttgatatttccggtttagaacctccccggagatctgatcagcattttcaaaataggtctcttggaaattctttgtcggcaagattcctaagctattatttaatgataccaaaccaaccgtacctaaggtaggtatactacttaagggataattcttcaaccattgctctgctttctcaatagccgcagcaaattctttcggacgggcaactttaatacctccacggccattcaccacaaccgccttcaaatttttactaccaaagaccgcaccgatacctccacgaccggccgctcgtcctctatcattgatcaaagcagcatagagaaccccgttttcacccgcctgacctatggttgctacagagatttccgggtcatcaagttcgcgtatcagggtatcagtagtctcttctacattaaggccccataagtgtttagcagctttaatttctacttttccgtcgtgaatgtaaatgtaaacaggctcttttgccttaccttcaattaccacaaagtcaaacccagcatacttaagctttggaccaaaagctcctcctgaccttgcctggttccaggtaccagtcaatggcgatttataacatacctcgtagcttccaccactgggacaacttgtccccgttacagcaccagttgccaatacaactttagcttctggagccaaaggaccaatgccagcaggcatttcctgatagaggagcttggctgcataaccaacacaccccatatatttgcgtaactcgttcttatccagttcttctaccttaaattcaccactggtcaaattaacccgtaacaatttgcctgcaaatccgtaccacataaacagcacctcctatctgttccgaaccgcatgggccatagcccaaagttcccgacgtttggctgcagctttatttgcaacctcatatcgaatagcattctgtggacaatgagctgcacatgccggtgagcctccacacaaatcacatttagcagccatctttgtttctttatctattctgagcacaccaattggacaaacatttgtacacataccacaacctacacacttttccttatctacaactacagccattgtttttttatcgcgttttagtgctccagttggacagacatttatgcataagccacattgaatacataccacgggcacatctaccgccggctctcgacgcaccacatacacattacttcgcgaaggatttatctctccatatttagttagagaacaccacatctcacaacggtggcatcctgtacataaggaaggatctaccattaacattttagccatatttagtcacctccaaaaactgatctctttactattgtttaattctaccgccatctccctcatcattgcccatttacaacttttctacttatacctatatcctttatgtaacgactttttctccacgacatacaggcaaaaacaaagctctgaggggtatactcatcaataacaataagcttcgtacaattcacaatattgagaatagatcacctttccacaaaccagtcctttttccgtcaactcacctccttaactaagcttaaggaaactaacttcgtttcttcagcaaacacaaacttaaaagttagaattcctgtatttccctcctttcccaaatatgcgaggaataactcaatcataaattttgaaaaacatttcttttcagaattctacttggaaaatatctaacacaggaaatttgatgtttgatattgtcaaacatcgttcttattctcagtttttattcgacaaaaaattcaattttccttcaaaaaaatcaaaaatatttttcaaccttatattcattaagaaaaccgcacctgctgttaagcttttaaaatacacaaaaaagcctttgggcgaaaacccaaaggctttttatttaattaccctttccgccattttaactacaaaaatagcatcatttatggctttttgggcatcctgcagggtatattcttcggttggaataaaatctatatctccataaaaggcaaattcccgctcttttctaagccacttagaaattcgcataatctcgggaatattggaaataacatcagctggcaacttttcctgatgctccgacaggagagggctaacgtcatgttgtttaggcgggtcaattcctatctgcctgagcatccctttaaccgccaactcaacaatctcctgggcttcacgaataacatctgaataggcttcttcttcaagaagtacatttaggattttcaggcgtttttgcgcttttaaaataacctccccataccggtagtcctttttcaatacccagtaccatcctccaccccggtaaattttttcggtccccaatctttggagtttttcctttaaagaacttaaataatttttaaaaaaatcttctttatcatacaaaatttttgcatcgtctatcatgtctaaaaaaagaaggcttccttttaacacttcatctttttgtttaatcacaggagaaagataagtatctattccctcattttttaatttatttaaaaggggctcaatttttctttcaacttctaaaaattcttcaactcgtgctattctaccccgaggaaggtccgaggcaataattagtaaatctatatccgaatcaggcctgaaagtacctctgcctaccgaaccaaaaatcgccagggtaataagcctttcaccataaaaatcttttacttcttttaaaagattatcaagaataatatcaaaatattttttgtacatcaaaccaccccaaaagtattgtggtttcaacttcaaactaccataattttcatttattagcaagtaattaaagctcaatcgcttcctgctcaagcctgatatttagggctaacatcatttcaataaccatcctaaaatcctgataaaccgggtcttccagggctttagtaagtttacgccggtagctttccgaaagcttcatcccccgttccttatattttaaaagagtatccaaatccatccagagcggcttaaagggaatacccgtttccctttttaaatgtaaaaaaatattaaaaccgcccaggtcaatatcgccccagtggtaaaaatcaatattaaatccccgatttaaacaatactcataaattttccttaaaaatttccgctccatcttcccggcaaagccacccaaataaagaactaaatcttcaggataccttcgtacatactggtaataggaagttaaattttctaccgtcaccacccgctgagctgcaaaatcggcaatttccagctgcagggcaagtccggccggaaaagctacatcataattaagccctttaaggttaaagagccgtccatcggggtatttaaggataacgggaccggcaagatgaaggtaaaccgggttattgaccaccccaaactcggcaaaaacggcatccccggatacctcaatatctttaaagtagtatttttgcaaaagggcggcaactttgcgctccacttttaaaaaaagtttactatcgcccagataccgctggctaaaaacccttttgggtatttcttcgttattcagggaaagagcatttaatacggtaaccattatttcagcatcgtcatcaaataacggctctaacaacatgtcttttttcagttccccgagccatgcgggaaaatcgtttaaattagcccaaagcttacggtaatgctcttctttttcttgaggtttttgccgggaaagcttttcataaagaagctctgctttttcaggatttagtttaacatgccttaaaagattatctttttcaaaccgctcccagactaaggtgataaacccctcccgctcccagtctttaagggctgcatgaaacaaagctttaaactccccatcggtaaaatagcggggaaagttattttcggcaattttgataagcggccttttcccctgttcatatttctccaaaagctcctctaacagctttttaaccgctggcgcttccaagccttatcccttccttggagccatcataataaaattcctccacaaaactttggtcaccggcgcgtagtaccaataaattggtttccacatgaggagcaatcagagcaagcttatccgatggcacggctataataggctgcagaccgtaaaatttcataaaccttatgcttgactccaccctgtcggcatccatccggttaaaagcttcatcaaaaagcatcagccttatagtgctgtccccccggtgtatccggtaaagctggacaaaagacgccacaattgccacataaaaaggcgtctgcgtttctccgccggactttaaaccgtagactttggagtaatgagaagtggttccatcaccgtggagaatctcaatatcataggttaagtagttccggtagtcggttaagcggtttaaaaactccccggcctctttatcccggtgtaaaaacccttcaaacatttcgtccattacttctttaaacttttcccggagtaccccgctaaaaaggcttgtctccccgggagttaacttatccacttcatcgataagctccatgtattttttatactccggagcattttcgtacctgaaccggtattcatcctctccaaattttatgccccgcaaagcagcatttaactcccggaatacccctttagcttcttcaatgctttcttttaacttatgcacaaaatgggatttaaactcttcctccgcctgggctttcgcccgctccatccgctctttataatccggaagctcactttcggcaagttttctgtataaatcaagaaaatcggtaatatcatccccggttatgctgccgccaaaagcatacttctggttaaatttacttcttagctccgttaaatccgcccgaagattattaatcctggtctcaagaccttttaaactgcttgagaaattctgggcaatttgtcctgggctttttccttttaattcttcctcaaaacgtttttccccatcacccaccaaatcgggattttgggaacaaaactcatcgtactccctccgggcagattcaagttccatcttaagctgtttttcttcccctgctctaaattcaagttcttttgtaaccattcccacccgtccctgaactttatctttctctgcttccagagctttttcttccagcacaagtttggcaaggctttcttccagagcttcaattccagaagtatcgatactttccctttccagggaaagttttactattttttcttcgatttccgcaagcttcaaaagctccatcaagcggtcctccaacagagcatactcccggtccttttcatcccgtgctccagagagttcctcctggcgttcggtaagcttaaacttctccctgtataacttatcaagttcctgctctaattccctgaggtcctgttctcttttctcgatctgctttttaatagcgcggctgccgatgtagggaatttcgtaaactttaaaatcaatttgccgggcagtatggttttgataaaccatgcaggtcggggttatcgaccgcggataaagttttaactgcccctcgtgttcgcactttattacccggcccattaaaaactgggcatatgccagagcgtagggattctcgctggtaacttcttccgccaatgaatttttctcaatttgtcctaaatactttttcacccggccggtattgacaatccccacccgggaaattcgccgctcctttttataccgctcgtaaatggcaagggcccggtcaaaatcctccggcggcaggatgatatcaaacctctgggtatttaaatatccctccaccgcattctgccagcgttcatccttgacctcaagtaactccgctaagattttcggctccacttcttttttcgcttcttcccgaaacttttcctttaaaagattaattaacgcccctacttccggaggataggtatgcttgttttgctttaatccttcaagaatttcttcgatttcctgttttaaggcctttttagtagaaatctcggcttctatccggtatagctcctgcgccgtttgttcttttaaatttttccgaaagtttataagttccggtaaaagcgcttttacgtcttttagccttaaatttaagaccatttcttttaaaatttctgcctggctaaaaccgtattttttatatattgttgcttcattctgtaaaaaagtctgaactttttcctgtaaggtttttaaccttttttgttccccttggagctctttaatttctttctcaatctccgttaacctccggtatgccgaattttcccagagggctttattgacattatccttttcttcccgtacctctaacaacctttttgtaagaatgtttagcttttcctcaagctttgccttttcaccggcaagctcttccatcctcccaataaggctttgatacctctcctgtaaatcagcaagattaccccgtaacaccaggtagcggtgcaggttccgggtcgttatgtctttttttagctgtttatgtttttctaagattacttctaaatcgtgtaattttctctcggtttcttcggccagaaccaaaaaccggtcatactgctccaggttttctaaaagatttcttaagtcgatttccctgggctctaacaaatattcatagacaaattcccggatgtccttaattgatttaaaggaaatggccttaacaaataaagagaaaaacttttcatggatgtgccccagttttgtccgcagctgatgtttatacgcatctttggccaaaagctctgcattttttaaagaccccattttagcgcgaaactcggtaatattcctgggccgctgatcaacgataaaatagtcatcgttaatagaagcattatttatgataaaaaactgttcttttaacgtatcatcgctgtaggcatcaattactacccctaccaaaaacggctcctttttcttatggtcaaaaaactcaaggcagataacggaagttacgtcaccggttcttagtacccgtttccccagggccccgtcggccccggttttacagcgcacataccccagtaaatccctcttggaatgttcttcccctgccgatgaattaaagcgcactttcctctggtccgccaccagaacatactggatagcatccaatatggttgatttaccggaaccgttatccccggttaaaagagttgccccttttagtttaatggtttcattttgaaaataatgccagtttataagctttatacccctgagctctttaaaattttcaactttcatcggcttctccctccgcatcaccgctcttcaagctctccagatacgcccgcaaatctttatcggtcagaaccaccgccagagttggaagcaagactattctcgtctcgggaaaagtttgtgctccatctggtaggattatcagccggtaacgggaaaacagggaaagacattctctaagagatttcttatccaaaggtttatctttaattcccagttcccgaaatctctcctgaatatcaaacaccgtcaccagtggattttccgcaagagatagctcccgccgcttttcctcataaagggttcgtaaaattaagagtactaaactttccactaaatttaacctaagcttgttaaaatcactgctacctgccgcctggtaaatcctctgggctgcaaaatgcaccagttcccagccggcaagctctaaaaaagctcgcacttctttttcatgctggtagataaaataatagtcttttctatcctcttcaaggtcccggatcacaaaattttgcgcaagcaatttatttaccgcccgggtaaattcttcccgggttttaggcgaataatccttgattaaaagaagctcttccattttttcccttccttacaatcttaatgtttttaaacgcaaaaggtcccttttgcactttctccccagcaaaacgccgcttgtcttctttaataacataagctgcttttttatggcgaaaatacgcatttagataaattaacttgataaaatcctccaggttttctaccagttctaccgcttccacttcatcccgtccccgggctttttccaggaaaaattcgtttataacctcgaccgaataccgctcccttacttcttccagggttttccttaaaagttcttttttcttctccagtggtaattccacaagcttttgttccggccggtgttcgctggccggtcttcttggtttataaaggggatcattgttaaaaaatttaaattcattaagttttacaggtaaagcatgttctaaataatcttttaatgatagctctttttgcattacctgtccggcgatataatctaaaatatctataagcgtcctggttaaatcccggtcagtttccaatagatacttaagctgccggtaagaacttttggcataaagagcgttataccggtcaatctcctccaggtaaagatcaagttcccggtaggcagttctgataaacgatgttttttcgtaaaactcctgccgaataacttcttccggcttttctttatcccgctcctggtaaagttttattatttcatccacatattcgctttcccattcgttaattttgttaataattgccggacggtagcgggaaacatggtcggaagttttcaggcggtggtagttctggtcgataatgttctgggtatattcttcaaagtgaaggattagaagttcttttgccgatgttttacttaccgcttctttgatataacctttaatgttgtctcttagcgtctttaagctatttaaaagattccgggtttcccggtaagcgctatctaaagccaaatctttctgcaattcggcttccggagaacacaatgcactgtaagtagcaaaaacataaccacggtattcttccgtttgccggttggctattttctccagagcttctaacataacccgggcaggctcggtaatcgttacatactgctggtagtcattatcctcttctaaattaaaccagcccacatcaacagaacaaagtcttcgtaaaataaaattggcccgttcccgggcgtttcctatctcctcttcgccctcttcgggaacaaaatcctcccgttcttcaagaacgtcggttattaaagcaataacatcctcccgctgaagccgaaaaggagtttgctggtaaagtttatagatttgtaaaagtaaatcggcgtaaatctcccgattgggcccggccagtattccaaaaaatctttcccggtactaccgaaaataacttcattctctcttaccccaaatgtatgattttttttatatcataacaaattctcaggaaatttccaaaagaaatgtagttttagttttttaattatataattctccagctttcgacctttacctgcaaaaattaacttttctaaataaaaaccagccgcaccggctggtttttatcgttgtcatttgtccaattttaatttttgtttttgtgcgatttatattgacatttttgtgctattttaagtatactattattagatattgtgctattttatttaaagtgaggtgaaaaaatgataatatctgccaccgaatttaaatccaaaattggtaaataccttaagcttgccgaaaaggaagaaatcattattaccaaaaacggcaaacgtattgccaagctaacaagtgctgtagaagacaaaactgctcttgttaaatctttaataggtattttgcctcataccatatccgaaaaggaagcaagagaggagcgccttgcaaaacatgaacgtcttgattgacactaacgttattttggatgtacttggcaagcgtgaacctttttttcagcactcaacgtcaattttaatgttggccgctaaaaataaaatatcagcttctataactgctaatagcttaaccgatctacattatttattaaaaaagtaccttaaaaacaatgaacaaataaaaaatgctcttaaaagcttaatagaaattttagatattgttgacattacaaaaaacgattgtctaaaagcctttgatttacccatggacgattatgaagatgctcttcttgcgttttgtgcaaaacgggttaaagctgattatatcattaccagaaacataaaagattttctaaattcacccgtaaatccaattaccccggaagattttatctcacgcttttttgccgaagaaaatatttgatgcttacttagttttacattaaatattcctctaacatctccacttcaaccaccggagctttacagctaaagttttcacacacgtaaaccgtagccctttctccaataagagactttttatccgcaatatgcggtattatttcccggatctcttgccccgcatcgcctatcgggtggaaaagcactaccgagtttggcaaatacgccaaatttattttttcgatcatcgcccgggtgtcttctccatccggttctccagctaccactatctcttttacaggtccaaggtaaaataaatacgccagcaggtaaaaggagtgagcagaaggtatctccgaaactttgccggcaaaagtcgataatatttccacggctttttgaagaaagtcttcctcacccagcattcgactaagacgcaaaaggtttaatgccgccaccgaatttcccgaaggcaaagctccatcgtagatttccttgggccgggtgattaactcttcgccatcggccccggtaaaaaataaccccccgtgtttttcatcccagaaaagttttagcatctcccttgtgagctctaccgccaattttaaataccatacttcaaacgaagcctcgtaaagctcaattaatccccagataagaaaagcgtaatcatccagatacgctaaaactgccgcctctccctcccggtagcgggctataagccggccatcggcccttcgaagctttgaaaaaataaactctgctgcattgtgagccatatttaagagttcctggtcctgcagtacccttgcccctttggccagcgctgcaatcattaacccattccaggaagttaaaatcttatcatccttaagcggcaaaacccttttctcccgttcatgataaagtttttgccgcatcctgtctaaactctcggttaattcagctgcactttttccaatttcctgcgccactaattcaatatcagtatgaattaaattaggtatgttcttaccttcaaaattgccttccggggttatatcatacacccggcagaataactccccctcctccgggccaagaactttttttacctcatccggcgtccagacgtaatatttaccttcaaccccttccgaatcggcatcttccgcggaataaaaccctctttctggtgatgtcatttttcttttgacataggtaaaaacctctcgggcaatcctggcatatttttcttttttcgtcgcttgataagcttccaggtaggtatacgctaaaagggcattgtcgtacagcattttttcaaaatgcggcaccagccactcccggtcagtggagtaacggtgaaacccgtatcctacatggtcataaatcccgccccgggccatcgcctctaaagttttttccgccataaaaagagctttttcttcaccggtcctcttccagtaccggagcagaaaaataagattatgaggagtgggaaacttgggcgctggcccaaaaccgccgtattcgctatcaaaccttcccaaaaactcccggtaggctttttctaatacttcttcggttaaatctccttttttactttgcggtatcgtctgcataaattcataaagtcgcttacttattgtaagaagttgctcccggtcagtctcccagagtttcactatttccgttaagatctccataagtcccggacggccccacttagaccttttggggaaataagtcccggcaaaaaacggttttttctccggagtcattattatggtaagaggccagcctccctgtcccgtcatcgcctgacaagcggtcatataaatttggtccacatccggccgctcttcccggtctaccttaatggccacaaagtgcttatttaataaatctgccacctcttcatcctcaaacgactcccgctccatcacatggcaccagtggcaggtagagtaaccaatagaaagaaaaaccggcttatcttccatcagcgcttttttaaaggcgtcaatcccccagggataccagtccaccggattgtacgcatgctgcaaaagatacggcgacttttcgtggattaagcggttgggttgtctcatcttttttcaccaccaggaaagttttaaagttaaaaatcttgagtaaggttaaatcaaattaaacattgctaaaattgacattaataaatttgaacttgcgtgaaacagccacccgggaattatcgaaccacctgctctttgttcatttatccatcctataatccaaccaacacttcctgtgattgtaactattataattattccccataaacccacgaaagaataaaaaataagcccatgtaaaagcccaaataataatgcttgactaaaatttgctatagtaaatccaaattttgcactaaggcgcttattaataaatcctctgaacagtatttcttccgaaaggcctgtttggataaaagaataaattaaagctggaaggaatactgctctaccttttcctgaaaattgtgatattgccaaatttgatgaatcaacaagcttaggtaaaataataattgttggtagagaaaataaaacaatactgctcaaaaacaatgtaaaaaattgttttttatttgttattaatggccttttaaacccaagccagtgtaaaaaattctctttttctcttgccgttattaaccaccatataaacggaactaatgaaaaaactactacttgaagcaacgcattaaataatgatgaggttgtatctataattaatcatctcccctttagtaaaaatttctttgtcgacagcaaaccaaggttttttacattaataaaaccactttgtcggcagcaagaatatttaatgcacaattaaattataattatcttttttcccttgcctgcttttcggcaatttttttataaaattctcctttgatttcccgattttgttttaaaagcttagctggcacctcttcccctctaatattaaaaaatatatcattatgacattttttgttttaatttattccaattctaaaatcttactaatttcctggggtttgatattataaatttttccattaactctaaaacaattttttttgagtacctcaatgctaattccattaagttcaaaactgtcttgtcgtcttcttaatttataccctttctctttcttgagcttttttaattctttatataattctaattcacaataatttcttaagcttaactcatgaatgttttctgcatttgttaataaataataggtcgtataaatatgcgtccgaataccataatcatctacggtttgtataggtggatccaaattttctatatcttccaattcaaacctaatgtataattcttcattagttgatggtaactcttgacactcatttcttttgtaggttcgaaaactctttatacgaccataataatatattcctgcatcctttccaaaactttttgccgactggtaaaaagctatatattctattccaggtcttacattggccaaagtagatactggtatatgataaaatttattttcaagataggcttctaaatgttttttgtcttttacattcccaattagaacatttcgatacttaaacttgataaaactatcgtcaatagcttcatgagataatatccttgatgtcgattcaatatcagattcttctaaaatgctttttatatgttcttttagtaagctataacttccaggtagcaaaggaaaggcaccaatgttaactttttctatgcttttataaaacttatgatttacaaatttttgctcatcactataaggaaacattatataagcaccaaaggttttatatttaaattgcattgtttcaggcatttctgctactatagcatccctatatctatgcatagcattgatatcttcttctaacggccctatttcttcattattaatttcaactcgatattttgcatcaaaaatgtacatcctgtttattttgccttttttgtttaaacaaagtacggtatcaggcttttggtcacttgtaggtaggttagtaaatattttattataaaataactctatttcttcaccattttcgttaacatatttcattacagatgtgtcattttgtagtaaattaaaaactaacccattgtcagtaacttttataattccgtaatctttaacttggtaccccaattcttttattattttatgaatagttaaataacaccaaatctcataaagcttccaaatccttttaggtgtaatattataaatatcttcacttatgctaagtcctttttttaacagaatccaataaaaatatacttctttatagccaggcgccatttgaaaaactaaagtcatacttttatttttatttagctcacttatatttacataaaaggtgcgtaaatggtaagtaatttgcctttccacttcattaagaaaattaagatattcattaacaatattgctttgttttcgctcgatattttgcttagcaatattaccttttatctttttaattcttttaattaagttttgtaagatatatttcacatattggttttcaaatatgtcaaaagtaatgtttttctttaactcaattactttaaacggcaagtatttttttccattgattgcaataaagccatttttgtcttcaaaaagattttctggctttttgcctaaaaatttgcttgttttcgaagatactacttttgctttgtccgcatgttttatcgtttcctggagaacgatattatgttttggatacttttctattctttttagagccctattgaaattattaaaaaccgtctgtaggattttgataaattcaaaattactttgatgttttgtttgacttaccgtagcttgatgaaaagtacttcctaataattcataggctaaggctgccatctcttcgtttatttcctgcaacatagctttgtaatcttgataataatccattttagccgggaaaacttcaatggtaagcatcaataatattttgtctttgcttttaactttaaaaactgtatggccaacttctccagaaaaattaaagcttcccacaataactttgccatactgacaaaacgaattttttatttcatcgctaatatgatatatttcgatgtcaatgtcttcttttttttctaagtacatttgatataaattttcctcaaaaaaagctggcatcataacgttaccattattaattgctaaatttccaaaactatcaacggtctttacaatgcacggccctttccaaaatattgcacatcaaaatatgcttcttgattaaaatttatttttaatcgttccactttttggttttcaatttttccgcttataactaattcaaattcatcagtagtaatagacattattgttttaaatccagtaggaggtgaaaccatcttcaaatctcctcagcatttcaattatttttttcgcactttttttataagttgcttctcccaaaaatttctcggcatcttcaatatatgatggtaaattggcaatttgataattagggttacagaagttatatagttcaatcaatatttcctttattttttgttcacttccaacaattgtcggtaaaatcttttgcattatttggtaatcaaaagccatttcttcatctaaaagttgcaactttttattgtataacatgtaaaataaaatttcgtctcttacccggtatccaaaatgtttattggcttttttcaatatttcatttataagaatgattttatcattgatagtctttacatattccatatcttcatgtaaagcatcttttatagttaggtaatcactcctaaaaaagttattatctagttcttcataaccaatttctatttgctcatcagcattaaccatgaaatgatctaagtcaaaatccacctcggaaaattcaatggtgtttgtcctgtctaatactttcctactaaaagaataagtagtatcatccatattaacggttcctattaaatataagttctgcggtatcgttattccatttaaaatctctaatttatcagtaattatctcattcctctcaaatttcctagattctattaaacttaaataatcacttaagtagtactcaactcttgccagattcatttcatctaaacaaacaaaataaggtttatcgggttcttcttttgctttttcaataatctttgttaagtatccaggtacaaattcatcttttatattcttatacccaatcaattcgctattatcgttccaatcaggtctaactggtattattgaaaaacgaccattttcagtggttgctccaactgcttcagcaaataacctcacaagttttgattttcctgttccacttatccctgctaaaatcacaaaaggctttgttttgagtgacaaataaaagttgcataattcttcatatgagtaattgaaacctttagattgtatatagtttttaattttttggataattttattgggttcttgccctttcatttgaacacttcctttaatatagtcgctcttgcctaaaaagatattatgataatatacttcatatttatcaattaattctttcaaatcatttaaaagaatattttcttcaggcatattgtcccgagaatactctttataaaaaatacttccttcctcataatacacataaccaattttcaacttattatcaattttaaaactaccatttgggatgttccttctaatttcctcccgcgttttaactagctgatcaataacaagtttcttctttctaaattcttcaattaattttgtacaaccttgatttaaggttaaataaaccctttgcatatcttcagaaaataagtaaacaatataaaccccttcctgaatgctatttgttatttttttattataaatagctacccaaggatattttgtccaaactccctgaccagctgagcctttaacttcataaatatcattgtttacgtattttcctaaataatctttaaaatcataagttaacactttataaatccttacatttttactaaatttattttcatttgtttcattcttgtaattatttaggacatcaagtaacaattctcttaacataattcatcaccactatttttttgaattattttatatatgcatatatcctacaacaacagttatgaaacaaatcactcataataaaagaaccaggcgccatcctcatatttatctttataaaactggtatacttttttacccattttaatatagcgttctcgtaaaagattggcaatttcttcggtacttcttattttcatgtattctctgccttccttggttttgcctttttccatagtaggttttatttttacacttcctttagctaccgctttttcttctggtttttcttccgctttttctctatcttttccaggataggcattttggcaaaagacttagcgtttataatacgatttgctaaatcttctatttcggaaagtgaaatgttgttttctttttgcctcgaagatatattgataaagcaaggccgttatcaagtaccggcatgatgcaatctacggtttttaaccaatccgtaatctatttgaataaactcatcttctagccgctctaaaacaacatcgtttattattcgccactccgaaggtaataatagaaaaaatttttaaatttatcgtactactttttttgttcaaggttataaattatatccgccgcaagctttaagattttaccaagaagccctggaacagcatcgtcaatcttttctttgatcttctctttttccccggcttttcttcggcaatattttttataaaactcttctttgattcccgattttgttttaaaagcttagctggcgtcttaacgttccaattacttgatattttttgttttaattttcctacctcttcatggtattaattcaccctaactttttgctatttattatttagaaaactccaagttatataattcttcctcttccttgtttttcctgcatttttctaaaataaaacccccttttcagggggtgtagtcagtcttagatacgacctctatctttaacatgttacagcgtttaccgaataaaattggtatataccttactttctttctccggagcttcgatctcacctttgccttttgctatgagctttaaaagataagccatgttttttccgaggactctcataatttgcactccctcttcatcctgcagagcttccccgggtttggtgccgtggatgacattccagtagttgctgacaggaataaacatctccgcatagtgaagatagtgattgagctgatcaaaggctgctaccccacccgaacgtcgaacagcgactactgccgcacccaccttatgccggaaaagtccgccgttggctgaagctacgtaaaacgcccggtctaaaaacgctttcatagtcgcagttataccagaatagtggacgggggagcctaagataatgccatccgcctctttcattttttgaatccagtcgtttacttcatcgtcaatggcacatctttcgtttttattccttacacacttgccgcaggcaagacagcctcttatcaccttatcccccacctggattatttctccctcaatgccctctttttctaactccgccaaaaccagctttaaggcttgataagtgtttccgtttgctctgggactgccgttaaatgctactaccttcatcttcctctccctcctgaagcttttttcaaattataacattttatccttaagtcgctcaataaaagaaaacatctgccggagcaaggtaatttccttttgctaacaataggagcttaaaaccccctgaagtttccctcagggggttaagttttaacttttaaagaagcttttcaagatatccagtacttccggtacttcttcaaaaaatccgtggccggcagggctaaactttattaaacgggagttcgggatgtgttttcgcaggatgtcggagttttcgtggtgcaatatctgatcttccatcccggtcatgattaaggttggggcggtgattttatttaaatcattgaaactgtcaaagttcaaaatagcatttagctggcggaaaaagccttccctggaagtgggaagtttcatgtaacgctccacaaataaatcaataacgttggggtatttttttatcgtttcctcacaaaagattagttcggcggttttgcgagcccgctcctccagggaagtatcttcccagagaagagcctgggaaggtatcccgtgttttactccgcaaaaagtacagcccagtaccagtttttctacccgttccggatatttaatggcaaaaatctgggcaatcatcccgcccatcgaaatgccaaaaatgtgagctttttctattttcaagacatccagaagttcctttaaatcatcggcattggtttctatagtccagggctcttcagggcagtcgcttctacctgctccccggttgtccggtaaaatgagccggaagtcctcactcatttcaaagacaaaccggtcgctccaccagtccgcattgccccctaaacccatgatgcagagaagcggtgaaccgcttccgtattctttataacacatccgaatgccgttaacctcagcatagggcatctaaatccctccatttcttattcttttatccccgctaaatatttagccagctttttcttttcttcaatattatactggccgtaaattgtaatcttctccattatgggagatcctccaccatggactcccgccacttgttttacgccagcctgggctgaaaccagaaggtcacttataaatctaaagcagcgatgctgattttcagcagatattcccgctttccgcatgaggtacttctccagatagcccttagtttcttcgttgtaaaagtcgccttccggcggcagggttgcgggtagtccaccggccagctccgccagcaattcaaattcacggtagacattaactccggcatgatagcgggcaacgttggcgtaaactacttccggaatatatgttccggatgctgctctcttagctttaactcctgccgcaatcccggcaccatagacaagctcggcaacagcgataagttcagccagggcatcccggacgtgcgaagctttttccacgccgttgtattcggccaccagagctgcggtacccatgatgatatccgttactgccggtttacagccggtataactgtggcggtggtaggtggcaaacagcagggctaactgaccggcatactgccattccccgcacataaagacccgctcccagggaacaaagacacggtcaaaaactgtcagggagtcagcagaaccataattggcatagggtgcatctaatttctggcggggacggggattggaaatcctgataatctgggttatcccctcggcgtccgccggaacagcaaacgccactgcccagtctttgtctttttcggtcatcatccgggttggtagcacaattatttcatcggcatagggagctatggtattgtgagctttagcccccgagacaacaatcccgtcctttcgtttctcaaccacccgcaaatagaggtcagggtcagcctgctggtgaggacgaagagaacggtcgcctttaacgtcggtttgcgcacagttgcccaccagatcgttttcctggtagtatttaaggtaatttaaaaaacgttcgtggtaattggtaccgagagcatcatccatatcttttgttactaccgataaggcgtttaaagcatcgatacccatgcaccgctggacacagccgcccactcgctggcacataaaccgggtcatttcctgctttttcagtaaatcttccggactttgatggatatgggtaaagcggtttatttttttcccggtaaggtgcgaggttgctgttaataactcttcatactgcgggttggcggcataattaaaggtctcacagataacatttattccgggtcttaatcgcgggtcgtcccggcctattaattccccgttatagtaaacgttttttcgcattttaaacagtttttccatatattcctctgctgttcgcatttcctaactcccccctccttatgttcctcgccttctgccaaattggccagcacggctttttctaccagggctaatttttttgttgtttttttaactcttcttcccgtaactgccggcgtaagactttacccacggcagttttgggaagttcggatctgaattccaccaggcgcggcactttgtacctggccaggtgagcgttgcagaattcaattacttcctgctccgttaaggtttctccctcctttacgacaataaacgctttgaccgtttcaccacggtaaggatccggcacacctactacaatcgcttctttaactttggggtgctgataaagtacctcttccacttcccggggataaatgttgtagcctcccgcaataatcatgtctttcttccggtcaacaatgtagaaaaagccgtcttcatccattttggccaggtcgccggtataaagccagccatcctttaaggcattagcggtctcttcgggacggttccagtagcctttcatcacctgcggaccttttacaaccaattcaccaatctgtccgggcggtaattcctctccggtttcgatatctactattttggctatggtatcggaataaggaacacctatcgagccgatttttctggtgcctcttatggggttacaatgagtaaccggagacgcttcggacaatccgtagccttccacgaccacggcaccggtaacttcttcaaatttggtctgcacttccacaggaagcggtgcggaaccacttacacagacatttatcgacctcaagtcgtatttcgtcaggtccgggtggttcagtaaagctacatacattgtgggagcgccggggaaggaagttggacggtagcgctggatgtgctgcagcaggagagttgcatcaaatttgggaattaaaatcatcgttccgccaaagcaggtggccaaattcatgcagcaggtcattccgtagacatggaagagaggcagggcggttaagattctctcctggccgtcaaagaagataccgttagaaaattctctcacctgatagacattggccactaaatttttatgggtcagcattgcccccttggaaatacctgttgttccgccggtatactgtaataccgccacatcgtcgggagttacggtaacttcaggaggattgggttccgagtcggaaattaaatcattaaatttataaactccaggtccaaattcaccgggataggtgccgattagcgggatattgaccactatgagatttttaagagcggtatttccttttaccgcgttagctctcgggtacaaaacatccaataaaataatggtctcggcaccggaatcgtttaactggtactccagttccctttccacatacatgggatttgtctggaccacaatgcccccaagggttaagatggcaaagtagcttatcacaaactccggacagttgggaagcatcaccgccacccggtcaccttttttaatgccaagtttacttaaagcgtttgtaaaccgttttattttttctcccagctccttataggtcatttcctgccccaaaaagacagtggctattaaccccggatatttttccgtggtttcccagaaaagctcatggagagttttttccggatagttaagactcgccctgaccccttcggaataatgttttaaccagggtttagcctgatacaccgaactcataaaacccctccttgaaatggatttaatttttaaaattttctaaacattcatcttaaaaaaattttttctcaatctttcaaaagttcccggccaattaccagtctttgaatctggttggtaccttcataaatttgggtaattttcgcatcccgcatcaatttctccaccggatagtcccgcatgtagccgtaaccgccaaggatctgcaccgcatccaccgtaaccctcatcgctacatcactggcaaaacatttcgccatcgcgccctctttagttgctttcatgccctggtccagcatccagcaggctttccagaccagcgcccgggctgcttcaatctgcatcgccatatcagccagcataaattgaattgcctgaaattcggctatgggacggccaaactgttttcgctctttagcgtatttaagcgcttcatctaaagcccgccgggcaacccctaccgccgttgccccaatcatcgggcgcgtctggtctaaagtttgcatggcaatcttaaaaccgcttcccacctcccccaagacattttccctgggaatcctgacattctccagtatcacctccgctacgtgggacgcccggtcgcccattttcttttctttttttccgccataaatccccggcgtatcccccggaactaaaaaagccgtaatcccctttatccctttactccgatcaacggttgcaaaaaccgtgtaaaggctcgccaccccgccgttggtgataaaacattttgtcccgtttaaaacccattcatccccttccagccgggcggtggttttaattgcggaaacgtcagaaccggcttccggttcggttaagcaaaaagctgctaagttgggtttggcgcaaaacggttttaaaaacttttccttctgctcttcggtcccggcaattaaaagcggagtcagagccagggcgttattcccaaaggttccgtttatcccaagacagccgtaagccatttcttcagcaacaatagcttcggtaataaaatccactccctgcccgccgtactccaccggaacatggagattcataagtccggctttaaatactttttcaatcacctgccagggtatttcttccttttcatcgtattccgcggcaataggaataatttcttttctgacaaaatctctggccatcttttgaatagctttttgctcctccgttaattcaaaactaatcactaccttcccctccctttttatttttcaataacccttcccgaatttggtctaccgcaaaaatcaaaccggtggttttttccccgaaatccagtgttttgcactgaaggtcattcatttacttcaggaatttagcttatcgaataaagttctaaatcaaagccttcttcttttttgtaacggttaaaaatgtagtgccggtaatttacgtattcgtcataattgcaaaagataccggcttccttgaggccttcttcaaggtcttttatggaaggcggacagccttttaaagcaatggcatgttttatattgggattatctttgtttaattcacagacacatttgccaaataaaacggtatagtcaaagcccggtgacgcgagctgccttttaccgcttaccacttccacattggggaagggcttacctttaaaagccgacataaacattataagcatggggttatacattcccgaacagccggtacagagggaactatcgtattttctgatggcaagtccggttataccccttctggcaaaaccaatgggtcctaaatccccctcctgccattcccagtcgtaatcaataaattgccggtgggcgttaagatcttcacctcgaatttccagattttgcagatcaaggcttctcccagttagaccggcaaaatagcgtaaatgctctatttcctctgcccggtaacccatgatttctgcccccgcgatatcagccgctaaaatgtccgtcgaggcaataattaagtttttgcggtaggctttgccggtaggacccggacctttttctaagacaaatacaccgtcaataattgttaaagcaacaggtagccgggtagctaaatgaggaaaggtatgttctaaatcccagtctttaccgtggcagtgagttttggaacggcggctaatggtaccttttagatttttaattcccagggaaactttgcactggttgtgggtttttaagaccggaaggttaatgattttatcggcttttaaagctctattggctaccgaaagcttaatggggccaaaatctatttccgtaaacttttcttcattaaaatctaccagctccacaccgtacttttccgccagcttttcataacccaaaaccttaaaaatttgccttcccatggggcgagggttcataagagaaccctcgccgattgtcagccggctaaatccttcttctttgagaattcgaaccagcgccgccataaccgccgatgttgtcacgaccccaaagggcgggaagggcaggttaaaatcccaggaaaccaagttgggctttattaaaattttgtcatctttttttaaacccgaaaggccatcacagagttcaagggcttttcttagagaatgatacgcatcctcaaactttacaattgaaaccaccggtttagtcaagatttttcaccaccatgcttttttagttcttcctcccgcagtagacggcgtaaaactttacccacggcagttttcggaagttcggatctgaattccaccaagcgcggtactttgtagcgggccaggcgagcgttacagaagtcaattacttcctgctccgttaaggtttcaccatctttaaccacaatataggctttgaccgtttctccccggtaagcatcgggaacacccaccacaaccgcttctttaactttggggtgctggtaaagtacctcttctacttcccggggataaatgttgtaaccgctggcaataatcatgtcttttttccggtcaacaatgtagaaaaagccatcttcatccattctggcaatatcaccggtgtataaccagccgtctttcaggacctgggcagtttcttcgggacgattccagtaacctttcataacctgcggtccttttactaccagctcgccaatttctcccggcggtaaatcttcccccgtttctaaatcaacgattttagcaagggtatcgggataaggtacgccaatcgaaccaatttttcttaagccgccaattggatttaagtgggttaccggtgaagcttcggacaaaccgtagccttccaccactatggccccggtaatttcttcaaattttgtctggacctctaccggcagaggcgcggaaccgctgacgcaaacgtagatggactttaagtcatacctggtaagatccggatagttcagtaaagcgatatacatggtaggagcaccgggaaaagcggtaggacggtaaagatcgatatgctctaaaataaggcctgcctcaaatctgggaactaaaatcatggtaccaccaaagcaagtagctaaattcatgcctgtggtcatgccgtaaacatggaaaagaggtaaggcaattaaaattcgctcctgtccgggaacaaaaaggcgatgggaaaattctcgcacctggtaagcattagctactaaatttttatgggttaacattgctcccttcgaaacgccggtcgttccgcccgtatattgcaaaactgccacatcatcggggcttaccgctacttccggaacatccggctcactatttagcaccaaatcattaaagtaataaacttccgggccaaactcaccgggatatgttccgagttgtggaatattaactacaataatattcttaagcgaagtgtttccttttaccgcccgggctcgcgggtataaaacatctaacaaaataatcgtttcagcaccggagtcgtttaagtaatactcaatttcccgctcgacgtacatgggattaagctgaacgacaaccccgcccagagataagatggcaaaatagctcattacaaactggggagagttgggaagcataattgctacccggtcgccttttttaatcccaatttgacttaaggcccgggttaacctttttactttttcaccaaactctttgtacgtcattttttcgcccaaaaaaatagttgcgataattcccggatatttttcaatcgtttcccacaaaagttccggtaatgttttttccggatagtcgatgtgcggtcttacccctttcacataatgctttagccagggcattgcggtattttcggcagccataaaacccctcctgatgaaataatttttttaattttcgtaatatccgaaaaattttaatctgattggtgcattcatatatctgggtgattctacctccggcattaattcctctatcttcatctatttatcttctgtcataaacaccggaggccgacgttcctttatagcttttaaaccttcccggtggtcatcggtaaactgggcgatagcaaagtgcgaagaaatcagatctaaagcagctcttaaatccatccttaacccctgataaaccgctctttttatcattctaatcgccacttccggcccttttaccagccgttcggcaaatttatacgtctcttccagtaatttatcatcaggataaacccggtttaccagtccaagttgatgtgcctccctggcatcgataaaatctccggtccagagaagttccaaagcttttgcaatacctataagacgtggtaagaagtaagctcctccatcccccggaaccaggcccaacctgatatatccctcggaaaagcgggcagattccgcagcaaaacgcagatcacacatcagtgccatatcaagcccggctcccaccgccgtaccattgatagccgcaatgaccggtttatcgattacttcccataacaaaagcggtattttctgaatatgcttccagataaaatttttactggcaagaggagtgcttttagctgtcttttccagtaattctaaatctccaccggtgcaaaaagctttgccgctcccggttaaaacaataacttttacagcgtcatcctgctggcattcctgtaaaaaattaacccaccggtcaatcatttctaacgtaaaagcattcattttttcaggacggtttaaggtaatagtggcaataccctcttttttttctaataaaatttcctgagcgctcatctttccccccctcgaacaatcttaattacggttagccttacggtagcccagggcatcctgggctaagataagcttatgaatattgctggttccttccactatctggtagtacttggcatcgcgaaaatagcgcgctaccgggtactcttccgaatacccgtaggcactaaaaattcttaaagcataatcggcacatttgctggcggtttcaccggcaaaaagctttgccattgatgtttcccgggtactgggtactcctttatcttttagaaaagccgcccggtaagttaaaagtcgagccgcttcaatctccaccaccatctgggcaatccagtcctgaatcatctgaaactggccaactttttgcccgaactgttcccgggtgttggcatattcaacagcagcatccaggcaggcctgagctaccccaaccgccccagcggctgaagcgagcctggtatcatctaattgctgcatgcaaattttaaaaccctgcccttcctgccctaataagttttctccgggaacccggacattttcaaaagtaatcgcccccaccggtgacgcccagtttcccagtttttcctcaatgggttcaatagtgacaccttcgctgtttaagtccacaataaaagccgacatccctttggccctccgggatgggtcggtataagcataaaccaaagcaatatccgctaccggcgccagggaaatccacattttgctcccgtttaaaatataataatccccatcacggatagcttttgtggtcattgaagctacgtcagaaccagcattgggttcagtaatagcaaaacatcctattaaagcaccactgacaagaccgggtaaatacttctttttcgcttcttcagttccgtaacggtaaatagtaactccaggacctaaagtattggcagcaaagataattctaagagaactgtgcacccgggctatttcttcacagaggattgctaccgccaaatacccctgaccattacccccgtattcttcaggaataatgcaccctaaaaatccaagctcgcccattttctgcaccaggtcccggcgaaaacgatgagctttatcatcggcatcagcagtgggttttacttctttttcggcaaattcccgggctaaacgcttaattgccagtaaatcctccggtaaatcaaagttcatgctcctcacttccttaacttttttaaaaaagcggccaattcctttggccgctttatttggtgtgtttaatcgtcgatattttcaatgatcgtagctactccctgacctccaccgcagcaagcggttatcagagcatatctaccctgacggcgttttagttcataaaccgctttaaccaccaggatggccagtgacgccgcaatcgggtggcccaaagctattgctccgccattgggattaaatttttcttcatcccgccagtcaatgcccagttcccggcatacggcaattgactgagaagcaaaggcttcatttagctcaataacatcaatgtcatttaaagttaagccggttttggctaaaacctttttcactgcgggaacaggaccaatccccataatattgggatcaactccggcagccgcatgacctactattctggccataggctttaaccccaatttttcggctttctgccggctggcaattaataaagcagcggcgccgtcatttatccccgaagagttgccagcagttacggtgccgccgggcttaaaggccggcggaagtttggccagaacttcgagggtagtattcggccggggatgctcgtcctgatcaaaaattaccgggtctccttttttctgaggaaccacaatgggcacaatctgctctttaaagcgcccctcctggatggccctggcggcttttttctggcttaaataggcaaactcatcctgctcttcccggctgatctgccagcgttccgcaacgttttccgccgtaattcccatgggagggtcgcctatttctgctggagctaatgttcttcttggtatccaggcaggagcggtccgctgaaaggcttcagtaggcctttccatcaggtaaggctggcgggtcatgctttccactccaccgaccagataaagctcgccaaccccgccccagataagagaagccgctaaatttacagtagtagaaccggacccgcactgccggtctaccgttatcgccggtacttcaagcggcaacccagctttaagccaggctacccggcccatacagcccacagcgcccaggcagtggccaaaaattacctcatccacctctaaagagtcttttaagccgcttcgtttaattacttctttaattacctccgccgcataaacctctggcggcaggtcttttaatgctcctttttctttggcaatgggcgttcttactgcccccacaattaccgcatcacgcattttccccctccccttttaccggcctttaaaattcggcggccgtttttcaaagaaagcagttcttccctccaccgcatcttcactgctaaacgccactttggaaccttctttctcaatttttaaaccttcttctattgaagtatccagccctaaagttaccgcctttaaaatttcccgcatagcgatgggcgcccctttggcaagcttagctgccagcgcccgggcttctgttagtacctggtctttgggtacgactttgtttaccagaccgtagcttaaggcttcttctgccgttattggctctccggtaagcattgcttccagggctctggttttaccaattaaccggggtaacctctgggtacctccccagccagggataatgcccagttttacttcgggcaaagccatggaagcatcatctgctaaaatgcgcaggtgacagcttatcgctaattcggttcctccgccgtaggagctaccgttcagcgcagcaatcaccggcttggggaaaagctcaatttgccggaaaagaacacttccttccacttccggtaaaatccctttagcccggtcagcaaattccgtgatatctgccccggcacagaaaaccttgctaccttccccgctaattattaccgcccgaatctcgggatttttctcaatttcctgcaaagctttttgtaaatcttttaaaactttctggccaagagcatttaccggcgggttgtttaggtaaataacggcataaccgtccgtaacctcaaatttaattttttcaaattccaccgcaaatctccccgctttctattttttctcctgggtgtaatcataaaagcctttaccaactttccgtccccattctcctttaacaaatttctccactacggtaggagatggcttcatagcaggatcccggctttcccggtatctttccatttcaacgtaataagtaaggtcgataccggttaaatccattaacctaaagggtcccatggggtgaccaaggccaagttccaccgcggtatcaatatccttataatcggctattcctatttcatataaatagaacgcttcagccttaatagccgctaaaatgcggtttaccagaaagccgtaaatttctttttgcagcaaaaccggaactttgcccattttccgggctacttccatcgtcacttctgcagtttcatcggcaacatgaggtcctttaaccacttcaaccagtttcatgaccagagctgggttaaagaaatgcatatttaaaactttttccggacgtttggtaacatcggcaattttggagctgacaatgtaggagctgttggtagctaaaatggcatggggaggggtaagttcatcaagctttttaaataattcccgcttgacatccagcttttcaattaccgcttcaatgacaaagtccacatctttgcaggcctcttccagactcaaagtgaatgtcaaattttctttagctttggcagctgcttcctcggtaagttttcctttcgccaccctttcaggtaagtaggtttccacaaagtttttggccctgtttaagatttcttcgttaatgtcggtacaggtgacctgatagccggccaaagctgcagccagggaaatctggtgacccatgttgccggccccaacaacacaaatttttttaacttccataaaagatacctccctcttgtttttttactgccggcaattacttttgccagctttatttctctccttcaagaactttaaacttgtaaccatagcggattacgtcttcttccgtgtaaatttgccgcaaaaccatctccaccggcatcccaattttaatttctgccggtaccggttcggtcaattgagctataatccggggaccttcctccaattccaccagcaccaccggataagctccccggtatgccgcttcttcggaaaattccggaggcgctcccgctccagcaataacggtataggaataaattttgccgcgcccgcttaattgcacttcggtaaaattatccagcgccccgcaggatttacagccagccttgggcggaaaaattatttgaccgcagttggagcattttaaacctaccaggcggtatctctgttttaccgcccgctggtacatggggatggaaatatgcgcacccatggcttcaccccttataaatacctcttaactctgaggtactgaataaaatttaaatattttttccctgaggcaagcttttctcgaaccggcactctatttgctggttttttcactgtcaggctaaaagctatcaccccggcaccggaaccataagtagctacaataactttttctcccggtttagcccggtccagaactgccgccagacttaaaaagggagaagcagcaccggtatcacccgtattttcgtaaagcaggcctggtagcatttgttcgtcggtaaaaccaagttttttgccggctttcaggggaaggcggctttcaatttcgtgcaatacagcataattgtaatcagccggctttaaattttctttttccaaaagttcggttaccgcctttgttatcaacttttgataggcctcaccggtaaaggttttaacgccaatatcttttatttcaccgctgccagctttgcgaaaacgttcgcctaaattttcctggaccagagctacaaagttatttaccactgccagaggattttctgtccccaggataaaggcagcactgcctgcagccagtccgtgctcaatggggtctttaacattagccctgggagcatcagccacgataaccagagctttttggccaaagcctccttttactaagcttactgccgttaaaaaagcctcaccgccggcccgggtagattggccgtattcagctgaaaatagattttttttaagtccgagcatttccgcaatactgccggaaagcaatttttcactgtaaggcggactggtggaagcccaggtcaaaagggaaatttcttcaggatttataccttcaaaaagagcatccctggcagcagctatacccattgttaacgaatcttcatcaaaatcggcaactgttttctcactgaagtttgctccgcagctgcccagggctttctggtattcgctcctggttattctaaggccggggaaatagatgccgtaacttactatccccacttccatcgctacccctccctccggtaaataaacaccgctgccgttcctccggaaccgcctacattgtgggataagcctacttcggcattttttatctggcgctccggatttttgacccttccccggagctggttaaacacttcgtatgcctgaccgcagccggtagctccaataggatggcccttacttttaagtccgccgctgacatttaccggaaggcgtccaccaaggtaggtctccccttcttccaatagcctaatcacctctcccttttcgccaaagccaaggtcaccgtaagctaaaatttcggcaatagtaaagcagtcatgcacttccgcaaaatcaatttcttttggagttattccggccatctgataagctctggtgcttgcctgccgggtggctttaaaacttgtaatactgtctcgatcctgcaaagccaggtaatcggacccaattccatagccgatgataaagactggatggtcggtaaactcttttacccggtcttcactgcaaagtaaaacaaccgctgctccgtcactggtaggtgagcagtcccacaccgtaaagggatcagctaccggtgctccctttaacaccgtttccaccgttatttcctgtctgaattgagccttgggattcattttgccgtgatagtggtttttcaccgctactttggccagctgctcccgggtaaggccgtattcctccatatagcgccgggcaattatagcgtaaatcccggcaaaggttaagcctgccagtctttcaaactcggtatcgccggaaatcccaagccagtatttggctttggtcgaagaaacatcccgcattttttcaaccccggcagcaagagcaatatcgcactgtccggaagcaaccgcattaatcgcattatataacgcaaatccacccgaagcacaggcattttccacccttaccgccggaacattgggtaaacccacatgtcccattaataagggagcaagctgtcctaattgaaaaccgctgccggcgcttaaagagccaataaaggcctgctggatttcccgggggtcaatccctttatcgacactctctattgcttccttaaaagccatagcaaaaagctctttaacccccagctctggaaaatcgccgtagggagtttgcccggctccgatgatggctacccgccgcatgcaagccacctctttattaacccagttcctttaaaatctgggaagctattatattcttctgaatttccgaagttccttcataaatcctggtaatccgggcatcccggtagtatctttcaatggggaactctttcatataacccatgccgccaaaaatctgtaccgctttatcgaccacccggccataagcttccgaagcaaacagtttgacggcagcagcctctttaatgacctttgctccctggtccacaagccaggctacccggtaggcaaaccatctggttgcttcaatatctacggccatctccgccagcatatgctgaatagcctggaaagacgaaataggcttaccaaactggacccgctgctgggcataacgggtagacagctccagaagtttttgcatggaaccaacacagcgagcagccagtcctacccgccctttagccaggattttcagggcattgatataaccttcgccgacattgcccaggacgttttcttccggaacttcgcagtcttccaagataatttccgaggtatgggaacctcgcagtcccatttttttctcaatagttcccactttaaaaccaggaaagttcttttcgacaataaacgccgttatcccacctttagcccctttgcttttatcggttaccgcaataatggtaaagacatcggcatctggaccgttggtgataaaatgctttaccccgtttaaaatatagcggtctccctttttaacggctgttgtcctgatacttgcggcatcagaaccagcctctggttcagttaaagcaaaggcagctaattttttccccgaggcaaggtcaggtaaatatcttcttttttgttcttcggtgcctaactccacgataccagtggtaccaataccggtatgcgcaccaattaaagtggtaaaaccattggcggtacgtccaagttgctcataaattatacatttgcccagcatgccaatgctgcccacaccgccatactcttccgggatgctcaaaccaaagagtccaagttctcttgctttctggataatttcttccggcacccggtcttcttcatcaatttgctggctgatggggtcaacttcgttatccacaaaatccttgaccgtctgcaccatcatttgcagttcttcactgatcgtgaaatccatagcgcccctccctcttgcttttttgttttatatatgaaataattgtcttatatatagtataacgggatttaaatttttatgtcaataattttgcaataaattttaaaattttcttacaatttttcttaaaccgcttgcagtgttatgataaattaggagaggtgacgttatggttttagaagaaaaagaaaataaatcgggagccccggccgtggaaatggctatcaaaatcttaacttatttaagtagataccggaataaaaaccgcacccttgccgaaattgcccgggacttaaatatcaataaaagttcctgccaccggatattgaaagttcttctggattaccggctggtatcctatgacaaaaacaccaggcagttcagcctgggatcttttttaattgttttaggtagccgggcttccgaattcaacgactacttaaaaattgccaaacagcatttaaaagaattagcagaaaccaccaaacaaacctgtgtccttgtagagccaatcgccaacaaccgcctagtttacattgccaaagaagagccggaggcagcagtacggattaccgtcagtatcggtcaatcgtttccggtaaccagtgcttcctttggaaaatgttatctggccttccttccagaaaaggaagccagggaaattgtaaaagaggtaggaatcaagcaatttaccgacaaaagtattaccaatgtagaggaattttttcaaagtttggaggtaattcgaaagcagggctatgcggtgagctttgaagaacacactccgggggtttttggcattagcgctcctgtttttgataacagcggaagtgttcgcatggttgtatcgtgtattgggcttgcttcttcagtgaatgaagaaacaattaatttttacgctgacaaagttaaaactaccgcgcaaaaaatcaccgctattttttccgatatgtaacaacaccccgaagttaaacctccggggtgttttccttttaaccaccgcttaagtagggaaagacaaatacttcatccccatcttttagcagctggttgtcagttgctatctgtccgttaaccgcaatactaaagggatttttaagtcttgaggccaaaagctcctttaactcttcaatacttcctgccgcaagttcaatttcttctttgggaaggtcgtaaaataaagcataatttaccttaactttaatcatccgccagtaacctcgctaaaaattcccgggatatggtgccatcggaattccagccccgaagttgataaaattcaggcaagtatttttcaatctccggaacgttaccaaaggctcccccttcggcaagaggctttttcacatgcccgggtagcctatcatcggccggactgcttcccaaattaaaggaaatggctctcttaattgtaatcgaattgtttgctgcttcgaccactttttccggcgtccaggcaactccggtagtataagacagagcacccaccacagcctttaacggtgtaaaggcaaagctgcattttacaagacagttatcaagttcccgtaagctctggaacttcactactgcttcaacccggccatcaaggttaaacctcggtcccggcactactccaaagtccggatctttagcaatccccaggtcaacttcaaagaaacttcctcttaaatgacaggctccccggggaccggttgcataggataacgcctgaccggtaaaggctcttggttcatgcatgggtatctccaatcttcttacagccgcagcatagtcctgagacaaaccaagctcttcggccactctggcaactcccttgcctatcagctgaccaatgccgctgttttctccggttagccttaacgcttcaagaattcccttgctatctccaaaatcaggcacttcggccttcaagttttcgggaagcaaattctcttcttttaagtacattaaaaaggccaggctaacaccggtggaaatagtgtcaaagccataacggttggcaatatcattggcttcaataatagtatccatatcgaagttttccagaagcggtccgtaagtaaccgctgtttcgtattcgggaccatcaacaattctacctttgaaattaagttcgcgtccacaggcaattggacaaccccagcaggctctgggatggattgaatattcctctctgaactttctggcattgaccttatctatcggaaataatcctttggtaaaatatttcaccggagtatcgccaaaataatagccaatatccagatatcctaaagtcccgtactgggtaaagagctccatttcctttttataagcagccgttaattgctttgccaattctttcagctcttctttagcagcaaccggtacttctccctgtccatcgactacgatggcttttaggtttttactgccaaaaaccgctccaaaacccattctcccggcagcccgaccgtggtcgttcatcaccgcagccatcggcattaacctttcgccggctaccccaatgcctgcaatgctgacattactgccgtaaacttttttgagctcttcctgcatttcataggaatcaagaccttttaagttgctgccgggtttaatctccaccctgccatttttgacttcaagatataccatatcctgagctttaccggtaataattaaaccatcaaaaccggctcttttaagatatgccccaaattttccgccagaggtagcctcgccccagtagccggttaatggtgaacggccacaaactgcatagcgggaagaagccggtagagcggttcccgtaaccgggccagccatcactgccacataagcttccggagccaggggatcaatttccggcttaatgtaatcataaagaagccttgctgcaaggccactgccaccgataaatttttcggcaagcttgaatggcgtaggctttatctcaactttctggtttgataagtcaatatacgctattttccctgtgtaacccagcattagcgtacgcctcctttcagcgtcccgtacaaggatgccacaaaaatctcctcataatcttttggtgttaccggaatggggcttaaaatactgaccgggtcaataagcgcccaggaaaccagctccggtaacgcttgcttaaatgcctcctcactaacctgcggataatcggaaaacttaaagctaaagccgagctttttataaaactcaaccagcgaatttaaaaactcctcgccctttccaaagccaagggcctttgcaagttcatcggttttggttaagtgtttggcgtaaaactcaaagacatagggtaaaaatgccccaacacacaaaccatggtgcagaccaaactttttccccagggtatgccccaacgcatggtcgataccaggagcagcattgctgaaagccagccccgctaaattagcagcaattaacattttttgccgggcttctaaatcccgaccatccgccaccacccggggtaaaaacttaaagattagttttatcgcctggagagcataagcatcggtatattcgttagcccagccgctcaagtacgctcctaccgcatgcgccagggcatcaacaccggtccagagggttagatttgggggaagagaaacggtgaaattggggtccaggatggcaaagtcgggaacaaattccggatggctgagactcatcttatggccgccttcggttattactgctgccgaagtagcttcagaaccggttccagctgtagttggaattgcggcaaacagcgccttttttcttaacccaagggaatcaacgggagataattttctaaaatctacatcgggtctttcatataaaagccagattaccttggtggcatcgattaccgaaccaccgccaatggcgatgattaaggaagcatcactattttttactgcctccactccggcaaaaatattttccaccggaggttcgggctgcacttcatcccacatttcaacgtgataaccagcattagagaagatttctttaaccttctctgcatttggttttacgattttatcggtaataatcagtacccgattatttcgacaaattgtttttcccatccccaccagagtgtttaaggcccggggtcccataaaaatcctgggtccaatgaccgctgactgtaagccccgaactcccgaggtgccggctaaagtaaatagtagccgccgcactgggtcttcaaaaccgtacttccctctttccatactatccccccaagttttataaaaatttaaagactatttattattttctacaattttctcatttttcctttgttctttataaaataaattgtttacctttaaaataattctcttgcccagatttaacaatatttttttctttaattgtcatattttcacaatgaatggcattcattttttaaaaaatgaaacattgaacatcacccggtaaatactattcttaagactcacggtaaaaagtcaaggaccaagaaatggaaattagaaaagtaggggctaaaaaaggcaataataaccctctccaactatatggtaatagttggaaaatagcagagaagagaaaaggttttattcaagaactatttcatcaccgtccctttgtagatttggcctttgctcagcagggcaaagaccagccttactaatttgcgggcagttagaaccagcgctcgcttatgttgatgcttggtaacttcgtgatacttgctctggtagtaggccttatactcctcgttgtgcacccgcaacgagttggcggcctggaccaggtagtaacgcaggtaccggttgccactttttgtcaggcggcgttcttcggcgtcaaaatcacctgattggtagcgggtccaggtaaggccggcatattgagccagagcggcttgatctttgaaacgtttgatatcgccaatttcggctataataccagcagccgagatgggaccgaggccttttacgctggtcagagtttgaggtatggcttctaactcccggcaaatgactttatccagttgtttaagctgccttttgaggtggtcaatattctgcagagtaagagaaagagccacctcacaagctgcgagcattttaggattaaggcggtaggcgcggcgggcagcctgtttgagggccttagccatattctcaggtgaggctaatttgttgttaccatgggactggatgaactctgccagctcttccaatggcatttctataagttcatctggtgtaaattcctgtaataccgccagggaggccttaccgaaagtttgactaaaaggcttgtcctggtgataattagaaaacttaaggaagaggagatttaaggctcggttctgctcggccgtcaccatttccacgaggtgtaggcgcaggcgggtgagctggcgcaaaggttcagtcactatagtttcccggctacaaggggtaagatggccgaagcgcacccgttctgcgataacgtaagcatcgagggcatctgttttagggcgcttggtaccgaaggccttcttaaaactggccaccatgacggggtttatttcatagaccttggtggagtatggcttaagctttggggagtccaggaggaactgacggagatggacgctgtagatagaggtggcctccaaccctatatgaagttgctggatgttaaacttatgggcgagaccatccagcacctcaaccatagcagaagcgccttcgaggctgttaggaaaagacttaactggggcgagctgttgcccttgctcatcgagacacaccaagtcgcatttaagagcgctgacatcaatgcctgcaaaaacgacccgggccaaagggtatccctccttgggctggcccaaattaggggcgtgccctgcgggtacgtcgcgtaacaacctcgcggggcgatgagagcgtggcaggacagccgggggtgcacctctggcctgctgaatccagaagccggctggcctgttggctcagctcacgcgtaagaaacatgcgccgcaccgcaagggtctcactcttacatgagtagtcaccgggtttactcgggctacaggaggtatttaagagtgaccccggaccaacctattttaatcttcgcaaaggcacgccaagttatcaagaacccttaacctaatttttcggctcgggttctatggtaatttaaattatacgaggaggtattaagcgatggagcttaaaaaaaacgagcggtcaattttagcgtactttccctccagtgctaaagccatagatgccgccgaagcccttaaagctaagggaattaatgacgtacaggttgaccgggtgagcagatacggtgttgccagcaatccggaagttaataacccgatttccggccagggagtgagcggaaccggtttaagcctttactccgctggtgccaaccagtttggcgataatgatgcccgggtgcttttatcagctgacccatcagtatcggggatgaccgctaaagaatatggcacagccgggggtgaggcgtttttggtaactgcagtaacgacaaaagataaagtagaacaggcagtaaaaatccttaaagaaaaaggcgccaagatataaaaaaggcaaaaaaataacccggaagcgaattccgggtttattttatagtattttaaaccgctatttccaaggtctactgcagtagcttcaagctttgtttttacctcatcggaaaaatgaaactagagcggcattttcgttcatttacatcccgctcttaaaaaccttaagccaatacctttctccctctttttcaactataaccggcaggtcgtaaaaatctgttaaaagctctgaagtcagtacctcatcttttttgcccgcggcaaaaacttctccattttttaacaacaggacatgggttatcccagccacaatttcctcggtatgatgcgataccaaaataattgcaggtccactttcttcccggcaaagggagtcaatatcggaaagtagtttctcccgggctaaaaggtccaatcctgccaccggttcatctaagattaaaaggcggggattgttaattaaagcccgggctattaaaactttctgcttttccccttgcgacagggtttgatactggctgttagccaggttagataagttaaatttttctaaaagcctaagggctttttcgacatcctcttcttgcggccggtcaaaaagccctatggtggcaaaaagaccgcttaacaccacttccaaggctgtttcccgaacataaagcttttcctgcaaagaagagcttacaaaaccaatttcccggcgaagctcccttaaatcatagcgaccaaatttctttccaagtacctcgacgtcacctttcgatgggtagtaatacccgcagataaggtttaaaagggtagttttgccagctccgtttaagcccaggaccgcccagtgctcaccctggtttatttcccaggtaatattcttgaggatttgcttcttttcccgaattaagttcacgttttttagttttaaaaccaatactcctctccccttatctaaaacgtccataaatttttccaagataagcttttaaagccggtgaattttgctttttccgtttttccattaaaagattaaagcgcaggattttttcgttaatttttttctttatttccttcttttcttcttcatcgtagcagcaatcgataagattttgtaaagtcaccaattcttttttgagctgcatttcttcgggcagcacgccggcattttttaaaatgatatatcctgcgcgtaaatcttccgggatcatggacaaatcctcgggaataattttttgcccctttcccggaagattatcaaaaaccccattttccatagcttcccgaattctttcctccgcaagatgcatcaagatatccattaaagtaactctccttcagctaccgggataactttacctcttaatttagacattccaggaaaaattccttctaaaaaaataaaccccgtaaaattacggggttattgttccacatacagttctaataaagctttgtccatttcacaatccgggcaaatttcctccccatcgtcaataatgcagtagcaaatagggcaacgtttttccacttaaaaccacctgctacgaagtattgagtatattattaacaacagatattatagtaagatttttttgatttgtaaactactttttcacaattaaacttacgcctaatacaaccagcaagatgccaattacctgggtaaaaacaattttttcctttaaaaatactctggccattaccaacacaaaaatataacttaaggaaagtgcgggataaatcttactgacctgctcccgggctaaaagccaaaaccataagaaagtttcggaaacgtacatgaaaattcctgaaataatgtaaccattcataaaaaattttattaaaccagtcaaagtaaaagtaaaaggcattctttccatcccaagcttccagaatatctgccccagggctatcataaaagcacaaataacggctaaaagtaaatacatttctaccacctggatttactataccacaggaagggaaaacgagcaaaaaagacggttctaacagcagaaaaatggatgctgtcagaaccgtccctaacggtactatttggtgaagacgtggttgccgatgcgggcggtaactacccggttagcaaaccagggatggttcgatttggccggattatagaagtacaaagcgccgttggaagggtcaatcccgcgtaacgcatcagccaccgccttcttcgattcagcagataccgttacctgccagaaccaaccgttcaggattggttcaaaagctcctttttgcaaaattactccccgaacatcgttaggaaagagcggtgattttacccggtttaaaattaccgcggccaccgccaccttgcccagatacggctcacctccggcttccgcctccaccatgcgggcaagtagctcctggtcttccgggctgatacgaaaagcgctccgggatacagaagtggaagtccgggctattaaccgcttcatcgttaccggaccaacaataccgtctacttttaaaccctcttttttctgaaacgccataaccgcttttttggtagaaacgtcaaaatacttatccactttgtagaccttataacccaaacttacaagttttctctcaatctccagaacttttgagccgtaacttccaaccttgtaataaaccacctgcgaagccaaagcttcagatacaactgctacagggagtaatagcataaaaattaaagaaaacactgcaaaaaattttttcatttttatccctccttaaaagttggtttacggaaaagcaaaaattctgcccttccttggacgcttttaagaaggtataaaagcagacactacaattgtaactatttctaatctttttgccaaattagctaaggccccataaaataagaaaacccggctttacgctttttccccaaaaagcataagccaggctttcacgtatcctaacctatgagacgattaacggtccgctggaattttcaggacttcctctcttagcttttttagcttcaccaaatcttcctcaatccccggttccggtgtttctaaaatccacggcacccgcttaaaaaagggtgaattcagtaaattaataaacccttctctccctatatatccctgctctaaattttcatgccggtcttttcgcgaaccaatggggtgtttggaatcatttacgtgaagaagacaaaagcgctcttccccgattttctccctaaactcccgggaaaaggcggaaatcccttccggcgaaacgtcatcatagccggccgccagcaaatgacaggtatcaaggcaaatccccagttcctcatgaccggtttcggaaatgatataagccaggtggtcaagggaatatcccatttcattgccgctaccggcggtattttcaatcaggattcttgtcttgaaattctcggaaagcagtattttaagcccttctaccatccgggctaatccccgctcttcgcctgccccgcggtggcttccaacgtggactaccaaaaagtcagcatgaagctggtcggagcggtaaaggtcttcccggatcatagctacgcttttctgaaacatctcttcttcgggagaagctaaattcattacgtacgggacatgaaccactaaaggataaagcttatactcctctttaaactctaaaaaaccctttaactctttttcgttaaagggtttagcttctccaccccgggggcttcgggaaaagatctgaaccccttcggttttattttttataattctttctttaagttttaagagccctccggcaatggaaaggtgtaaaccaacgttcatttattttccttcccttcggggtttatgaattggaggatttttcttttcccttacttcctccgctgggatcgcatctttccgggaaagtttcagtctaccctggttgtcgtaaccaatcgccttaaccaaaatctggtcaccttcttttaccacatcttccactctcttcacccgggaatgggcaagctgactgatatgtaccaagccttctttgccgggaaggcccagcacccctggaactacttccacaaaagctccaaagtcagctatcctggtaactttcccaagatatactttgcccacttcaatttccttggtaaggttttcaataatgttgagagctttttcgcccgcttccttatccaccgctgcaatgaaaatccgaccgtcgtcctcaatatcgattttgactcctgtttcatcaataattttcttaattattttaccgccgggaccaattatatcccgaatcttttccggatccacggtggtaaagattattcgcggagcatagggcgaaagttctttccttggttcggaaattacttccaacatcttgcccaaaatatgcatccggccttcccgggcctgggctaaagcctttgttaatatatcccgggtaacgccagcgattttaatatccatctgcagagcggtaatgccatctttggtaccggcaactttaaaatccatatcccccagagcgtcttcaattccctggatgtcggttaagatggctacttcatctccctctttaattaaacccatagcaacaccagctaccggcgctttgatgggaacaccggcatccattaacgctaaagtgctaccgcaaactgaacccatggaagttgaaccgttagactctaaaacttccgatactatccggatagtgtagggaaaaacttcctccggcggaatcaccggctcaagcgctctttcggccaacgctccgtggccgatttcccgccgccccggcccgcgcattgggcgaacctcaccaacgctgtagggtgggaagttataatggtgcataaaacgcttggattcctctatcccaaggtcatcaagaatttgcacatcgccaacagcacctaaagtaacaatacttaagacctgagtttgtccccgggtaaagagaccggaaccgtgagtccggggtagtagccccacttcacaccagattggccgcacttcgtcagtcttccggccgtcaattctaatgccttcttttaagatcttctgccgaacgatttctttttgaatgctgtccaagatgcctttaatggtaagctcttcttcgggataagtttccaaaaacttggttgtaagttccttttttaaattttcaagatattcatcccgctcctgtttgttaaatttttcagctataattttttcaattgcttctttaagaaggggataagcttcagcggtaaccgcttccttgagctccgccttctcttccaccactacttccatcttctccttggccagcccgagctttaatgcttcctccctaaactcttcgataaaggcaacaattttcttaacttcttcatggcctctcgttatagcttcaatcataatttcttcgggcacttcctgggcgcctgcttccaccatcatcaccgcatccctggtcccagcaaccactaagtgcagccggcttttttccgcctgctcaatggtgggatttatcaccagttcatcctccaccaaccccaccaccactgcaccaatgggacctaaaaacggcaggtgggaaagggtaagagcagccgaagctccgttcatcgcggcaatttccgggggattatcctgatttaccgataaaaccgttgctacaatatggacatcgtttttaaagccttttgggaaaagaggacgaataggacggtcaattaagcgcgccgataaaattgccttttcactgggacgtccttcccgcttaataaaacctccgggaattttaccaacagcgtaaaacctctcttcgtaatctaccgtcagcggaaagaaatcaatgccttcccggggctctttacttccggtagccgttaccagaactacggtatcgccatagcttaccaaaaccgaaccgctggcctgggtcgcaactttacctgcggtaagctttaacggccttcctgcaatcattatttctttttctaaaatctgccttcccgtggtcatatatatcgcaaataacctccttaaaatcccgtaatatattgtaaaaaaattcgacattatttatagtatttcctgccaaaaaatcaataatacttaagaaaattcctgatataggaaaagcgggggtaatccccgctttatttccttaaacctaatttttcgacaatggcgcggtagcgctcaaagtctttccgctttaagtaattaagaagagacctccgctggccaaccatctttaagaggccacgccgggaatggaaatcctttttgtgcacctttaagtgctcggtcagctgattgattctttcggttaaaatggcaatttgtacttccggcgaaccggtatccttttcgtgcagctgatacttggaaatgatttccattttctgttcttgcgttaaagccacttctttcacctcctcctaccataatcgccagagatcaagtaataaacctaacctctggttaagcctaaatgtcctcaagtttcttggacaaaaaggcaattaaagcatcttccaaggcagcggattccgcatcttttattttagcttttttatattgtttggtcaaatctttttttaatttaataaaatctttttttaaaataatccgggaaatttccgcaatcagttcccggtaaaactgttcttccctgtccttcaggttgtacacggctcaaaacccacccttcggtaaaggttatgagccaataatttaatttattccttgtaaagcttctttaacatctaactcgatttgtttttttaattcttccagggaattaaattttttctcgggacgaattttctttaaaaaactaaccttgagttcccggtgataaagattagctttatagtttaaaagatgaacctctaaaagcggacgactttcaacttttaccgtcgggcgcactccgaggttagcaatgcccggaatttttacctcttcgccggtaatttctacatctacccgataaacgccgtactgcggtaaaaccaggttttcctccggcaaaatgttggcagtaggaaagccaattttccgggcaagcttatcgcccccgattaccttaccttttaaaaaataagtgtagccaagcataccgttgaccttagcaatatccccggccgctaatttttcccggattgccgttgaactcaccacttcctggccaaaggtaaccggctcaaccacctccactttaaacccaaaacgttctcccgctttaatcaggtcagttaccctgccggctcccaggtggccaaaagtataattaaaacctgccactactcccgccaaattaaaattttccaaaagcatatttataaactcccccggagaaagccgggcgtattcgggggtaaaagattctaacacagtaaattccagctcttccgcagcaaatctcttaagacgctcgtctaaaggaaggatatattttacctgttttccctgaagcacctctaaaggatggggccagaaagtatacaccccgggacaggccccgattttaccggctaaatcccgggtaaccctcaaaagtttctggtgaccaagatgcactccgtcaaaattgcctaaagctaacaccacagggcaatttaaagtaaactccctggaaccgtgaaaaacctgcaactattactcactccccaaaccggaaaaccttttccggtcgaaaaatttgcccgcaaatcatgcctgtggctataatcttttcgccataataagcaaacaccggtccaaaattttcccctttagtttcaacctttactcctccgccattttttaccctgaggtattgctccctggttaagtttatttttggaaaatcttgaaatagctgttccggaggaataagggtaaaatcttcgtgaagaaggttactgtcgtctaacaaaaagggtccggagcgggtgcgaagcaaaaatttcagggttgcccccgttttaagtaaattaccgatctcatttgctatgcttctaatatatgttccccgggaacaacggatatacaaccgcaccgccggctggggtttgtctgctaagaattccaacaattcaatactatcgataaaaaccttccttttcgggggttctaccttttccccctggcgttgataacggtataaaggtttacccgaaaccttaaccgccgaagcaagaggcggggtttgctcgatttcaccatgaaaatgcccaagtactttttctatatcgccagcggttaaaaaggaagcgtccttttgctccaaaatttccccttccatatcccaggtagcagtggtaatgccaaaaacaatttccgccaggtattctttcatggctacattttccaaatattctattaagcgggtagcctgccccactgccaccggtaatactcctgccgctgcaggatcaagagtacctaaatgcccaactttcccggtttttaattttttccgtacataagctaccacatcgtgggaagtcattcccggcggttttaacaggttgataaaaccatccatttttaaaacctctttttgacctcggctaaaacttgttccaccgcatccgccagcggcattttcagggtgcaaccggatgcctttttatggccgccaccgccaaacttagcagcaatttcgttgacatcaatagttttggacctaaatcctactttaatgctgccatccctggtttcccggaaaagaatgctaatttccacaccggcaattccccggacaaaacttgcaatcgaacttatgacttcttccccttcaataaaacgctcgatttgttcccgggtaaattttacccaggcaattttcccatcggcttcaaaggtcagggagtttaaggcttcccgaaaaagaaggacgctatccctgggtttttccatgtaaagcttttcgttgatcattgccagatcaaagcctttctgagccaaaaaggaagctacagcaaaacttttggcggtagtattggtatactggaaagaaccggtatcaagggtaataccggcataataggccgcagctacccactcatcccagggtaaacccaggtcttcatggatttgcggcaaaatctcgcaggtagccgaagcttcgggcacgactatgttttccactccaaaataagtgttgctgatgtgatggtcaatatttataaccctttgcgggtttgaagtaaccaccgccaatgcttcttctcctaaacgttccgggtcagcagtatccaaagcaattattaaactgtctccggcaaataccgccggatcggaagttatacggggaaagtcgggaaaaaaggaaaacaggcgaaccggtttatcttttaggtacattaccacttcaaagccatttaaacgtaaggcccggccaaaacccagaattgaacccatagcatccccatcgggcaagatatgggacgtcacaatgattttgctatatttcttcaagaggtctttaagactcactttcgttctctcctgcttcttttttaagaccttccaagatttccataattcttgctccatattcaatagaaggatcttctacaaaatacagttcgggcattattctaagtctaacccgtgatgctaattctcctttgataaatcctttggcactatttaaagctatgaaactattttttttatcctcctcactgccataaacgctgatataaattttcgcctggctcaaatccctggctaaatcaactttggtaaccgacacaaatccaagcctggggtcctttacttccctggaaatgatagccgccaccgcttctttgattgcctgggcggttcgttcgtgcttatgggaagccaaaaccctcacctcgctttattccagtgttcttttaacctcttctatggtaaaagcctcgataatgtctccttcacgaatatcattaaacttttcaatagtcaaaccgcattcatatccctgggctacttcccgcacatcatctttaaaccgctttaaagattccacgtttccttcatgaataacgattccatcccgtattacccgcacttttgccgaacgggtaattttaccttccagtacatataatccggcaatcgtcccaactttcgatgctttaaacgttttccgcacctcagcccgtcccagcaccacttctttttgttcgggttccaatagaccagccatagcagctttaatgtcatctaaaagctcgtagataatccggtaaacccgcacatcgatcttttccgtttcggctaatttccgggcattgctatcgggacgaacgttaaagccaataacaatggcgttggaagccgaggctaacatgatatccgtttcggttatagcgcctacacccgagtgaatgacgttaactttaacttcctcggtggaaagacgggaaagggactgtttaatggcttccaccgaaccgtgcacatccgcttttaagacgatatttaattctttaatttttccttcctgaatatgtttaaataaatcttccaaagaaactttgctgctggctcttaattcttcttcccgcttttgctcctgccgcttctcggctaaggtccttgcggtcttttcatcgtcaactaccaccaaaatatctccggcactgggcacatcgtttaaacccagaacctctaccggcattgaaggagttgcttttttgaccctccggcctttatcgtccattaacgcccgtacccgaccgtaggttaaaccaacaaccaccacatctcccacatttaaagttccggattgaaccaaaaccgtcgcaaccggtccccgccctttatctaacttggcttcaattaccgtaccccgggcgggtttattgggattagccttgagttctttaagatccgccaccaataagatcatttccaaaagttcttcaatcccgattttctttaaggccgaaacttccacaaaaaccgtatcgccaccccaggcttcgggaatcaggccatattcggttaactgttgtttaacccggtccggctgggcattgggtttatcaattttatttactgcaacgataattggtacccctgccgctttagcatggtttatagcttccaccgtttgcggcatgaccccgtcatcggcagccaccaccaaaatcgctatatcggtcacctgggcaccccgggcgcgcattgcggtaaaagcctcatgaccaggggtatcgataaaggtaatcttccggccgttatgttctacctgatacgccccgatatgctgggttattccccccgcttcggtggcggtaacattggtttggcggattgcatctaaaagcgatgttttaccgtggtcaacatggcccattaccgttacaatgggcggtcttggttccaggctttccggatcatcgggagtttcttcaagaagccagatgtcttctttttcttccttttccaccgttacttcatagccaaagtcggtggcaataatcgtggcggtatcggcatcaatttcctggtttattgttgctaaaatgccataactcatcaacttcttaattacttccgccgccgatttacccataattttagcaaattcctgaaccgtcatccgttcgggaataacaattgctttgggttcagcagcaaccggttcctgtttttcttgtttttcttgttttttctcttttttcagattcaatttcttttcttccagagcaaaaactttttcttccttctttaaagccttttcccactcccgttttttatccggagcaccctttctcctttccggttctttattttcacctttaggagcttcaggtttgggaattgccggaagtactcccttcttcttctccctggggaaaggcggacgctcctttttctctccaaagggttttggcccctgaactccccgctctttatcaaaacgccgccggtcatccctcgggcgattttggttaaatgagcgctgttcacccggtcggcgacccttgtccttatccctgggttccggtcgttgattaccggcatacctttggccctggggccggtcagaccgctgttcccgcgggcggctttgacccccttgctttgattgttgctgctcttttggcctctgggggtgagactggagcttctgggcttcagctttttgctccacctgcttcttttcctgctcctttttttctttttcttctttttcccggtttaaagcttttaacagaagatttaaatggtgattttctactgtactcatgtgggattttacttcaaccccaattgcctttaaacgattgataacttccttactttccatgtttaactctttggcaatttcaaaaacacgctttttgcgcattaattcaccccctggtcattaccaatttcttttaaaaatttctgccaaaatcccctgtcttgaaagcctaatattcccgtgggacggcggtttaaaatcctgcctatttcctctttagtgccccagttaaccaccaaagttccctgctcctttgccagaaattctattttcttcttttgtttttccgaagtatttaccgctaaaataactccctcaattttaccccttttaaaccctaataaaacctccgtttctcccacaagaagtttttttgctttataagctaaacctaaaataccttcaactttgttcactttccgttaactcctgttgtaatttttcgattatttcgggagaaaccggatgatttagagctttttcaaactttttaccctttttagctttttcaaagcaactaagggatgggcagatgtaagcgccacggcccgccttttttccggttttatcaattaatacttccccttcgggagttctaactacccgaatgagctctttcttgggtttcatctcctgacatccaaggcacatcctcatcgggatttttttctgtttggccattaaatccccccaacctgcgattcgctcttgatatctattttccaaccggtgagcttagccgcaagtctggcattttgtccttccttgccaattgctaaggaaagctggtaatcgggtacaactacccgggcaactttttcatcctcgaaaacctccacactggtaacctttgctggacttaaagcattggcaataaattttgccggatcagggctccacttcactacatcaattttttcgccatttaattcttcgacaatattttttattctaagccctttgtttccgacacaggctccaatcgggtctacattttcatctttactgtatacagcgattttcgaacgggaacccgcttcccgggcaatactcttaagttctaccgttccgtcataaagttcgggtatttccagttctaaaagcctttttaaaaggccgggatgcgttctcgataaaattatgtttggtcccttgctggttttcttcacttcaaccaggtaagcttttatcctatcaccaaatttatagttttcaccgggaatttgttcctgcggtggaagaattgcctcggttttgccaaggtcgacataaacatttttttggtcaactctgcggataattccggttataatatccccctcacggctggaaaactcttcgtaaatttgatttctttctgcttccctgattctctggataaccacctgcttggcattttgcgctgctatccggccaaaatttcgcggagttacctcaatttccaggacatcgccaagatttagtcttgggtctttttcccgggcttcttctaaacttatctccaaccgggggtctttaacttcttccaccacggtctttaaagcgtaaacttttacttctccggtaacccggtcaatatgcacccgggcattctggttaatcccataatttttcttataagcggacaataacgcctgttccgttgcttctaacagtacttccgccggaatccccttttgcttctcaatttcctgcactgcctgtaaaaattctgtattcatcacagatcctcccgaaactaaaaatcaaaggtaaggttagctttggcaatttgttctaaaggaatttgtacctctcctttaccggcatcgataaccacctggccatctcgaaccccaagaagttttcctttaaactgcttctgtccctcaattgcggcaaaagttttaatttgagcttctctaccagcgaacttttcaaaatccgctaattttttcagggggcgttcaatccccggtgaagacacttccaggtagtacgactggggaattgggtcctcttcatctaaaataacacctattctttcggaaaaattttgacagtcatccaagtctacaccttcatctttatctatgtaaattcttaaaaaatacctgcccgcttcttttacaaactcgacatcaaccacttctaagttaagctctcccccaaccctttcggcaaggggccaaactttttgttcaattcctttattccggcccatgttttcgccccctttccgcttttgctttaatatttttcccgtaaactgctattactaacaagaaagagtgggaaaacccactctttctgcgaaaaggcttttatttctttaacattataacacacatcccatacaactgcaaggtattagggagaaaatagttaaattaagcaaaaagtactaactgggaagtcggtgctaagccttttaagcagccgtgggcatccaaaacttcaattaccgctttagtggcttttccccgggtttttaaatcttcaatggatacaaacattccttcctcccgggcctttacaatatttatcgccgctgcttcccctattccgggtaaagccacaaaaggaggcaagataccctccggggttattaaaaagcgggttgcatcggatttttccaggtctaccggcagcatttttattccccgggccagcatttccagggcaacttctaacaccgtaacgagacctttttcctttgccgttaaatttcccccccgttgttccagctcatcaagagttttccaaattttttctggaccagccaaaataacgggcaggtcaaaatcatcagcccttacggtaaaatacgtagcataaaaagcttccgggtagtaaaccttaaagtaggcaattctaaaagccatcatcacgtaagctaccgcatgggctttggggaaaaggtattttattttctggcagcttccaataaaccagtcgggaactccatgttctttcattaccgctatttcttcctcggaaattccttttcctttgcggacattttccatgattttaaaagcttttttgggaggaacccctttttgcaggaggtaaatcataatgtcgtcccgggtagaaattgcatcggataatttacatattccggctcgaattaaatcctgagcattattcagccacacgtccgttccatgggaaaagccggaaatccgcaccagttcggtaaagctcttgggtcgggtatcttcaagcatctgccgcacaaaacgggttccaaattccggaattccgtaggtacctacagtagtgcggatttgttcgggagttacccctaagggttcggtggaagaaaagatacctaaagttttccggtcatctaaccggatagttcggggatcaattcccgttaaatcttccaacatcttaagaacggtcgggtcgtcgtggcccaggatgtcaagcttaaccaaacggctcgaaattgaatgataatcaaaatgagtggtaaccactcccgcacttttatcatccgccggatactggagaggagtaaaccggtgaacatcgttatttttcgggacaaccataagaccgcccggatgttgaccggtggttctcttgactccgacaatcccgttcgttagccagtttatccaggcctgacgggccggccttccggtctcctcaaaatattttttaacaaaaccaaaggctgtcttatcggcaacggtagcaatagttcccgcccggaaaacgtaatccttgccaaatagttcttcggtatacttgtgagctcgaggctggtattccccggaaaagtttaaatcaatatccggaactttgtccccttcaaaacccataaaggtttcaaagggaatatcatgaccctcttttttgagaagagtaccacagcgcggacaatttttgtcgggcatatcggcaccgcagccgtaactgccatcggtaataaactcgctgtagcgacaattaggacaaaggtaatgggggggtagagggttaacctcggtaatcatcgtcatcgttgcaaccagcgaggaacctaccgaaccccgcgaacctacaagataaccatcatccaaagatttttttaccaacttatgggctattaaatacaatacggcaaacccgttattaataatagcatcaagctcccgctttaatcttttttccactatttccggaagcggatctccgtataactcatgagctctctggtaagtcatttcgtaaatctgccggtccgccccttcaattatcggcgggtaaaactcatcgggaattggtttaatctcttcaatttgttcggcaattttgcgcgggttgtccactaccacttcataggctttttcctggcctaaataagcaaattcttttaacatttcttcggtagttttaaggtaaatgggcggctgcagttcggcatcgtcatacccctgccctttttggagaatccggcggtaaatttcatcttccggctctaaaaaatgaacatcgccggtagccaccaccggtttatttaatttttctcccaaagcaatgattttccggttcaactcttccaattcctgttcgctctttaaacgctggtttctcaataaaaaggcattatttcctttaggcattatttcaaaataatcgtaaaaccgggcaatttctaaaatacggctctccggctgattttccagtaaagcggtaaaaagctcccctgcctcgcaggcagtacctatcagtaagccttcccggtagcgcatcagctcacttttggggatgcgggggtggcggtggaaatattttaaatgggataaggttattaaacggtaaagattgtaaagtccttcctgatttttcactaaaatcgaaacgtgataggttttagaccggtcgttaatgtagttgtagtttattttggccaggtcatccaagctataaagtccccgttcaaaaagcctgggcagtagctttaaaaagacttccgctaaagcatagctgtccgcaagagcccggtggtggttattaagggaaacttccaggtgttcggttatggtttttaacttgtgatttttcaactccggaaacagaatcctgaccagagccaaattatccaccaccgaaaattttcgttcatgtcccaatctctttaaagcttgtcgtaaaaacccgtaatcaaaagcagcattatgggccagcaggatgctgccatcgcaaaaacgcaggaatttttctatggcctcaccaaaatccagcccttccttttctaaaaggtcgttagtaataccggtaagttcggaaattttagcagaaataggtttttgcgggcgaatcagtacggaaaaagtctcctttatctctccgtcaaagattttaaccgctccaatttcaataatttcatctctttgcgaagatagaccggaggtttcaaagtcaaaagctactattggtgtttcctttaacgataaaggttcgggattaaaaactaccggcagtccatcatccaccagatacccttcaagtccgtagataactttaatcccgtattttgccgaaagttccgctgcttcaggaaaagcctgaacaacaccgtggtcggtaatagctaccgcctcatgcccccagctcttcaaagtttggaaaagcttttctaaatccactacgctatccattgcgctcatcttactgtgtaaatggagttcaattctcttggtttcagccaaatccatccggcccgcaggtttttctatttcctctaaatcatttataaataacaccagttcatcggcaaaacggtcaaactgcacttcgcccctgacctttacgtacatgccatctttgattaaagaagctttttcttcctccccttttttcaaaaacagtttggccgaaatggcatccgtttggtccgttaggttaaaagtaattaatatcctttccgtcttaagctttttcacttccaaatcaaagataactccactgaccaccacatttttttcctcttcggtgaggttggcaattttacagggagtttccttaatttcctttcctatggaaagtttaaccggaacctcctctttattttcctgcccttctctttccgccactttttcttcccaaagcttttgcaccaattcttcttccatttctaactgccagtccagtacttcatttgcttcttctttaaatttagcaataaacttataatccggagcgactttagccagaaatttcgtaattgtttccacaacttttttccgtttaatagtatcaaacactatttcattggcggtttcaaaaataatgttttcaccatcaaaggttaaacccgcttccctgagttcaccccgtaaacgcggtaatttttgcaccagtaaatagttaatatcttctaagagaagctcgatgtccgtatcgcgaaaattctccaccgctaaatcaatacttacgtttaaatccggaagttcttccaagattgctgcctttaagccatcaaattcttttaaagaaatataatggggagctttaaaataaagctcccatttttgatttcgggggtccacctgaactttatccaaaaacgctttttgccccaagctttccaggatagacttaattttgtccataaggcgttactccttttgcacctgaattactcccggaagattggctatttcctctatagccttataaacccggtttttatccggtcgcgaaagcattatgacaatttgtactttttggttcttctttttaataatctccacattatcaatattaagtccgtaacggccaaaagcttcggatactttggccagttgtcccggagtatcctccacaagaacagtaaccgtttcaccgctacggtaaatttctaaatatttttccaccttacctaagtacaataaggcaatgtaaactatgccggtggcaataactgctccaaaataaaagcccatgcccaccgccagaccaacgccgctaaccacccagaggctcgcagcggtggtaagaccgcgaattgttagaccctcccgtaatatagtcccggcgcccaggaaaccaatcccacttaccacctgagcagctaaacgggccgggtcagcattggccttaccgtaaaagtcaaaataaatttgttcggagagcagcatgattagagccgaacctacgcaaaccaaaatatgagtgcgaaagcctgcggatttaccgagactttcccgctcaagtcctattaagccccctaaaatacttgccaggatcaaccggataacaatctcaagctcgctcatcgtactgctcctctatttttaaagtttaattttactgccaaagctaaaaactatgtcccggtacatcttagctcttgctaccattccaggaattagccctaacttttcttccttcatcacatgggttaaatggggtaacggtacttcaattacttttatacccctcttcctggcatataaggtaagacttacctcaataccgtagcgaagctgttcgatgtcgtcattttccgcaaaaaactcttctaaaaaccacctttgaaaagctctttgacccgaaagaaagggagtaattttctgggcaaaatcggtagcaaaacggccctgattaaaaatacctaccgtcataactgcttcttcctttattaccggtagcaaaaggttaattacgtgccttgaagttaaattaactaaatcggcgtccaaaaaaacaataatatcaccgcgagaacttttaaaaccttctaaaagcgctgcaccttttccccgattttccccgagagaaataacatgagcttttaactggcgggcaataaccgctgttttgtcccttgagccatcatcgataacaataattttatcaatgagcgaaagcttttttaaacttgcaatcacccgcccgatatttttttcctcgttatacgctggaatcaacacctcaacggtcaaagagctttccccctataaagtttttaagagctgtcttaagccatccactaactcttctttttggaaaaccttttcttcccgggtccggcgaatttttacctcatataccccttcacttacggtccgtttaccaacggttatccggagcggaatgccaattaaatccgcatctttaaatttaaccccgggtcgctcgtccctgtcatctatcacaacctcaaagccagcgtttaataacaaattataaacttcctccgccattttcatttgctgttcgtccttattggaaaccggcaccacgattacttcaaagggagctatagccgccggccagataataccatcttcatcatggttttgctccactgctgccgccatagtccgggtaacgccaataccgtaacaacccataattatgggcttttgctgcccattttcatctaaataaaaggctcccattttcctgctgtatttatctttaagtttaaagatctgccccacttcaataccccgggcaaacaccagggcttttccgcatttaggacagggctctccttcttcaaccaaacggatgtccgcatattttaccgcgggcgaaaaatccctttcgggatttacgccggttaagtgataacccgtttcgtttgctccggtaaccgcatttaaaacatgttttacttccagatcggcaattaccggaatattcacccctaccggacctatcgagccgtattcggcccctaatacctcttccacttcctggggggaagcaagctctaaaaccaaacaatccacctgattcttgaccttaacttcattaacttcccggtcaccccgcactactgccagcacatacccatcatcggccttgaataacaccgattttaaaatttgttttttctcaacctttaaaaactcggctacttcgtctacagtttttacattgggagttgctactttctggatctccgcaggagttccgattacttcgggagtaaattttgtttccgctttttccaagttcgcggcatagccgcagttatcatctgggcaatagacgactaccgcttcgccggaattggccagcaccataaattcatgggtggtgctcccaccaatcgcaccggcatccgcttccaccgcccgaaactttaagccgcagcgggtaaatacattggtataagcttcgtacatcttgcggtaacttatttctaagccttcttcatcccggtcaaaagaataaagatctttcatgataaattcgcgcccgcgcatcaagccaaagcgaggtcttttttcgtcccggtacttattttgaatctggtaaagaagcaggggtaattctttataagaccttacttcccttcttaccaggtcggtaataatctcttcatgggtaggcccgaggcaaaaatcccggttgtgccggtcttttaatttaaaaagttccggaccgtaaacatgccagcggcccgtttccagccaaagttccgccggctgtaaaatcgggagcattaattcctggccgccctgccggtccatttcctcccggataatctgcatgatttttttaagaaccctctgggctaacggtaaatatgtataaacccccgatgccgatttgcggataaaacctgcccgcaacaaaagtttatgacttatcacttctgcttctgcaggattttctcttaaagtcggcataaagtactgggatagcctcattacacttcctcctccaactttttaatctcttcttttaatacttttaatatttcttcttccccaatttttctaacaacctttccctttttaaataataacgcttcaccccggccgccggcaattcctatgtctgcttcccgggcttcgccggggccattaaccacacagcccattaccgcaattttcaggggttttttgacgttttgagcaaacttctcaacttcccgggctattttaatgatatccacctgggtgcgcccgcaagttggacaggaaattacctcagctccgtactcccttaaacccagagcttttaaaatttgaaatcctatttttacctcttccaccggatccgccgtcagggaaacccgcaaggtatcaccaataccttcggccaaaagggccccgatcccaaccgccgatttaataatcccggtggagcggggtcccgcttcggttacgccaatatgaaacggatagtcaaccttcttagctaaaagtcggtaggctgccagcattaacggtatatccgatgcttttagcgatattttgataagatcaaagcccatgtcttccagaattcccacatgatggagagcgctttccaccatcgcttcaggggtaatacctccatacttctccacaagctttttttctaaagagccggcatttacccctatccggatgggaactcggcggtttttagcttcccgcacaataatccgaactttttcagcactcccgatatttccgggattcagtctaagaccgtgaacccccgcctccagagccattaacgccagcttataatcaaagtgaatatcggcaataaccggcagaggagatttttccacgattaattttaaggcccgggccgcttcctgatcgggaacggctacccgcaccagttcgcagccggcttttttcagtcttttaatttgtcttaaggttttttgccaatcccgggtatcggtattggtcattgactgcacggtaatcggtgcgtccccacccaccggcaccgttccaataaaaatggttttcgtttttcggcgcggaagtagcaatttaaccacctattagcgaaataatgtctttataagttataattagcatcagtaaaagcaaaagcccaaatccgattaaatgaataaagttttccttctccggatcgattggtttcccccgcagagcttcagctaaaacaaacataatccggctaccatccaaagccggtatgggaagcaagttaaaaatgccaaggttgatgctcaaaaaagcggccagctgaaccagggaactcagtccaaactgggcagcccggccaatctccgaaaccacccttaccggcccccccagctccattggagcctggtgaacaagcattttcccaagaaacactacaattaaagcaattattttaaaggtgtaaacaaaccccaggtacaaaccttcccatattggttttcgttcaatttcctgccggggaacaataccaatcttccctaacccctggtcatcggggcggggggtaactacgatggttttttccaggttttcccgtgtaattttaaaggttaacggtttaccgggacttttacttattatttccaccagctgttcccacgaagcaatcttagtttcgtttaccgctattattttatcgccgggcttaaatccagctgctgccgccggcatattgggctggaccttatcgatcaccgggaccgctttagggattccaaaggcgctaaaaaccagcgccaagagaaccaccgctaacagaaggttcattcccgaaccggcaaataacaccaaagcccgctgccagacggttgcttttgtaaaactgccccggtcgtcctcctcttcttccccttcttctaaatccatccctttcattttcacaaaaccgcccagaggaattaatcttaaactgtactgcgtttcctttttccgggttttggctaaaagcggaccaaaaccgatgctaaactctttaactacaatacccacttttttggccgctaaaaagtgaccaagttcgtgaatccaaattaaaagaaaaaagataactatcgaggcaaccgccgttatcactggtgttcaccacctataaattttcttgccagttcccttgcccgaaaatccacctctaaaatcgtctccaaatccatttttaccggtgaaaaacagtttaatactttttctacaatttgggcaatttccagaaacttaatttttcctgccaaaaatgcttcaacggcaatttcattggcagcatttaaaaccgccgggtaaatatttccggctttgccggcctggatagcaagtttgagagccggaaaacgttcatagtccggtttttcaaaagaaagaacgccaatttccgttaagttcaagcccggcaggttgttgggaaatctttcgggataagtcagggcatattgaatgggatgccgcatgtccggaagtcccagctgagccagaaccgagccatcataaaactccaccagcgaatggattaccgactgcgggtgaattaccggttcaattttttcatagggaatttggaacaaaaagtgcgcttcgattatttccaagcccttattcatcaaagtagccgaatcaatggtaatcttattgcccattttccagcgggggtgcttgagggcctccgccacggtgacattttttaattgttccaaggtgtattccctaaaaggtcccccggaagcagtgatgaggagtttcttcacccacgccaatttttctcctctaagagcctgaaaaatggccgaatgttcactatccaccggcaaaaggttttcccctaacttcatcaagggggtgatgatttctccagcagcaaccattgtttctttattggctaaataaattatttttcctgcttttaaagcctcaatggtaggaagcaaacagatggtaccgggaatcgccgtaatgatgccatcaacgccgggtagtaaagccaaattcagtagttctttgctaccggtagtaagaagtattccgtggtttttaaactcctggtaataagttttataactttcttcatcggctaaaaaagcatgcttaaccttaaagcgcaggcactgctctaacaaaagtttaccgtttttcgccgcagccaaggctaccacggaaaatttatcgggaaaaaactcgataacttctaaagactgccggccaatggagccggtacttcctaaaataacgagttttttcataattcctccatcactctattttttgtgaaagttaattatttccgcatcaattaaggctttaattattaaaagaataatcggacccgctgcaatacccaagacccccataagctttaaacctacgtacatagatattaacgttgctaaagggtctaaccccaggttttcggccactactttagcttcaaccactttccggaaagccgaaatggccaaataaagaatgagaatttcgaccgccatcaaatattttccctgaatcagcagtattcccgcccagggaaaaattatcaggcttgggcccacaatcggaaccagatccaagaatccaattattaaacccagggtaagggggtaagctgcgccaattaaataaaggccaaaaatggtaagaatcgttgataatcctactaaaatcgcctgggcttttaaaaatctaaaagcagcagcgatcgcttcctttaaaacatactcactcttttgccggtagtcttccggtagcacattaaaaactaaccgctggtactggggtaaatctttgctgaaaaaataagcagctattaaggcaatcagcaaaataataataaattcaggtacttgagccaggccaacaaaaatgctggtaaaaaagttctttcctacttccaccacttgatttaataacttttcggcattctgtttaatggaatcagcaagggtgggaggaagcttgcctaaaaaacggtttcccccggctatcataaaggtaatctggtccttgatattggtcagcatatccggtacgtaattggctaaccggtacaattcggtaacaagttttaccaaaaaagaagagataaccgttaaaaaaagtattaataatattgccagagaaatgcccgtaccaatagcccgcgtaagattaaatcttttctcaaaataacttaccattggctccaaaattatggcaatgagtatgccaataataaacggcaacaagtagagcaccgctattttatagataagccacaggcctaaaatcccggccagaagccccaataaataaaggccgtaccttttccaattttccataatccacccctaattaaataataagtaaagatagtaaaaaaccggagcagaaagcagtaccccatcaaatctatccagtatcccgccatgcccgggtaaaatctctcctgaatcttttactccagcaaaacgcttgatagccgattccaaaaaatcccccgcctgagctattaaagcagtaacaaaggcaagcggtaacaaagttaagctacctaaaacaaacctaccgtaaagaaacgcgatgaataaagctcccagtaaacctcccaaagccccctctacactttttttcgggcttaaagccggtgcaattttccgcctgccaaattttttacctacaaagtaggcaaaagtatcgttggcccagattagcaagaaataaaacaaaaacagtcgaaaacccaaaggggtgcttctaatttcataaataaaaatgaataaaaaaacatacattaaactggtataggtataaaaaaattccaagacactgtgcttttggtgttggaccaggtaataaatgcccgtagcgatgaaaaagaaataggggagaatttctctggaaaccaaatcaaaaaagccaagtaaaagtaaaacataggcaaggggaacataaagcttaagctctttcgttaaaaacattcggtaaagttcgtaaaaacctattaacgccattaaagcagttaaagccttgaggtaaaccccgcctaaatagccaactattaaaaatccgggcagtgcaacaagggcagtaataatccgataacttaacatcgataactttctccttacgggtaatttacgcctccaaagcgccgttcgcgtttttggtagtctttaattgcctgcagcagatgttcttcggaaaaatccggccataaaacatcggtaagccagatttcactgtaggcaatttgccagagaagaaaattactgatgcgaatttcccccgacggtcgaattaatagatcgggatcgggaaattctttggtgtagagatagttggcaaaaactttttcatctatctgctcaggcgataattttccattttttatctcgtaagcaattttcctggccgcttccacaatttctcttcggcccccgtaatttaaggccaaaatcagatttaagcggctgttatggcaggttttctctataccttgagctaaggcgatccgggctttttccggaagttcggaaatttctccaattaccgtgagcctaaccccttcccggtttagttcatcggtttctttttcaatatactccaccaaaaggttcatcagaacattaacttcttcttgtggacgccgccagttttccgtggaaaacgcatagagggtgaggtagggtacgtttagttttgcgcaaaactttaccacccgccggaccgtctctacaccggcccggtggccaaagtagcgcggcattcctcgttttttagcccaccgtccgttaccatccataataatagcaatatgccggggcattttcctaaaatcgagatcgcttatatctatttgattgttttttttgcgaaatatgctgaaatccatcgttcgcctccacgaaaagcttaaaccccatgtccattatctctttgtacttttatattatatcgtataaacttatttcataaaagacaatttccaattacttccccaaaaatgactaaaccccctctttttaagagggggtcttatgtttaaattactcttccacaatggcacctaccgggcaagcttcagcgcaagtcccgcagttctggcaagcatcggtgattttgtaaatatcaccttccacgatggcattatgggggcagctatccatgcaggtcccacaagccaggcactcctcggtaattctataagccatcgattgcacctcctttctcgtaatcggtaaaaccgattacgattcttccctcggtttctcccctttttatttgtaaaattcgagggtcaccctttggaaaatacttaccgggcggagaggtaataacgatctcccattttaaattttcctttaaaatttttcttagcccggcttcgcaatcaatacctaacagttcccgttccataactaaatgctcaatatctcatcttctttagcttttaagagctcatcaaccgtcttaataaacttatcggttagtttctggacttcatcctgaccgcgttttccttcatcttcggaaataactttatccttttctaagtccttaatcctgtcgttggcatcccgccgaatattgcgaattgccacccgcgcttcttcagctttcttcctggccaccttcaccagctcctgccggcgttcctgcgtaaggggaggaatagcaagccggattacacttccatcattggttggggttataccgagatccgatttaagaatagctttttcgatcgcccccaaagctcctttatcccagggttgtattaccagtaagcggggttcgggagcggaaatggtagccaattgattgaccggcatttgggtcccatagtactccacaactactttttctaacaaagccggagtagccctgccgacccgcatggtagcaaactcttttttcaaaacttcaatagccttttgcatgtggtcctgggcttcctttaaaatatcctgaatcacttgcgctcacccccaacaatggtgccaatattctcccctaaaatcacccgcttgatattccccgggacttcgagattaaaaacgatgagcggaatattattatccatacaaagggaggtagcggtggaatccattactcccaagccgcgatttagaacctcaatatactccaattcatcaaatttttgagcattgggatttttcaaggggtcagaatcatacacgccatcgactcttttcgccattaaaatgacttctgcctcaatttcggccgcgcgtaaagctgcggtggtatcggtggaaaaataaggattaccggtacccgccgcaaaaataactacccggcccttttccaggtggcgtatagcccgtcgccgaatataaggctcggcaatctgccgcatttcaatcgccgtttgcacccgggtatcaattccaagcttttccagcgcatcctgcagggccagagaatttatgaccgtagctaacattcccatataatcggcggtagccctatccatacctttggcacttccggaaagaccccgccagatattcccaccaccaacaaccacagcaacctgaattccaaactctttgataatctccgcaatttggccggctatcgagtttacaacctccggatcaattccgtaacctttttcaccggccaacgcttcaccgcttaactttaaaactacccttttatatttaggtgaaggcacgtttttacctccagttcctgacaatgataattctacaaatgtagaaaaaatcctgtaaaagttcacccttgtgaaaataattatttattaactttcattgctgcagctacttcggcagcaaaatcctcctcttttttggctaaaccttcgcccaattcaaagcgaacaaaacggcgaatgttgatattttcaccaatcttcgcaattttctcggtcagaagatctttgacggtaatatcgggatttttaatgaacggctgctctaaaagacaaacttctttaaagaacttttcaagacgaccttccaccattttttctaccacgttcgccggtttaccttcgtttaaggcctgtgcccttaaaatctcccgttctttttcaatgacttcctgcggtacatcttcccgtcttacatactcgggtttagctgcagcaatttgcatagcaatatcccgggcaaaagatttaaactcatcggttttcgccacaaaatcggtttcgcagttgatttcaaccagtacgccaatccgaccgccaccgtggatataagcttcaacaactccttcggtagcaatccggccagcttttttcgccgcagcggccaatcctttttgccgtaaaatttcaattgctttttccatatcaccgttagcttcctctaatgctctcttgcagtccatcatgccagcaccggttctttcccggagctctttaaccatttgtgaagttatcatttatgtacctcctttaatttttaatagtacccataaaaattatgcccgatagggcaaaatcttacaaccattttttgttcataaaaaaggtagggtttaatccctaccttttattccgcatattgctcgccttgacggccttcaattaccgcatcagcaattttggaagtaattaactttaccgcccggatagcatcgtcgttaccgggaattacgtaatccacctcatcgggatcgcagtttgtatccacgatagcaactacaggaatatccagtttccgggcttccgccacggcaattttttccttccgagggtcaaccacaaacagcgcatcgggtaactttttcatttccttgataccggacaaaaagcggcttaatttttccttttcctttaaaatttttgctacctcttttttcggaagtaccgacagcgcaccttcttgctccattttttcaatttcaataagcctttctacccgttttctgatggttttaaagttggtaagggtacctcccagccaccgctgatttacgtaaaacattccgcaacgttccgcttcttccttaatggcatcctgagcttgctttttcgttccaacaaataaaatcgtaccaccctgtgccgacaattctctaacaaaactataagcttcctctaattttttggcggttttctgcaggtcaatgatgtaaatcccgttccggtcggtaaagatatactccgccattttggggttccagcgccgggtttgatgaccaaaatgaacccccgcttctaaaagttgcttcatggaaattacagccatttaagaatcctccttttggttttttcctccgcccggttcatccaggctaaagaccatcgctggcaccctttagccggtcgccgggagtgcgttttcgacaccggtaaagattgtatcacaatttatttttccctgcaaggagaaaattttttaattatttagtttttctaattcttcaaaaagatggtcgtttaacaccttaatgtaagtacctttcatccctaaggattttgattcaatgaccccggcactttcaaatttacgcagagcattgacaattaccgaacgggttattcccactctatcggcaattttgctggcaaccagcaggccttcgtccccttctaactcttcaaaaatatgcttaatggcatccaattcggagtaagaaagggtcgccagggcaatttggaccgcagctttcttccgggcttcttcttccactttctccgcctgggcccgcagaatttccataccgataaccgtagctccgtattcggccagaaccaaatcgccatcggtaaacgattcgtcaaacttggctaatactaaagtacctaaacgtaccccaccgccaacaatgggtacaacggtcattaccttgttctgggaaatgcattgtacatcctgaaagaaaacacaagcattagctttctggcagaagttagcatgggtttcggtaattttcaaaagaaaattttcattgtaatcttcgggaaaccgttcggtttcttccactacctgccgcataatatcgcaggtgaaatttttaaaaaaggcatgtcctaaaattttccctttccggctcacgatataaacattgcagttgatattttcggaaagaacctgggcaatttcctcaaaatctaccggatttcccgctgccttctgcaatatacgattgatgcttcgagttttttccaaaagtgttctcatcatgtttcctccttactaaagttaaaatatttgcaattataagatataccttgataaatcggaatcgtgaactatttcacttaacttatcctggacaaacttacggtcaattaccaccgtttgcccccacatctccggagcgttaaacgataaatcttccagaactttttctaaaatcgtgataagtcgccttgcaccaatattttcattccgttcgttaacagtataagccatttttgcaatttcttcaagggaatcttcagtaaatttcaaattaaccccttcggtcgctagcagctcaacatactgcttggtaagggcattttccggaacggtaaggatttttttaaaatcctccacggttaaactctttaattccacccgaatgggaaaacgcccctgcagttccggtattaaatccgaaggcttactcatatgaaaggcaccggccgcaataaataaaatatgatcggttttcaccggtccgtatttggttaaaaccgttgatccttccacaatgggcaggatatcccgctgcactcctccccgggaaacatcgggcccatgggtattgccggtggaagcgatcttgtcgatttcatccaaaaagacgatgccgtcttcctctgctcttttgatggcttcccgttgcacctcatccatatcaattaatttctgggcttcctgttgcgttaaaattttcagcgcttcttttaccgtaacccgccgttttttccgtcgaggaggaatcaggccacccaaaatatcctgaaagtttagccccatttcttcaatgccaccgacgccaaaaacctctaccatgggagttttttgctcttcaacctcaatttctaccatttcattatccaaaaaacccttctttattttatcctgaagttcccgccggcgataatttaattcatcataagcagggtccgttttggctgcatcctcccggatcccgccaaaaaacatttcaaaagggtttttgatattttccttcttgggattgggaatcataatttcggatagcctttctaccgctaaattataagctttatcctccaccattttaatcttttcttcccgcaccatcctgagggaagtctccaccaaatcccgaatcatcccttctacatcccggccaacataaccgacttcggtaaattttgtggcctcaacctttacgaaaggagctttaattaatttcgccagtctccgggctatttcggttttacccacaccggtaggcccgatcattaaaatatttttgggtattatttcatcctttaagtggggaggcaaaagctttcttcgatacctgtttcttaaggctaccgccaccgcttttttggccgcttcctgccctattatatatttatccaaatactcaactatttgccggggagttaaattttccaaattattcacctccaatggtctccaccgtaataaaatcattggtataaacacagatttcctgggcaatttttaaactttccatcactatttcccgggctgataaattggtatgattaattaaagcccgggccgccgctaaagcataatttcctcccgaacctatagctaaaactccgtcatccggctcgattacctctccggtaccggatattaacagtatcctttccctgtccgccaccagaagcatggcttccaggcggcgtaaaaatttatcggtgcgccaggtttttaccagttccaccgccgcccgggtaagattaccctgactttcctcaagttttttttcaaataaatcaaataaagtaaaagcatcggcaactgctccagcaaatccggccagaactttaccccggtataattttcttattttatttgcccgccgtttgataaccgtctgctgcccgaaagtaacctgaccgtcaccgccaatggctacttctccgccccgctttaccgccacaatcgtggttccctcaaacatcatttttctcctccctgcttcgcggatgggttctaaggtaaacctctcttaaccgctctttactgagatgggtataaatttcggtggtagacaagcgtttatgacccagtaattcctgcacggccctgatatccgctcccccctctaacagatgagttgcgtaactgtggcgaaaggtgtggggggttatttttcgattgagccccgcttttttaacaatctgcgaaatcaggtaacgaattccccgtactgttaagcccgcaccctgctgatttaggaacaacttttctgatttgggcttaaaagccggtcttcctgcttccaggtacaactttaaactatccaaggcgtattttcccagggggacaattcgctgtcttcgtcccttaccggtaacccgaacgtaaccctgggttaaatcaaggtcgtttaacgttaaacccgcaatttccccaattcttaaacctgctccgtaaaacagctccaaaagcgctctattgcgcaatcccgttggtgtggagttttcctggccttcaatcactttaaacacttcgtccacggttaaaacttccggcaatgttttgggaatcttgggaatttcaaggcttaacgctggattttctttgataaagccgcatcttttcaaaaaacggtaaaaggacctgagagcaaccatttttcgggctgccgttctccggctacgatttttcctcagaatgtctaccaaaaactgctttaaatccacttcatttaccgataaaaaactttttccctgtaaaaattcttgaaaatccaaaatatccctttcgtaagcggcaatggtattcggggaataatttctttcaagtaataaataatttaaaaaagctttaagctcctcagccattgaccgcaagccacctttttaaatcttttaaacttctttcagctaaaagcttatacctttcttttttgttttttatttttcggtccagaggttttaccaagccaaaatttactcccatcggctgaaagttttctaccggggcagtgtttaaataacggatgagcccgccaagcatggtggtttccggtaacggctcgggcattttcccaaacatcccggaagcggcaattccggcccaagccccggtagctatcgctgccacatacccttccccgccggttatctgaccggcaaaaaacaatcggggatattttttcaagtttaagtaaggagttaataaagcaggagagttgataaaggtatttttatgcatcactccaaagcgaataaattcggcattttccaaaccgggtatcaggcgaaaaacccggttttgttccttccaggtaagattggtttgaaaacccaccagattgtaataatcccccgctaaattttcccggcgtaattgaactaccgcatacggttcttttccggttcttggatcaataatccctttaggttttagagggccaaacctcaaagtatctttaccccttgaagcgattacttctattggcaggcaaccttcataataaatgtctttttcaaaaggttttaagggatgccgttcagcagtaatcaacgcttcataaaacctcagatactcttcttcattcattggagcatttaagtagtccttatcctgctggtaccgcccggcaaaaaacaatttttccatatccaagctttcaccggcgacaataggagcaaccgcatcaaaaaagtaaaggtaatcgctttcaaggtatttttttaaattctcagctaaagcttttgaggttaagggacccgaagcaattaccgtaactctttcggggttaatatccacaacctcttcccgtataacttctattaatgggtggtgggaaagccttaaggttacttcttccgcaaataaatttcggtcaacggccaaagcattgcctgcgggaatccggtttcgatcagccacctttataacaaggctatctaaaaaccgtaactcctctttcaataagcccgctgcattgtctaaatttataccccctaaagaattactgcacactaattcggcaaaaaggggagtttggtgcgccggagtaaattttttcgggcgcatttcaaataaccgtactttaattccccttttggccaactgccaggcagcttcagcaccggcaagcccggccccaaccacatcaacttctttcattgtacttcctccaacggctctgtatgcttacaatcagggttggtacagagaaggtacggtggctttttcttcggtcgtttttctaccataacactttgacaattgggacattttttgctgctgggcaggtcccagctaacaaagtcacaggacggataattggaacagccgtagaaaactcgtcccttctttgattttttaactatgatttcaccaccgcaccggggacaggtagcaccggttttttgcacaaaaggtttaataaatttacactccggataacccgggcaagccaaaaacttgccaaagcgactggttctgactactaagtttcttccacaattagggcatttttcctccgtttcctccagcggcaggataattttttcaattttttcgtaagattgccgcaaagtttcattaaacggttcgtaaaaatttcttaaaacctcaatccaatttttttctccttcttcaatctggtcaagtttttcttccatttcagcggtaaattccacatcaataatgtcaggaaaatgttcctttagtaaatctacaactatccggccaagttcggtaggttttaattgcttcttatctttttccacgtagcctcgctttaatatagtctccaagatgggcgcataagtactcggccgcccaattcccttttcttctaaagctttaattaaagtagcttcggtataccgcggcggaggctcggtaaaatgctgctttggctcaagcttcagtaaggttaagctttgcccttccattaaagcaggtaacttctccttttcctctttttccccttcctcttcttcaacctgatagattttggtaaaccccggaaatcttaggattgatcccgtcgccctaaataaataatctcccgcttcaatatctaccgtagttacgtcatactgagcatcgctcatttgactggccacaaaccgttcccagattaatttataaagtttatactgatcgggtgttaaatattgtttaatcttttccggatctttttctatatccgtaggccggatggcttcatgggcatcctgaattttccccttcggggctttggtctttttctcagttcctacatattcttccccaaaagtatttttaatatatgctgctgcttttgctttcgcttcttccgctacccgggtagaatcagttcttatatatgttactaaaccggtaactccgtattcaccgatttccagtccctcgtaaagagcctgggcaatttgcatggtttttttggccgaaaagtttaaccgttttgacgcttcctgctgcaaggtactggtaataaaaggctccggagcagattttttggtgagctttttcgtgattttaacaactttaaaatccctttgcgaaacttcagcaataatccgctccacttcatctttattttttatttctattttgcgattctggtatttagaaagctttgctttaaatggtttcttttccgcttcaagatgagccgttaaactccagtattcctccggtacaaatttttcaatttcttcttcccgctcacaaataagcctaaccgctaccgactgtacccgcccggccgataatccttttttgatttttcgccaaagcaggggacttaatttataaccgacaatccggtctaagatcctccgggcttgctgggcgtatacccggttgtaatctatcccccggggattggctattgcctgcaaaaccgcatccttggtaatttcgttaaattcgattctaaggtctccattatcttctaaatccaatacttcctttacgtgccaggcaatggcttccccttcccggtccgggtcagaagctatgtagaccttttccgccttggccgcttcttcttttaattcttttataagctcttttttaccccggattatttcgtaggtaggagcaaaatccttttcaatatttactccaaaccgataggtgggtaagtcccggatgtgtcccatggaagcttttaccacatattctttgcccaaaaattttccgatagttttagcttttgctggagactcaactattaccaattttttcaaaccaaaatcacctcaacccctggtaaacttacctccaaactgttttttcacaaagccttttatttccaggaaggaaatttctcttaatacctccgaaacacgggcatttaagcgataagctatctcttccacggttaaatcctcatttactaaaacttctaaaatttttccggcaagaccgaaagcttcttgctttgacctctgggcagcaaaactattactaaataacgtgccaaagccaagctcttcaataacctccgttccttttaaagcaattctggccccatcttttaataaaagattactgccagcacttaaaggagaagttatcatccccggaacagcaaatacttctcttcctaactcaagggcaatcctggcggttatcaagcttccgctcttcaacgcggcttccactacaacgataccttcggccagagcggcaatcaggcggttacggatgggaaaaagataaggtaagggcatcgtccccggtaaaaactccgagatgattaatcctttttgtattatttcccggtaaaggttttcattttcccgggggtaaggtacatcaatccccgaacctaaaaccgccaccgttgctcccgcacttaccgccccccggtgtgcttcaccatcgataccccgggccaggccgcttatcaccgtgatccccgccccggctatttcttcggcaaaagctctggcaacttttaagccgtaggatgaagcacgcctcgctcctacaatcccgaccatgggtgtttttaaaagctccaggttaccccagcaaaataacaccaccggtgggtcgtacaggtgtaataaccgctcaggataccgcttctccccaaaggttacaatctttatccccaggtttgagcagtgctcctttacccgttcgggattaaattcggaaattttccgggtaaggctattaatttccgtgggcgaaaagccaaactcctttaatgtttttaccggattaactacaatttcttctaccgggatgccttctttaatcaagtgaaaaagtttttggttataatatacagaagctaaggttaaataataatcactgttttgcaaaaaatcaaccccaaaaatatttttaacttaccttactttactttaaaatatttttctaaatttttctataacctttttaaagaagttttaataaatcttctaaagaatactgcctggaaaataagtcccagacctctccatcttttttaagtcgatgaggaatagttttaatgttaaagtccaggggattaatcttaccgctctttatttcttcccaggtaagaggtgtggaaacccccgctccggcaaaagctcgaatactatagggcaaaataatcgttttaccgtagcgattgtggctgtaatccaggtggacttttccttccctttcagcccggtaatcctgcagggaaaccctttgcgggtgagctttttccaccagacttccgataaatttagcaatgctaaccagagtttcgtttttataacgcggaaccaccggtactaaaatatgcaagcccattaatccagaagtcttcggataaccctccaatccatacgaattaaggacttcccgaattaatagggcaacttccacacactcctgaaatccggaaggaggaaaaggatcaaggtcaaaaagcaacaaatcgggaaatctttcctgcccggcttttgctaaaaggccgtgcatttcaatgcaaccctgctcaattagccacttcaaagtaggaaaatcttcgaccaataaactggttttttcattaattcttttttcataataaaccaaagcagcaggagcatgggcaagttttccccgcacgtaataactttccctgccaaccccttcgggataaaatttgacaaaaaagggccgtccctgcatgtacggccgtaaatattcccaggttttactgtaataagcaataatttcatcaagataaattccttcgggataaactaagtctcttaccacgatcccaccttctttttttgtataatttacccggaaaactaatgataatacaaaaaatcgtgcagctcaagccacacgattttgcaggtagttactaaaagccaataaattgtattttcccggtttttctcggcggcaccggaggattttgatcgggataccccagtaccaccgcacacacaaattccttatcggtaacccccaaaaagcgatcaatctcatcggccacatacctggggccggtcatccagcacgtccccagccctcgttcataagccaaaagcattaaattttccaccagggccgagacgctcatgatggcttcgatcctattttcttcattataatggcgttcataaccactcattagatggttaactgaaaattcgtatttgggaatgtaaaacaaaataattaccggcgcgtcaccaacattttcaaaaaactgcagggtaatttttacaatcttttccggaaaaagttcttctaattttggtttaatgtgcttacctgattcagcaataagcctggcaagctcatcccgcttttccccaccaaccacgtaaatttcccagggctggcggtttttcccggaaggcgcccagagtgccgcttctaaaagctcttccaccacttcccgcggcaccgggtcttttttaaactttctaatacttcttctcccctttaaaatttcttttaactccatcttccccctccttaaaaattccggactaaatccggatttagttccttatacggtcgcagggcacatcgcagggacagtttctcttgctatctttcagcgccggttctcctttaatggttttaatcaagcttaataattctactacctcatcctcatttccttctacaataaacgtttttcccccttcggctccccctatgccaccgctacctactaccacaacctcaatgttgggaaataaaagctttaaagcagatatttcggtaaaaatttccccatcaccaatgacggtataaccgaatttttgccctaaagctttatcaattgtataaattcctgttaattcggctgctttccgcaccgaaggcaccattttctccaaaccaacgggaataataagccgtatcccccgggcgcgaataagcgggtatgcccggcctatggtccctccccgggaatcggaagtaatgattccggcaaatccttccgcatcgatagcattggcaccttttaaaaacacatcatcccgtcccattttttcgagggcatcctgccagctaagctctgatacctggccccgttccagcaccaccggtggaattcttcgacccgggtcggttacgcactgtcctttgggcgttattacccccgccgtataccactcccgttcaatttccctaccggttaattcttccacgatataaccattagttgttcctccggcaatcaccacaatcccttccttaaaagcttttgctaccgccggatgttttttaataccttttgcaatcaacctcttcccttcagccaccgttaaggaaaaagcagctctcatttagctcacccccatttgattaatagcttccagaatccggttaaaattattgggatcttttttaatttcgcccttttcttccaagtttttaaatccaacaatcctaaactcctcaacttctaaaacattatttaagtacttcaaggtaatctccgccccggtaaatacggtgttaaaattagtaccggcggtcagtaaatacaggccttttcgccttttttgctgcatttctgactgctttaaaaggtacttttgcgcccagtaaggctgcaaccggtctattatagctttggcctgagcgcaaagccccatggcataaattggagatgctataaccaagtaattaatttgcggaagtaactcataaatttctgccatgtcatccttttgcacgcatcggccgtcccggctgcataaattacacccaaggcaaggattgatttttttgcgggaagtgtttaagaaaactccatctcctttagcctttaagagggtttccacataccgggcagcagtatcgctattgccacctatccgtggactggtagaaagaattaaatacttaagggagttcgccacggccatctcccttcttttcgctcaccacatagtaattttcacaaatttccaggggacgtctttttacccgaaaaaccctctttttcctcaattctattccctcctcgctaaaaccctcttatctccaacacgccgggtaatttttagctggtctaaagtttctaataacggcaaagcgtatttacgggaaataccaaggagttctcgcacatcggcaattacaatttcttttttttctaataaaagctttttaattttggccatagcctcttcaaaatgttcgcgggctaaatatatttcttcgtcaatcttaattaattccccttgctccacaagataatttattaactccagcgccaaatcttctttgaggttaaagcccggtaaaacagcactaagattttccggcatcagggaagcttttttaaagtagtttaaaatattctccttggctttttccagttccgctgttaatctcggtacgtaatcaattaaagctactttatttccgcttacctttaattcttttttctcttcggcaatttccagaaaagaagtaaactctcttaacgaaaactcattaaaaagtttactcttcagttcgtctttagaaacccctgctctaagaggatattggtgatgataactctgtaaaaactcttttgttttagctaaaattttagcataattatccgccgcaaagtacagtttttcccccgagcggtaaactttattggcggcaattagctgatttaagctctcttcgaccaccctcgccgccaacgtagttttttgttcaattaccttttgttctaagggttttaagctatttaaaagaacgtttaaaactaaggcagaaggttcccctttttctttaaccttcaagctttccattacgtcctcgcgaaaacgcttgtatttccttgccgggtaagggtccaggatctctccaccaccaatagttaccataggcgaataggagcgaatgataaaccggtcaaagcggtcggctactaccggctcctctaacatgagctgggcataagtttcccctcccggctctaattcttcccggtctaaaagcagtacccttcccagccgttccgccgttcccaggtaaaaacgtatctgctgtcggtggcgaacgggcttttcttgcgaagcaagaaccgtaaacttaacgtcaagcaaccgggtgggttttaatacgccaatggtaacaacccaatctccccgttcaatatcttttacctctacatccgctaaattgatcgccaccctctgcccggcaaaagccctttccactttttgcccgtggacctgcaggtttctaatctttttggtaagcccgcgggggagaatttctaccgtttcgcccaccgcaagttcccccgaccagagggtaccggtaacgaccgttccaaatcccgctatggtaaaaacccggtcaataggaagccgggcatagtgcgaccgggatttttcctcgacctcttccgcgacccggtcaatttccgcaagtaaagtagaaatcccttcaccggtaattgatgatacggggataatgggagccttttcgagaaaacttcctttgacaaattctttgatatcttcaattacaagatttaaccagtcttcatccactaaatctttcttcgttactaccacgatacctttttttatctgtaaaagctttaaaatatccatatgctcccgggtttggggcataataccctcatcggcagcaataactaaaagcaccatgtcaaaccccataaccccggccagcatatttttaataaaccgctcatgccccggaacatcaacaatcccggcttttttccccgaagggagcgtcaggtgagcaaaaccaagttcgatggaaattccccgttttttctcttcctttaagcggtcggtatcaattcccgtaagcctttttatcagttccgtttttccgtggtctacatggccagcggttccaatgatgaagtatttcattgccggtcacccaccagatgtttttccagtaagcgtttgcagtaatctatttcttcctccaataccgtccttaaatcgataataaatttttcttcctcaattcttcccaaaagggcaggattttcctcccgtaaagcttttgccagtttttccaccgaaaggtgatgggggttaatttttatcacataagaagataggtaggttccgggaaaagctcccccacctacttccgatttgccttcatccagagaaatttccgcaggtaatttggcccttaagagtttgcgataaagcttttgcgcccgctttttaatcttttcgggcggttcggttaacatccgtaataccgggattttcgagagaaaatctctttcaaagtaaagcattaaagttgcctgcaaagctgctacggtcattttatcaatccgaatagcccgggtaagaggatgttttttcattttggcaacaaactctttcttgccagcaataatccccgcttgcgggccacccaaaagcttatctccggaaaaagtaactacatccacccccgccgccagaacttcctgcaccgttggttcgtacggtaatccgtaagaggttaaatccaccaaactgccgcttcccaagtcccacattaccggaattcccttttcttttccaagcttcaccaaatcggcaatttccaccgattcggtaaaaccaattattttgtaattgctggtatgcacccctaataaaaggccggtgttctcgttaattgccttccggtaatcgtcaatccgggttttattggtggtaccaacttcttttaaaattgccccgcttctttccattatttccggtatcctaaaggctccgccgatttccaccagttggccccgggaaactatcacctctttcccaaaagccatactgcttaaagctaataccaccgccgaagcattattgttcaccaccagtgcatcctcggctccggttaactcacagaggtattccaccacgtggtcgtaacgggagcccctttttccggtggttaaatccagctccaagttgccgtaactgcccgagaccttacgtaaggcttctaccgcctccggggccagaggagcccggcccaggttggtatgtaaaaccacaccggtaccgttgaccacccgccggtagggaggtagaaaaaagctttcaatctttctttgagctaagttaacaacctcctgaaattccagcggcttttgccgctggccagagactataccggttctgagctcatctaaaacctcgcgcactttccgggtaataatctcccgctgataacggtttaaatagtcctgaagttccggagcttttagaatctcatctaccttgggtatggagcgcagtaatttttccaatgccatcggctcactcctcataaacttccaaaatttcgtaatgggtgttgcgtttggccggtatgaaccctgcttcccggatagtttttattatttcgttcattggtatgcggtaggttacccccgctgcccggaccacattttcctcaagcatagtagagccaaaatcgttggttccaaaatacaaagctaattgcgctattttggccccttgagtaacccaggaagcttgaatgttgggaaaattatcgagataaatccgggaaatagcaaccgtctttaagtagtccatccctccagctggcaaaagatgggctaatgctgtattggccggctgaaacgaccagggtataaaagcagtaaatccgcgggttttatcctgaagctgccgcaaattttccaggtgaataatcctgtcttcgtaattttccacatgcccgaacatcatcgttgctgtagtcttcatccccaggctatgggctgcttccatcacttccagccattccgccgcggaaattttattgggactaattaccttccgcacccggtcggataatatttccgctccccctccgggtaaagattgcagtccgctttcttttagttgctttaagacttcaaccacgcttaagccctcttttttagccaggtacataatttccggcggcgaaagggaatggatttgtaccgttggaaatcttttctttatctgagaaaacaagtttttaaagtactccagccctaaatcgggatgggtccctccctgcattaataactgagttccgcccaggttaaccagctcttcaattttggcaaagatttcttctaaggtcagaacgtaaccttccggatgaccgggaggacgataaaaagcacaaaatttgcaggccgtcgagcagatattggtataatttacattccggtcaaccacaaaagtaacaatattttccgggtgatgacggcggcggacaaggttggcaagtcgccccaagttgtacaaatctccctgttcaaacagtaaaactccttcggcaaaagttatcctttcccccgcttctattttggcgtaaattttttttacatccaatcgtcttccctccaaatcttaaccaaaacccctgccggcgcttcgcctattttagaagcccgacggtaaaactccaaaagaccagaaaactccctctcggatagttcatgggaaataatttttaaatacccgtcaatttcctcaggagtaaaaggatatttttggctgccaaattcaaccatttcttgccagtgagcatacgagtaatttttagcctgaaaaaacagttcggttaactttttaattttatgaggctctttctggcaggtctcccggtggaccgcccacaccgcataaaccatgggtagtccggtaagttttttaaaagcttcgcctaagtccaacacctctaaattttggggcaaatgataataacctgctaaagctttatcaccaattaaaagcactccgtctaaatcggtcttgcggtaaaattcaatgtccaaattcatgggtacgtattgagggtcggctccaaaaagttcttttaagattatttttaatagtactaccgatgttgccgactccctggttacaccaactttttttatgttttgaagccttccggaaaattcctgccggtaaaaaaacatcacgcttaataccgggccatcggcggcaatggaaagatcaggtaaaattaaaaggtcttgatagtttctggcgtactcaatggaggaaatgggagttacatctaactgatgttttaaaaaaagttgatttaactcggccgggggacctgaaaaaagctcagcctccgcaaaaccatttttctcaaaaggataatataagggtaagcagtttaagtagcttacccgtccaagccttaatttcattcaaaatcctcccgtaccacattgtaaagagtatctctttctaccggttgtcttcccgcttcccgtataaggtgcaggatttcctttttggtcatggcttgagaggtggtagccccggcagcatgggtaatccgctcttctaccaccgtaccatcaatatcgtccactccgaaggaaagggaaatctgagcaagttttggtcccaccatgatccagaaagctttaatatggtcaaaattatcgagcattaagcggctgatagctaacatttttaagtcttctacgccagtagtgagggttttaatttcaccctctaacccggtgtttttaggatgaaacgccaaaggaataaacgacataaaaccgccggtttcatcctgaagttctcttaacttaattaaatgcataagtctttcttcaacggtttcgatatgtccgtaaagcatggtggcattacttctaagcccgagtttatgggcggttctcatgacttccagccagcgttcgccggaaatttttttctcgcaaattttctttcgcaccctctcggaaaaaacttccgcacccccgccgggtaacgaacccagcccggcattttttaaaattgtcagcacttcctccaaagacttcccggaaatacgagaaaagtagtcaatttccaccgccgtaaaagcctgaatgtgcactccaggtagggctctggaaaccctctccaccatctccacgtaaaaatcaaaaggcaaatcgggatgaagaccacctacaatgtgaatttcacttatcccatcatctttggattctaaagcccgcgcttcaatttcgtcaaggctcatctggtaagcttccggagagtctttgtccaccccaaaagcacaaagtttgcagcggttaacgcagatattggtgggattgatatggcggtttacaataaaataagctttattgccattttttctttcccggacgatattggcaagataaccaatccctataaggtcggaggaattaaaaagggttagcccgtcttcaaaggaaagccgttcacccttctccactttatcgtaaattttttctaaatttttatcggcaaaagcaaacatccttccactccctttttaaattagtaaatcgataacggtaacaccgaacattaagacgctgataatcatatttacattgttaaaagccgtattaacccttgataaatcggtaggcttgaccagccagtgctcgtataataaaagaatagcggtggcaataacaccaaaataataaaaaaacccaaggccaaaaccaatgccggccagtaaaaagaagatgatagttagaaagtgaaatacccgggcaatcgttagagccttttctatcccaaacctgctgggtatggagtataacccctgctgccggtcaaactccacatcctgaagagcgtagataatatcaaaacctgccacccaaaataacaccccggcagctaaaaagtaagccggtagcggaatataaccttcaatccccacaaagcttccgagcggagcaaaggacagggccagacctaaaacaaggtggcatgcccaggtaaatcttttagtataagcataaattaccagaacaaataaagcaaggggaagaagctttaatgctaacggctttaaattggctgccgcccaaaaaaagagcaataacgaaagtatcgtgtaaatatatacttccgacacttttataagcccccggggcagggcccggttttgggttcgggggtttaaggcatctatatgccggtcaatcaaccggtttaaactcattgcggcagtccgggcaccaaccatagccaaagtaataaaaagaaaatctcttagcctcggtacacccccggaagccaaaaatgctcctacataagcataaggtagggcaaagagtgtatgttcaaacctgatcatttcaagaaagatcttaattttagtcaaggccgaggtcactccacttccggtccactaaagccttaatctctggatccatttcgatgtcatcaggccagggtcgggtgtgaccttcggaaggccattttttggtagcatcaatgccaagctttgaaccgtaattgggcagaggagatgcgtgatccaaaatatccaggggtccttcaacaatcattaagtcccgcttcgcatcaatattgttaaatactttccacattacttccgaaaggttttgtacattaacattttcatcaacaacaattatcattttggtaaacatcatctgccccaagccccataaagcattcatcactttacgggcatgaccgggataacgttttctaatcgagacaattgcgcaattatggaagaccccttccaggggaagatttatatcaacaatttccggcagcagcagctttaaaaaaggcaaaaagattcgttcggtggcttttgccatataacagtcttccatcggtggtttgcccacaattgttgccgggtaaatgggattctttctgtgggtaatggctgtaacatgaaataccggataataatcggttaagctgtaataaccggtatggtccccgaaaggcccttctaatcgcagttcatcgggatcaacgtaaccttcaataacaatctccgcatgtgccggaacttccaaatctaccgtctccgctttaaccaattccaccggttctttccgaataaaaccggcaaaaagaaattcatcaattgacggtggcagaggagctgtcgccgcataaatggttgccggatctccgcccaaagctaccgcaacttctaaaggcttgcccaggcgcttggccttctggtaaaagtgcgccgcatctttatgcatatgccagtgcatcccggtagtcctgccgtcataaatttgcatccggtacatgcccacatttcttcttccggtttccgggtctttggtaatgactaacggtaaagttataaaccttccaccatcctgcggccagcattttaatattggaaatttatttaaatcggggttatccttgataattacttcctttaccggaccactttttacaatcttaggtgcaaaatttgacaacctggcaagcttcggtaacattttcagcttttcaaacatggtaaccgggatatcatcgggatttaaaaggcttaaaaactcttctccgatatcatccaaacggtcaaccccaagagccaatttcatgcgctcataggagccaaaagcattcatcaataccgggatatcgtaacccgaaacgttttcaaataaaagagccggtccataagcctttgacacccggtcggtaatttcggttatctccaattccggtgacaccggaactttgatccttttaagctccccccgcttttcaagttctgctatgaactctcgcaaatcccgaaacgccatcaattactacccccaatcttatgtagttttttcaaatggtttggtaccaacatgaaccgccactattccgccggtaagctcgtagcattttacatccaccaaacctaaatcctcgaacatctttttaatgacctgctggtgtggaaaattttttaccgagttgggcaggtaagaataaggaccgtccacccccacccccaatttccctaaaagcggcaccaatttttcaaagtaaaaccagtacagttgtttaaacacggggaaggtcggatgggcaagttctaaattcacaaccctgcctccgggttttactacccttttcatttccaatattgttttttcaatatccggcacatttcttaaagcaaaaccaatagttgccacatcaaagctgttgtccggaaaaggtaaagctaaggcattaccgtgaactaacttaattattttttccatggagtacctggcaatatttttcctggcaacttcaagcatgttttcgttaaaatcaagtcctacgacttctcctgtcgggccaactacccgcgctaattcaatagcaaacattcccgtgccgcaggccacatctaaaccccttcccccggccgataagcccgataccttaaccgcgaaccgccgccaggctttatcccggttaaaacttaaaacggtatttaataaatcataccgatgggcaattgccgaaaaaatattataaacaagttcttcttttgaagtttggcgggaatcgttcaaaatttactaccccttccttttatgataaaatgtcgtttttatcgataaattctttaagttttattaaaccgtcaaagccttcatcctcaatgttacaaagaaactcgccaattttttctccaaaggtaataagttcttgcagggtatctttgggtacatcagctaaatctcccaggatagccagactctgacccataaaaattcgctcgtctttatatttatcttcctccgaaaaaattaaagcagcttcatttaaatcaagaattaacctggccagagaacttaagtattgtaaaagtcccgctttggccagctccaaaaaaaagttaccgtacataaaatcgcccactaacacctgatactggattctttgcctttccccgtgatattcttcttcaccaatctgccggtgaatttcatgggctagataaatataagagaatatttcggctaattttactaatttttcccattcaatccccagcctttgccccatcagtaaccaaactaaaattctttttctaacagcagtcatttccttaatctcgggcaaaatttccccgtattgttccacgttacttcgaagttttttggcaattacctccgttatttccgctgccactttattaagttccctttcaacaacactcatttacaggcctccccaaaataatccacacttatactattattctttattttatcccattttcctgttagctttcttaaaattattggaaatcatcatttttaaaataaataagccctacataccttctccggcatgtaaggctcgctaaccgtgtttaaaacacgtactaataaaaatccctcctataaattgacggcttgactctcggcaaactcttcaaccatgacgccccgcttcgtttccttagccgtcatgtactttgccccaaactcctttgccaggtaatttgttgcatcccagggatctaccgtatccccgcaggtaaatacatcaacagcagcataacctaactcaggccaggtatgaattgcaagatgggactcagaaatgaccaccacaccgctaaccccttgcggactaaacttatggaaagctacctctctaatttcagcacctgcttccaaagcacttctgaccatgatttcttcaactcttttgacatcatttaaaacgtcaaacccgcagccgtaaagctcggcaatcacatgacggcctaaagcattcatcggcacttcctcctttaaaaataatttgttgggaactataacccccttttgtatacatgggctttattcaatcaaattaaattttagcacataaatccccgttgtcaataaaaaaatagagattttctaaattaatttcatttaattttggttaattctttattatccttaaaaatttttaagatttcatggctttttctatactttcacaaaatttctcaggcttccaatggccgaaatctttacctcaaccgtgtctccttcagcaagtttaccaacaccgctgggggttcccgttaaaattacatctccaggctttaaagtcatgactttagaaataaaacttaccaaaaaatagggatgaaacagcattttagaagtattactcttttgccggagttccccattcaaataagtttctatctcaaggtggtcaggctcaatatcggtaacaatccacggtccaagagggcaaaaagtatcgaacgattttccccgcgtccactgtccatccttccgctgtaagtcccgggcggtaacatcattggcacaggtataacctaagatgaaatcccttgcttcttcttcctttagatttcgcccttcctttttaatcaccaccgccagttctccttcgtagtccacccgccgactttcttgaggtaatattatcacgtctaaaggaccaattaccgcggtaggcggttttagaaaaatcaccggttcttccggcaactggtgtttaaattcgtcaatatggtcccggtagtttaaacctacacagataattttcgacggtaataccgggggtagtaatttgacctctgaaagcggaagtaattttccgctggaattaatctcgccgaaaatatctccatttaaaatttctaccttatcatcattaattttcacgtacttatcctgccccgctattacggctctacctaaaatcatttttctccctcccgtacaaataataatacttgatataaaagcggcaaggcgctgtaattcatagtagtagccgccgctacaattcccgaatcattaaaaataagagcagccacgcttgctactaaaatggcgactaatcctttgtaaaatatcggcatttccgtttttattttgttcatgtaaccaagaggccggtaaaaggaaaaggccagagccagtaagcttgtcaaaaacaccctgctccagatagtgtatttaataagttttatattcattgccaccttgcggattataatccccgttaaaaccgaaagaccacctgcccttacttcctgtatagcccttgccacgtgggattgagctttagtgcttaaaaaagcatcgtaagtataaactgctattaaacctgccattaccgctcctagcaatatcaacacgtttcgtacattaaaacggatgtttaaaaatagcgccagaaaaacggtaaaaccaaacaatgccgttagagctcccccaaagtttgctccataggaaggagaggaaataagcaaataaacggcaagaaaaacaaacgaatataaaacgtaagctttctttttcaagcgcgtaccgtaatggcttgctaaatataaagtaacccctaccaaaatccccatatactcgttgccgatcccgtaataccgggcgccggccatcgggtcgtagccaagaaccgaccggcggattaactcctggtgatttaaaaggtcaaaaatcaacgaagcaaaggtaattattccgataaccgcaaagctatctattcccagaagtttatttaaaagttttgccagtaccaccaaagctaaatttaaaagcaccgcaattaaaaagtttaaaatgaggttattggtgtagaaaagggaaagccataaaaaagttaaaggtaccgtaaataaaaacaaaagggcaagatccagtcctttaacttttttgtaatacaggccaaaaagtccgtaaagaagcgtaataattaaaacggtaatataacttttaactaacggtggtcgtaagttgtaagtaattaatatctggttatgataatctttcaggaaatttaacgcatttgccttgctaattccctgcaccgaacggccaaaaacctctaccggtggtttaataccgtaaaaagtcaagatagttgcggtgagatccaaattggtaattaaaccgggtctttttgtggtgccggaggtaagtaacccgggaccaaacccccggccccaggccaccgcaaagcccaggtaatctttctttgccagcatatccctgctgggatagggagtaaaaataataagggcatcttttttaggatttaactttgaaagtatctttcctaaaaaagcatcgacttccttaaaaactttcgtcttctggcgttttatttcccggtcaaaaagtaagtttttaaaataatcaactcgggcaatatcccctgtttcaatgaccacgagatccgaacttcgccaattgtccgttacaaaagtataaatcttatcataatcacttctcaaacctccgggaaaatcctggtccttttttaatacttcccggtttaccaatcccaaaggggtaacaccggttttatccatggttaaaagagtaatttcccggaaatactcctttccggcatcggcattacccactaccagcgtttttaatccccgtttttttaactcttcacctattaagccaattttaaacggatattttaacgaactgctttcccgttccgcttccaccgcacccaggttaacaaccgcttccccggaaggttccttcccaaaaaaggtacgatataaagcaaatccttcctggccatcgtactgttctccgtaattaaacgcaagtctacccgtttcccctccgcgaaggtgggcaccgctaccgatggtaagataagcatttacgctatttagaccaccaccggtattattattcattaacgccacactaccttccttaaaaacccgctcaaagtttggataccggccaagctccgttaattcctcaaaagataacccatccagagaaattaacaccaatttccccggggaaccggcaaaggccaaagaaggaaacaacactactgcaataatcagtaaaattatgtaaaatactttttttctcatttaagtaaccccctgtaaatctcctcgtttcgctgggccatgtgcgctacgttgtatttctcccttatcgtgatataagccctttctccaagacttaaacgaaaattttcattaaaaattaacgtgtaaagcgcttcagttaaagccgtagcatccttggggggaactaataaaccattttccccggaattaatgacttccggaattcccccaacgttggtggcaattacggctaacttccagctcattgcttcgagaagggataagggtagtccttcggaaatggacggtaaaacaaaaatatcaatttcccggtaaaattcagcgggattgggaatgtatccgggaaaggtaaccaggctttcaatccccagctcttttgctaactctttcagctcattttttaaagggccatcaccgccaatgatcgcccgaaataccactcccctgttacttagaagggctaaggcttttaaaagataatttaaacccttttgcggggcaaaacgggctaaggtacctattaccaccggctggtggggatttgtttttatctcttccggaatctccaccccattaggaattacggtaattttttctgccaaaaccccatgctttaagattaattctttctttaaattttcactgaccgcaattactttatgggtataaaatttggttaaaaagcgctcaatgagcgaagcaataattcttttaaaagccgctacattttcatgccagatggagttatgtacggtataaaccaccggcaccccagccaaaaaagcagccattcttcccgccagtgccgctttaaaaccatggcagtgaactatccggtacccttcttttttaataatgcggtaaagggaatagcaggcttttaaatccccttttaaggaaattcctgcaggaattgctacggaatagtaggttactcccaggtcttttaaggttttttgctcagcttcggttaactcgccggcaaaaccaaaagcaaagtcaccgcttttcttttgcagcagggaaaaaacatgcttttttattccccccgccgatggccgcatcacctgtaaaactttaaccttcccgctcaaccagatcacccttttcaaaaactcccccgagtctttccggcaaagaagaatacctggtttcttccttaatattttccaccgcctgccgtaaagcccagggagttcctatgacaataagcattttcttggccctggttacagcagtataaagaagatttctcttaagtaaaggataatggtaattatgtaaaacaagaataaccaccggatattccattccctgagctttatgaacggtagtcgcataagacaacgtcagctcttctaaatccgttttccgatattttatgtttttgccgtcaaaagaaacaatgatttcttcttcatccccggatttaataatttttttgataaacccggtttcgccgttaaataccccatcttctccccgttcgtaattattttttatctgcatgaccttatcgttcactttaaaagaagtaccgaaaaattttacttcctgtgtttcaaaaccgttaaacagtttttgcagtaaaacatttaaattttctacccctaaagcgcccttccgcataggagataaaacggcaatatcttccggagaatacccgtaattttcccagagctttttaaccacctttaaaagaagattagtaatattttccgtatctttcgccggaagaaaaaacacatcctccaatattcttctcccaaggagccgctcaagttcagaccaatccccggttaatacccggtgggcaacctcaataattcctgcatcttctccctgacgaaaaaccgttttcaggcttatccgcggaatttcttccacggctaaaagatctttcaacaattgcccgggacccaccgggggcaactgattgggatctcccaccagtaccagccggcattcaggggttatagcctcaaataaagcagcagctaaaggtaaatcaagcatggaaacttcatcaattattattaaatcgtagggtaaaggttcgtatttgttatagcgaaaaagcagttctcccgaacgggtttccccctccggttctaaaagacggtgaattgtcgccgccggcatcccggtgctttcggaaagccttttcgccgcgcgcccggtaggcgccgccagagcaattttgtttttaggaaaaaacctctgatacagctcaataaatcctttgattaccgtggttttaccggtaccaggacccccggttaaaataaaaagttttttctcggcaaacattaacgatagagcttccttttgtaatgggtcgtaggaaattcccagttttttttctacctcgttcagaggcttctttatattaatttttttatcggtaatcgttaaaagaaaggctactttccgcgccaccgttttttccgcatcataaagctttttcaaataaagccggtccctttccaggcacacttctccggttcttaaaagtacggaaagcccctcgtcgagggtctcaggcccaatcccttcccccagaagagccagccctttgttatacacttctgccaaaggtaaataaacatgtccctgctccagagcttcctttaacacataaacgatagaagctttaatccggtaaaggtggttcgggggaaaatgccaatcttttgccagcttatcaaagggtgcaaaggcaaaaccgtaaagttcatgaatgggtttgtaaggattctcttttaagtgctctattaaactttcccggtaaaatttgagcagggttttaatttgatgcggttccaagtttagcggagctaataaattaaaagcttcttcgaaaagatactcttcttttaatttctggtacaggctttccgctttttcaaaggaaatgcctcttatttttgttagctgggaaaaatcttttaggataacggtcagggagtccataccaaatctttcaacaattttcgctgccgttttttccccaattcccttaacccctaagttagacaggtacgagattaactgttccggagaatttggtctttccctttcgtagtatttaacctgaaactgcaaaccgtaattggggttattgacaaactttcccgaaacccggtaccgttcgcctacccggcagttaattatttcccctaaaatatcaataatttccccctgccgttctccttctaaaattttagctccggcaataataaagttttcccgggagaattttatatattttacttctacattaattgtctcttccaaaagaaaattcctggtcatatttttcccttcaatttataatgatttagcataattttactacaattttaaaaaagaaaaaaccccggcatgagccggagttttttctcttagccaaggatagcttttaagtcttcgtcgggagtagtgataagctttaatccaaacttttcgtttaagatggccagtaaattaggtgttaggaaagcaggagcagtcgggccaatacgaatattcttgactccaaggtagaggagtgataagagaattgccacagccttttgttcaaaccaggatagaatcaggctaagcggcaggtcgtttactccaaccttgaaggcttcggctaaggctaaggcaatttttactgccgagtaggagttgttgcactgcccgatatcgaggagccgcggaataccggtaccttcgatttcaccaaagtccttgtggatgaaacgatatttaccgcaagccaaggtcaggataatggagtctttgggtactttatcggcaatttcgttgtagtagttccgggtggtcttagctccgtcgcaaccgccaattaagaagaagtgcttgatcttgccggacttaaccccttcaattatcgtatcggccaagcttaatactgcggtgtggtggaaaccggtagtaatgtaacctccttctttctcttcagccgggggaagttctaaagccttcttaataacctcggagaagtcgcgattggcgatatgttttactccgggcagatgagctaccccgcaggtaaacatccggtccttataagaatccttgggaattaaaacgcagttggtggttgcgagaattactcccgggaattcttcaaactctttcttctggttctgccaggcggtaccataattacctaccaagtgggggaatttctttaactcgggataagcatgggccgggagcatctccccatgggtgtaaacattaattccggtaccttcggtttgctttaaaagctcatacaaatctaaaaggtcgtgcccggtaaccagaatagccggaccttttttaatccccgtgtaaacttttgtcggcacagggttgccaaacttttctgtatgagctttatccagaagctccataattttaaggttcatttccccggcttttaacaccatttgcagatggtggtcaaggtcaaaatctacgttggtcagggtagtaaagagagcttcatgcataaaggcatctacttccggatcatgagctcccaactcccgcgcatggtaagcataagcagcaataccttttaagccaaagataagtaagtcctgaagtgcggcaagatcttcatttttcccgcaaactccaacaggcccaacacagcctttcccttgagcagtttgctcgcactggtaacaaaacatcaataaacccctcctgtgaaaatagtttttcgcccaccggctactttaaattttaaagataaaggaggggcaattctgttaaattcgtcacagttttgtcatgaaatttattaaattaagtggattactcggatatttcacttcaagttttccgggttcagtccttcaagttccggtaaaacaaatactccatcttttctaatcaacacaccatcaaaataaatctcaccgccaccgtattccggagtttgaattaaaacaaggtcccagtgcaccgccgatttgttgccgttaaaagcttcatcgtaactggaaccgggagtaaagtggatgctccccataattttttcatcaaacaacgtatctttcatcggcttagttatgtaaggatttacccctatcgcaaattccccgaaatatcttgctccggcatcggtatctaaaattttgttcagcttttcggtattgttggccgtggcttcaactatcctgccatcttttaccacaaagcgcacattttcaaaggtatagccctggtataccgaaggggtattgtaagtaataactccatttaccgactctttcaccggagcagtgtaaacttcaccatcgggaatgttgcgatggccgtcgcatttcaccgccggaatgccttttatcgaaaaagttatgtcagtgcccggaccggttattcgcaccttatccgttttgttcattaagtcaattaaagcatccatcgctttggacattttgctgtagtcaaggttgcaaacattaaaataaaagtcggtaaacgcctcattgctcattccagcaagctgggccatagaagcattgggataacgcagtaccacccatttagttttgggtaccctaacttccccgtggaccggatgccaccagtcccgttgataagcctgaattttttcctcggggacatcggaaagctcggcgatattgtctccggcccgaattccaatgtaggcatccatttgttccattagcgatttttccatttcccgattaatcttgataacttcctcatcggcttctaaaagaatttcccgcaaaatttcctggttttttaaaaggacaaaaggttttgccccaaccttataagcctcgcgaattaaagctttggtcaggggaagttctggacctatgttttcaattaaaattttctcaccgggtttaagggctgtagaatagtgaattaaattctgggcaagttttataaagcgtggatccaagaaaaaacctcctttcttcttttcgtctctttatatcttattcctttttcgttttagcatcaataaaagcacagggacccgttgcacacattccgcaaatttctaccggattggcatcggaaaaagcttccccgcatttaacgcaccaggcgtagcatttctgccggtcaaaagcattattatcatcttttaacgcctttaccgggcaaatgtcccggcagtaggtacagcccttagaacgccagcactgaagataaggttcaatagcaggagttggtgtaatttcggcatcggtgacaaaagacccaaagcggccgccactacccagggaagtaattaaaaggttgttcatcccaaaagtgccaagaccagcaatgtaggctacatgtttatgcgaccagacggcttttaaaacttttttatcaaactggtaggttggcatgagtccttcagctttaaagccgtaattttttaattcttcctttattttctggattattttccaaaggaggcgattagttttaatataagctttggcccaaagctccgatggataaatgccatttttgttactttcgataatttcccgggtatacggcaagaaaatggcaactaccgttttagccccgggcaatagctcatcaggcagcaaatgagccggattggccacctcttttaatttcaaaaaaaggggattttgagcttcggcataaccaattagcggcttacggtaataaaatgaactttcctcttctaactccacctgttcaaaaacaatcttctcaattaactgttgcaaattatccccccttttttttggtattttaacatcttttttatttaagtaaaataaattaaaataaaaacataaaactcatctcaaatcaaaggagataattatgggagcaatctgggatttaattttacatcttgataaaaatttagaccttctgcttcagcggtttggcaccgaaacctattttattttatttcttatcgtttttctggaaaccgggcttgtggtaactccttttcttcccggcgattcgctcctttttgcagcaggagctttatctgcactgggaagtttaaatatttacctggtaatgttaattttcatttttgccgcagtgcttggtaatacttcaaactattttatcgccaggttctttagtaatgccgttctgaataaaaaaaatcttaagtttataaaacaagagcacttactaaaaacccagaggttttacgaaaaatatggaccagtgaccattgttctggcccgttttgtccctatagttcgtacctttgctccttttgtcgcaggtattggccggatgaatttttttaagttcagtctctacaacctaattggagcttttctctgggtgttcctcttaaccttagcaggatattacttcggtaatattcccgtaattaaagataatttttcacttgtagtgatagctataattttaatctcaatccttcccggattaatatcatttataaaaaaaggaaagtagcgtccggaagggcaaaggtctatcgccagggctatttcctccgccttgaatgggcatttggtaagaaatcttttctaaaacctttaattgcttttcatttaaaacttcgtaaaacaccgcatttcctcctcagacaggttaaaatatgcctgccagaaacgagcagttttgcgggtaagattgcgactttttttaactgcttcttttatcatagtttcatcataattttcctttaaccaaaaaagcgcctgatgatctccgtaatttaaaatccgctcgatgacaaatcgcttatgtttttccaaatcaatttcatctatatttacatcccagaaatatattttaaagcgctcaggtattgtttttttcatcttatcacccgattacattttaccataattttactaaataagaaaatcaaaaacctgccgcgttcaggcaggttttaactttcttgaaatatacggccagaagaatttgattaaactgcggccaacagatattgcttacaaaactactgcgtgtttttaggattgcacaaccaaagaatattttgcctttggatgaagccaaaaaaattcatctggaaggtgagtaagctacaatttgcacatctactcgaataaaaatgctcatttttcataagtttgtgttaaggacaccttgtcgataactgcgagggtagcttaaaaagggggttagagagcaggattggagataaaagcaccatttagccctaatcctgctcctttagcaagatttaaatccccaaccccctgcgtctttccttaataactgcaaccagtttagcagcagccagttccggattggtttcaacaataaaataaccgcccagcaaatctttcgctttttcagttaaaaactcaacaactacagaggaacccataatttgcggtacaattccaatatgggttggtattcctaaagttactgcccaggtcccaatggctactgccttctccgacataaactcaggagcagaagcaacaagaggtagtttgtctaaatcaactcctaatttgttagctatggccactgcgacattaactgccctgctattatcaacacaagaacccatgtgcaatactaaaggtagaggtccattaagcccggctgcctttcctaaggcagttaatactgcctttaaggattcaccggcataagcctcggttgcctcctgggtcattagaccatttttcgcaaaagccccggctccacaaccggttgccagcatcaagacgttatttttagccagctctttagcaatggttataaagctattgtcgtgaattgccttaggattgttacaaccggcaaataaggcaatgccctgaatgttgccgttaataatattgtcaattaagggttttaacgggtcattagcatttaacttgcttaaaaccgccatgattgcctcggcactgaacccggtaatggctgtttgcttgcagtcaggaatgttaacttttcgtttatcccgttttttaaaggcctcaattgccacttctacgattttcttagcgctttctacggccgagtcttcccgaaactcgatgtgagttgcgccggtgattttattttcagccatagtggtaattatttcagtatggaaacactcagccacgctggtaagagcaggcataatgcactgcacatctacgaccatagcatctaacgcaccggtaatgatggccatttcctgagacagatagttcgtagctaaaggaatcccgcgccgcatcatcacctcattaccggtacagcaaatacccactacgttaataccttctttggccccggctttctttgcttcttcattcatttttaaagcgacatcacaaataatttcactaagtaaagggttgtgaccgtgaactgcgatgttgacagcatcttccttcagcaccccaaggttggcttgagtaattaccggtttaggggtaccaaatatgacatcagacaactcggttgacaaacacataccggtataatcagccagtgctccctttattccgccgagcaaaaggttgacagcatcggcatcacaacccacatgagtccggcccataatctcggtgataactgcatcgatattatggggcataacccccagttctgctaatttgtccacccgctcagcggtcaaggtttctttggcccagttacagggtacgttacgcttttgccgtgaataatcatccagggaagctaaagccacttctttagctacttgtcttatatctttgcctgccggtgccaggtttaatttttccgctatctttcttaacttttgctcgtctttaatccggtacgcaggtgcatgtccttcgccaacttctaataaagtcaaagctatgtgccggccgtgttcggaatgagcagcagcaccggcagcaatcattctaatcaaatttcgcgcaacaatggtatgggcatcagccccacaaacccctctctggggtccattgccaaatggatcgatacgacaaggtcccttccaacaaatgcggcagcagacgcccagttctccgaaaccacattgaggctgcattgcttcataacggtcccaagcagtttcaattcccgcttttttggctataggtaacaaataatcgaccgcaggatctacggaatttttccaattactcatcaaatcactccccgcatctttccgagttaagctttaattacggaataagccctaacaagttctttacctctttcctcaataagtttcttacgatagctttcgtaatccaccagcattatcgccttggtgggacaagcttcaacgcaggcacaggaaacttccttgttgtcctgctttctgctgtagcaaagatcacattttctggccttaccatttttggttctacgattaccttcatccttttcctcttgtgctataataattgctccaaaaggacaaaccatggtacaaactttacagccaatacaattaccctcattgattctaacaaacttatcttcctggtaaattgctccggtcggacaggcatgggcacaaggagcatcctcacattgtctacattgaataggcattaccataccaccgacctgaaccaccgaattccttggctttaatttcaaccccctggttacagccgtagtcaagtcacaattggcatgggccaaagcacaggctatctcacaatttttacatcccaaacactttcgagggtcggcgtaaataaagtaattctcgttagctgttgccatatggttcaactcctttcattaatgtatattaatttgaaatagacaaaactttttacgcaataaagctaacaaggaatcccgcaaaatacagggcccgcggactttttgaaagatactacatttctacttctaaattttcaatataaagttccctaccggccacaatgtccacagccctgttttcacactgcgggcattgaaaattgaaattggaaatcccaaacacatggttacactcccgacattttcccatcagtggaactcgctcgataaccaactccgcaccctcggcaacggtattttgcgcataaactttaaaacacgcagttaaggtcataggttccaccactgtcatctcgccaaccttaagctttacttttaaaattttttttatttgatgctcttttactttggcatcgataatctgaaaaagactatccactatagccatttcatgcatggtaccgcatccttttttatattatctttcggtgcaggaaatacagggatcaatactattaataatgaggggaatgtcagccactttattacccggcatcataaccttaagcgcttcccagttcatataagttggtacccgccacttaatgcgttccggaatatctgaaccgttggtgcgcagataataaatcaattctccccgcggagcctcggacctggctaccgcctctcctgcgggaatttccggcaaatagtctatacacgttggaccgtccggaagctcttttagacaatgttgaacaatattgatagcttcctgaatttctctcaacctaaccagggctcttgctttaacatcacaaccagtttctaactgaacattaaccttgagcttgtcgtaagcagcatacgggctctttacccgaacatcattatttatacctgacccccgggctacaggcccaaccaccccatagcggagagcttcatctttaggtaatatccctactccttcagtccgagcccgaacaaatttattgttcatataaatacgggtaatttcttctaaaggcttcttcaggttgtctaactgtctcgccagatatttaatcttttcctccgacaggtcatatcttacgccgccaatacagttagcagccaggtccattcgattcccgtaaatagtctcttttatatcctggactatctcccgtaactccataacatgcatgaataatgagtcaaagccaatgatatgagccatcatagcaatattaaacaaatgggaagctatcctttttatttcatctgctataacccgtaaatattcggccctttccggaatttgaataccggcaattttctccagggccatgcagtaggtaaagggatggttattggagcacaaagaacaaaccctttcaagcaaagttaaattttgatatatattacgtttcattgccagatactcgataccccggtgcacatgccctgccgttaactccagacctacaatagtctctccctctacctcaacccggaaatacatcggctcttccagggccacatgtagcggacctacggggattgtataagtgctcatttaacctctccctcctgggaagtagccgctaagaccttttcccacaaagttttactggtagctccctgcatagcaattgataaagggataaagtcattcattattccctcatcaatagtatcatcgaggaataatctctttggattgggatggccgactactttaataccatataattcttgtaattcgcgttccgtccaatcggcactttttaaaatcggggttatggaattaactttaccactatctccgggtacttcaatggtaaccgtacaggtacagccatccaggtcaaaatggtaagcaatctcatggctatccctttgttggtcatctttcgttttataagctgtgatagtaattacccgacctcccaaacttgccactatcaaagccacagtggtaatatggcggtggtcgtggagcctgcaccaaccagtaacaactcctttagaatctctctcccaacgcaaagaaaattctgcccccaacgcccgggtcagtttttctgtaaattcctcctgaatattccgtaccatcttcttacctcccttcctcagcggagagctcgtttttggcggcatttagggcataaatgcctcaatatttcaatttccttgtttacgttctcataagctcgctgcaataattcaggagaaattggtaccataggtgtaccacatccggcacaatttacatattttatgaatcctttttccacatatctgtatttatcctcttgccggtgagcggtatgataatcttccgttaaacgaattgctttggtagggcagtaatattcgcaaaggccacagaaggtacaggtattatgccacaggatgaactcaaggccacttttatcagccacttcccggatttgaatggctcctccggcacacacatgctcacacatcctgcaggcaatacaagccccggcattatatttggcctttccccgcagtcccttcggaacaaaggtttccccaaagggatatgggtcggttgttggactcttgaataaattacgcagggcgatttttaaaaacgaagacatgggtaactcccctttacaacctggtttcccaaattttgatagcttcgataatcccgtcaataatcgcctggggtctgggaggacagcccggtacattgacatctaccggaataaagttatcaatagggccggtaatggcataactatctctaaatacccctccagatatgggacatactccaatggctaccgtcacttttggctcaggaatttcctcgtaaaggcgcaaaaccttttccttaacccgggcagtaagaggcccagtaattaaaactatatccgcatgttttgggctaccacaatatttacaacccaagcgttccacgtcataacgagggatacaggctgtggttgccagctccacgtcacagccattacaggatcccgcattaatgcggtataaccagggtgattttttcgcaattttttgcagaatctttttcatccggacacccccctacccttttactaacgttaaaatcaagctgattaatgccagtactgtgggatacttgagataaaatttaaaggcctgatctatccgtactcttcccgtactggagcgaataattgtaatagaaataaacaataagattaaacattttaacaaaaaccacaccaggttaagcaaaaggttttcactcagaggggttggaaaaaagagcgctatacctaaacccagtaccactaccatttttagggcgttggttagcttaaataaagccagccaactcccggaatattccagaatagggccttcaacaatttccgtttccgcctctggaatatcaaaaggaacaactcctatagtaccggggataaaaaccagaaaagctaaaagagccggtaacatggtgtaatcaaacagtaaagctccgttttccacttggtactggacaattttacttaaagaaaaggtggcaataccgccggttgctaatccaacctttaaagcaacggtcaccaggactatcagtaacggcaactcataagccatcatcatgaccatttcccgcgaggaacctatagccccaaagggtgaactggaggccgaacctccgactatcaaggcaatagccggcaaggacaacaaataaagtaaaaccagcaaatctcccgcaaagttcaaacctggataaacccccgcaacagggatcagggttactgctaccagcatcccagcaaaccctaacaacggcgctaacctgaaagccggcaggtgtgccgtctcgggcacaaccacctccttcagggttaatttggccaggtcaataaagggctggtaaagaggtggccccacccgtctctgggcgcgggcaacaattttgcggtcaattcccatcagaagcaaaccaaggactaaagcaaacaggccaccgggaaagagcaggaaattaaaaattaaatgaccgatatccgtcacaatcacacccccttacccaaaccggcaacccggtgtaaaaacttaatccatcccttaattaaccctttgggagactcatagagattatgcgaattaacatgtacctcttcgggagttaaagtagttaccccgcaggtatagattttggtatagcggattttcccattgcccacaaaataaatactaaggccaacaataaaggcaattaccataaacaccgcaataattccggcattccaggtaccaaggccggaatcaatcccgaaaagggtaactgaaaccggtgtcagccccaacgacctttcgatggcagcaatagtagcaagtggtatccccgggaaaatcccaaataccatacataaaacagctaaaatcaccataggaatttgcattgtccagggtgcttcagttacgttctccaattccttaggtatttgtccaaaaaaggcagaatgtaaaaatttaaggaacgaagccagggtcaaaacacttgctaacaaagataataacgctaaaaatacatatcccttctccatggacgcttcatagattagccatttagatgtaaaaccattaaaaggcggaataccggcaatagagaatgtcccaatcgcaaagacactgagagttaccggcatttttcggcctattcctcctaacctgtccagatcccctataccggttttcaccataatggcaccggcaaccaagaaaagcaggttcttaaacagcatatggttaactaaatgcaataatcctccggccagacctaaagaagagcccaggcttattcccaagatgatataacccatctgacttaccgtatgataaataagcaggcgtttcataccactttgcagcaaagccaatgccgcagccattaaaatcgttaagccgctcacccaggcaaggatgtacatgaggcttggcatatctccaagctggcccagcttgcttaaaagagcaacgcctccaaatacataaaataacttaaccatcccaaaaggcgcactttttaaaagcaccgaagaaatataaccgctcaccggtgttggggcggtaggaggatgcatctgataatcgatgcggaaaggtaacatcgcagctttcatggcaaaaccaatcaacattaagattaagccaagagccaccagacctgtgggcagggcacttaaccgcccggccagctcactcatttcaaaggtgccggcgttaactgttaatacaagtagtcccagaagcagcaaattggctccaacgtaattaaagatgaagtacttgaacccttcccgcaatgcctcgctggtttcctcatgaataatcacaaagtacaatgtccagctgctcatgatttcccagaaagcgaagaaattgaagagatccttacttaccgctacacccaaaaggccgccaatcattaaggtaaagaacaggtaaaagcgattttgggcatgttcatgttccatatatcccagggaataaagtaaatttaaaacaccaataaaggcgatgaggaaagcaaaactccgggaaaatatgtccaggccagtggatgccgcaaaaactgtggcaagcgttgctaccatagttgcaactgctaaccaaccgctaactttaaccgaacgtcttccgaaaaagtaagcaaagagagcccccaccatcggaattagcgtaactattggccaggagatggtaattttaggaatagccgttacggccatatgtccgttagccgcaattaaatcggcaaccggcttaattaaagccagacccgcttgcggatatacgccattaaaaatggacaaacccgttaaaatcacaattggtatcaacatggtaatcggggcttcctgccgggccggcccctcatacttttcaaagaaaataattctaaccactttcaggtaataaaaaccaccaaggatactgcctaaaaggattaaacctgccagtgccagatgaccggattggaccagagcgtacagcattaaaaatttactgataaacccgttgaagggcggcaaacccattatggctaagatcccgatactaaaacataaagacgttaccggcattactcggccgatacctttaagcttattaatctcctgactttttacgcgcaagattaaagcaccaacagccaggaataacagatttttcataatagcatgatttaagatatggtaaagggcaccgataaaactcaaataagtccctactcccagagtaattactatctcccctacctgggccatcgttgaataggccagcattttcttcacatcggtctgtagcagggccataatttcgccgtacaaaagggtaaacgctccaagcagggagattataaacccaattgtggaaaattgaccggtagtacctactttagtcagtaaacttaccccaaaaaccacaaaaaggatgcggacaagtccgtaaataccggttttggtcaaaatccctgacattggggctgaaatagacgaaggcgccaccgggtgagcatccggcaaccagctatgcagcggcaccaagcctgctttgaccccaaagccaataataaacattcctaaaaccactaacataagaccgggagataaaacctgtaaatttgcagaaattgtcgtcagatctaaagatccaagttttacatgcaacgttaaaattgccaaaagcataatataagctccggaggtacacataataaaatatttaaaaccggcacgcagagctttttgagtttgctcttgaataaccaaaaagtaagaagtccaggtcattaattcccagaagacataaaaattccccagctccttgctggtggttaaaccgagcaaagtacccaacattaacagtaaaaagaagaagtaacggtttgcatacggtttagctttaaaataacccaccgagtaaagggtaaccaagaaaccgataaaagccataagcaaagcgaaaaatttagataaactatcaaagttaccggcaagccaggtcaaataaaccgttgtgccggtaataccaaccgccaggatattacgtaaggcctgggaaaaacagcctgcaagatagacgataaatccacccacatagggaacgagaactaaggaagaccagggagattcaaagacaggcaattggtccgggcctgtaccccctaacaatacggcagcagcacgttcagcaccgtgaatgaaaggttccggaattaagcccattaaagcggtaagaacgcccaaaaccagtaaaactgccattaaacccggagaagtttccctgacttcttcggcaccgggtccttcctggaccggatcttcaaagcacagtatttgaaagacctgaaggaaatacactgcctcaatgatactaccaaaggtagctattgccgctgacaaccaatgcccactctcaatagcagcataaataattaaaaatttactaatagaacctttaaagggagataaacccatcacagaaaacaatccaaaaccaaacaaggttgtcgtaaccggcatttttctacctataccttgaagcttttccacgcttgcagaatgaccccgaaaaataaatgccgctgcagctaaaaagactaatcctctcattacaatttgatattccaaatgcaagagagctcccgaagtccccacataggtacccgtgcccaatcccaaaagtacgaaacctatttccgcaatgcttgaaataattagaaattgaattaagtttttccaccgcagtagggcaaccagttccccaaccaaaagaagcattaccccaaacaaggcctgcagcgagaggccattaattaaaaaacctaaatccacatttctttcctcctccctgcattgtgattgtgcattttttcacaagaaaggaaccctttcttttcctaatcttcaatcgccctatttacaaaaagataaaaaactttctcctaaaaatttttaccgctggcttgcactttttaactaacaattctgccttttcacttcttccaataagcgctctttaatactatgacctatggcaacgatttcgggagcttgttcaaatacgcttacccctgataaatccgctaaaattaatgtcggatcgtaaggaatgaaacctaaaatcggtaaaaagttcagttcttttcgaattatttcctcatctcctgggcgcaccttgttagccactgcaaaaatcttagtaacccctaaatctctggccaatgttactaccgctcttgctgtctgaaaactccgcttacccggttcaactacaactatgaaagcgtctaccccttcagccgtaccgcgccctaaatgctccaaacccgcttccatatcaacaatcacggtttcgtccgcctttaaaaccaggtgacggagaagatgcttaagtaaaacactttccggacaggcacatcccgaaccacctctgactactttacccatttgcatcaaccggatgccggcgtgctctaccacatatttttctggaatatcatcaacccgcggattcaggataaagtactgacctgatgttcccggttcagcaccggtccgctctttgataagctctttatcctcggaaatagccgtcaatttttctaagacctccgtcggaaatcctaaagctgtgcccaagttggcatcagggtcggcatccacagccagtactcttttcccctcacgggcaaaaatatgactgagcaatgcagacagtgttgtttttcctacaccacccttaccggaaacagcaattttcagtcccttttcagacacctgcatccactccctgacatttaagtaatatccttaatgaacagcttttgaaacgttctaaaatttacgctaattttactatagcgaagagttaaaaaaaaaactgtcgtttatccgacagttttagaaaaaatcagccattcatttttagtctcgcttcctaactaaacgcctgaggaaaactcctttaatttttgtaaatctttaagcaatagcgttcgctgattcactctttctaaaatccccatttttttgaaatcattgagaagaaccgaaaccgtttgacgggtagtccctaacatcaaagcaatttcttctgtatttaaaccaagctctaattttattccctgcggtacctttaaccctgtatccattgccgcttgaactaaaaattctgcaagtctcaagcgagcatctttaaaaaccaagccattaattatggtaagggagtttttaagtaaatcccccaatactttaaccatatttaaactaaatgccgggaactcgacaacaatattttggaagttacggatatcggtatacaatatagttgtatcttccattgcctggataaaagccctggtatgggtgcagaaaatatcacctgcttccaaaatggctaaggtaaattccttatcctcataggcaagataaacccttaccctcccggacttaactaaaaacaccaggtttctctcggtattcggtgtatagagaattgccttttttgaataccgctgttcccgaaactcttttaagaccccagagtattcctccgaattcaggacctccaacaagttagtgtcggttaatctcatttgggtggccatagtccagcccccttagcttttgttgctaatatttactggtggcttctacggacattataccagattcaatttgccttacaaagcatagcaattatatgtaatgctatgtaaacttaaaatttcgaaaagtaaaactcagtgcaaataagcggaaaagccataagagacctcaccctccttcaacgcaaagtactgcctggtgaggtctctttttcttcttctctttccctttttcctgcttccacctacttaaattctacacagccatgccgcgttcaggcaggtttagctttcttttgtaattttttcagctaaaagctctaacggatgatacaccggcaggccacttacattgttaagctgcactccgcacattccgcactcggtaacaagagcctcgggtgcctggcggtctatagccttttttagattttggccaatagcctcggttaccggctctttttctgcctttaagccgtaacttcccgaaaggccgcaacacccggcatccaacggcactactttattttccgtcacttcgtttaaaagttccaaacccggagttcctattcccgatgcttttaaatggcacggttcatgataagcatacttgccctctatcggctcaccctccaggaaatagttaatttcttgaagtccccttaaaaactcgccggcctcatagaaatacggcacaaactccctggcttcttcgattccaagtaaccctccgtactcttctttaaaagttaaaaggcagcttggacaggaaaacaatacgggaatcccatcctttacatattttttaagctggcttaaattaaaataagcaaattcttgagcagtatcaagtctaccatttcctatcgccggctgaccgcaacatttaaactccggaacgataacctcgtaattcaagcggtttaaaattttcaccagagcttccccaacttccggtttattatactcggtaaaacagcctggaaaatatacaaccttgtttttcggtttatttactttttgccggtaatgaccaaaccagcgggaaaaactcttgtgagcgtatgccggaaaagaaatatttgcggatattccaaaaagggttttgcctattaggcgaaagattttaatcttcgtaatgaagttcaccaaaccggcaaaatttaccgcaatccttccaagcaaacggggattggcaaaaagtttttcccttaatctaagtccttttttctttaatttttccgcccgggtaagctggtttaacgacgccaccggaactcccgagggacaggcaatttcacagtttttgcagttagaacagtactctattccttcggggtaatctactttcgtttcagcgtttaaagaaagtctgagccaatcggggccaaccgctttgggtccgggaaaatcaggatttaccttggctacaggacagttagcggtacaggtggaacatttggcacaatgatttagagtttccagagaaatatctttaagcatttctcctcacctccctatctcccaaagctaaaagccccgctttatagccggaagctaaagccaaccccagcccggaattattttttaaataattcgagtttgctaaaatacttcccgccgcataaagattttctaattccttaattggccgcaaatactcatcggtatatataccagaagctaaaaagttaaagtcttcggcaaagttccggggaagataaactttagactgaaagatgggctcacaaatttcctctttattagcccacaaacctttaccccagaaagacccggtcgctaacacaaaagctttaccagaaatctcccgtacccgtccgccagattctttaattttaattgaagttacttgccttaaatcttttttatatcctattacctcagcattaaagagaaaatttacccccatttcttttaaggtgctaaccaatgctttattgagcctttgaccgggaaaagacggtagtcccccggaaagctccactacccttactcccagtacatcctccatctctttaaaaagcctatcttccggtaaatctcccaaaactgccggaaagaccattaaagttttcggcccggcataaggttttaaaaaagctataagcttttccttcaggttccctctggctaaggcctgggcaagccaggtagtattaacggttatggtgccggtttcaaagtaaacttcctcggtttcttttaaaccgggaaatattccgctttttttagcgtaataaagaaacattttaggagaaaaatcgaaataacccttgaagccaaccgctataattcgctcataactttcaggattttccagaaacatgctttccggaacaaggcaggagttctttaccgttccaagggtcgttaaaattctggtctgctcagaaggtgaacctacataatttaatccacaccttttgactaagcccttaaaaaagctaaagctctcctctaccacatcttgtactttaaaataaggactgccttcttctctttctaaaagctcgggattaaaatcgatacagccggaagacaagcttaaaaccccctgacctttagccacaaccaaaacctttttttgctttctggctcccgctccggctgccattaaaccgctcattccagccccgattacaactaagtcatacatcgtccgtacctccaaagagactaaaattacacccgtatagaccggctaaaagctctgcttcccgcagctgttcaccccagagaagaggcttttgtccagcatagcggtttttaagaaaatctttaagctgttccaatggctcctgaggcttttccagtaactccgtaaaagcaacccctaacccacggtaggcacagtttaaaccctgacaggtgcccatccccagacgggttttccgccgtaagtcttctaaattatgcgtatctttccacctggccacttctttaacttccgccaccgttactccttcacattcgcaaagcacctgcttttcttcagtaacaccctttaacctttcttcaattttcggtgctcgtacggtataacgccgggcaattctattcttctcttccaccgcaagagctggagtcaatggaatttctgaagtcttactcttcctatcaatccctaaaagctttcctatatagtcaccggttttttcggccattagccgataggtggtaagtttgccccctacgagactaataagcccttttaaaccttcattcctttcatggtcaatgatgacaaaatcccgggaaatgctccggctgtcctggctattgctttcttctcctaaatataacggccgaatccccgcaaaagctcgcaacatccttagttctaaaacatcaggaattagctccttcccaatatctaaaagctttgttatctcttcggaagtcggtcttaacatttccgggttatccacgttaaccgaagttgtacccaaaatagttattgtatggtgtggtacccagatatctccgtcactgggtggccgcaagcggttaactacttcttgaaaaatccgctggttaaaagcaattagggtacctttattttgtaaaagattcacttttaccccggcaagcttggctacctccgccgcccaggcaccggcagcatttaccgctacttcgaattctacaaaaacttcctcgccggtaagggacgaccgaagtttagctgcagttaaccgcccttgttgcttttcaaaacccaccaactggtgataggttaaatatctgccgccatactcttctgcctgccagacatttgcccagcacagacgaaagccgtcaacagtaccatcgggaacttcaaaaactctccttacttcttttgttaaaaagggatattttctttttataagttctggatccctttcccggatttctatgcccgccgttcgacacccatcaagccatttttcggtgtaagcagggtcatcggaatttaattcgataaagtatcctccggtttcttcaacacaagtaggagcaattttctttaaaattaaattttcttcgatacactcccgggccgcatttgggtctttgacggcataccgggctccgctgtgcagaagtccgtgaaaacgcgaacttgccccgtgagcaatatctttttgttccactaacaaaacatctaaaccccttaaagctaagtcccttaaaagtccagtgccggtagtacctccaccgatgattaaaaccgttgtttttagtttctgcatccatatccccacctgtaatctatttaaagcttttttaattagggacaggtcctgcggcctaaaataaccgccggcaggagccggccctacaggaactgtggtcagtagtcagtagaagtgataagtcgtaagtggtaggtaaaagaattaatacagaccacccaccactaactactgaccactattaaaaaagccgtaaagccatcccgagggatggcaatacggcgctcaatgtctccagccaggttattttattttactcctctacttcccattcccgtgcacgggttactgcccgctgccagcctttgtagagtttttccctggtttgttcatccatagtcggttcaaaacggcggcttactttatattttgccactaactcctgtttatcagcccagaaaccaacggccaaacctgctaaataagcagcacccatggcagtagtttcaatgtttaccggtcgttctaccggaacacccaggatatcggcctggaactgcattaaaaggttgttggcaacagccccaccatctactttgagagcctgaagtttaatgcccgagtcagcttccattgctgataaaacatcccgggtttgataggccattgattctaatgcagctctcacaaggtggtatttgttagtaccccgggttaagcctacaatcgtaccccgcgcccgcatatcccagtagggagcaccaagtccggcaaaggcaggaacgatgtataccccaccggtatcgggcactttagaagcaaaatattccgaatcggctgcgctttcaataagttttagcccatctcttaaccactggataactgcaccggcaataaaaatacttccttccagggcatattctaccttaccgtcaatcccccaggcaatggtggttaagagaccgtttttcgattcataaactttgtcaccggtgttcatcagcataaagcaaccggtaccataggtatttttagccattcccggttcaaagcaggtttgaccaaataaggccgcctgctggtctccggcaataccggaaatcggaatagcatgaccaaagaaaacgttaggatcggtttctccgtaaacgtaacttgaaggctttacttccggaagcatggaggccggaatcccaagctccgctaaaagctcttcgtcccatttaagctcccggatattgtaaatcatcgtccgggaagcattggagtagtcggtaacatggacttttccgccggttaatttccagacaagccaggtatcaatggtgccaaataacagttcgcctctttcagctttttcccgggcaccttcgacattatctaaaatccacttaatctttgtacccgagaaatatgcatcaataaccagaccggtcttataacgaaccttttcttctaaaccttttgcttttaactcatcgcaaatccctgcagttctccggcactgccaaacaatcgcattatatacaggctttccggtatttctatcccaaactaccgtggtttcccgctggttggtaataccaatagccgcaatttcttcagggtttacgttgtaacgggccattaactcggcaataaccccgtactgagtgctccagatttcttccggatcatgttccacccagcccggcttgggataatgctgggtaaactctttttgggctacgcccacgatattgctgtcccggtcaaataagattgcccggcagctggtggttccctggtctaacgccaaaacatattttttcgtcacaaaattccctcccggtttgtattatacttgattaaaataccatttgatataaaatagcaccaattaaaccgccaatgattggaccaataaccggtacccaggagtaagcccagtcggaacttcctttaccaggaataggtaagattgcgtgagcaattctggggcctaaatcccgcgcagggtttattgcatagcctgtaggtccaccaagggataaacctaatgcccataccaaaatacctaccaaaaggggagctaaaccagatgcagcaggttctttatttacgcctaaagcaagtaccccgaaaactaaagcagtcgttccaataatctctgttagaaggtttgcagcataatttctaatagcagggcccgtactaaatacccctaattttgctcctggatcatcggtttccgcccagtggggaaggtatgctaaccacacaaggacagcaccaataaatgcgcccaatatttgagcgacaatgtacatcggaactttagcccagggaaactggccaagataagctaaagcaatggttaccgccggatttaaatgggcaccgcttaactttccagtagcataaaccgcaacagccaccccaaaggcccagccagcagttataacaatccagccggaattttgacctttcgacttgtttaaaacaacgtttgcaacaacgccgccaccaaataagatgataattgcagtaccaatcaattcaccaataaatgctgtcatgtttttccttccctcctgaaatttttgcttaaaagtattttaaaaaactgtgttagtagccccctcttctctcttatcccctcccccttcctttaataaatagaaaagccctccctggatacagtaagcctgtacccaattggagggctctccatttctccagcccgcatacagtatccattaacattggcaaaacaaaaagagcctttaagtaaaaggtacctccctttacttaaaaggctctcctgttctcccgccacaaatcttcatctgctattaagtgtagtctaaggagagtaatttgtcaatatatttttacaattctaaaaatgttctttttttcacaattataaaacattatttaaaaaccagagggcagtcttattggtactaattgcagaaaatcctttagaaagagcttcctttaagtcatcctccccttgaattagccctccgccaatcaccggaaggcggcaagtttctttaatttccctgacgatttttgcaggaacggtagccggtaggatttccactccatgaggttttgattcagcaagctgcttcaaaccgcttctgaccgcttccgaatcaatgataaaaagcctttgaatggcaactattccttcttttttagcctgccgggcaatcgaagttttcgtagtaattatcccttccaccccggctttgaccaaatacttgaccgctgcttcatcttttcccaatccttcaattaaatcaaagtggacaatcaactttttcccagatgctctggcatgttttaaataatcgcccagggagttaatatccccaaacagtaaaaacattatttttaccgaaggaatatttaaaacttcacgaaaatcttcaggatttcttaaggcggggattaccttttgctggtttattaagtctattagcacttttaattttacctcccttaagaatcattctaccatataaaagtttactacttttcgcagaaaaaaccaaagttttttttaacctttgcaacttcacctgccaaaaattcatcttttatttaagggtgagaaaaaatgcgaaaaaaagttatcttttttgccgtaaattttcttaccttatggcttatatataacattattttaaataaagatttcagctatgcgattttaaaggtcaaaccccaggaaaaaattttaattgtggctccacatcccgacgacgaacttttagccgctggaggattacttacccaagcaaaagaaaaaagagccaaaatagcggttgtttacctgacggccggagatggttttacgcaagcggtagaagtaaattataaagtgcttaagcctaaaaccgttgattatattaattttggccgtttacgcataaacgaatcttttgaggtaaaaaaatatttaaacattgaccggatttaccacctaacctatcccgatggttacctaaaaaccgtcttatttcaatattatgatacgccttttacctctcccgacaccggttttaatgcccagagctatccagaaagctataaacccgggcagccttttaccggaaaaaatttaattgaaaacttagaagaaatcgttaaaaaagaacagccggatatagttgttttcccctcggttttagacaaccatccggaccacagcttcggggggtttgccaccagtgttgcgttaaggaaaataggttatcagggaaaaacttatacttacctggttcacagctacttttggcccaattacgggaagcaatttaagctcccccgggttctaacggaaaacaaactaaagttcaccgttatttctttaaatgattttgaacatgctaaaaaagcccaagccctggctttatatcggtcccagcgcaaagtaattggagcttttatgcagctttttgccaaagaagacgaagtttttcttcccgaaagcagtacagctaatactggctggcagcatggctcgaatattttacatgttcaggtatttgcagataaagtgttcctatcctttgctaaaaaccagcaggataagcttgtgatatccggatataatcttcaaaccgggaaaaccttcaggattgtaaaaaatgtcaatgccactgagcaaaacttcacttttcctttagagggtcatggtatatttatcatagaaagttttaaagggaaaaaaataagcaataaaaccttaccttttaactattaaaaaattattaactgcaactttagttaaaaaaatctcctctatatttttagagaaatgagttgagtgtagatggatgttaagttaatcccgataatagttaaagcaaaaaatggtgatgaccgggcttttgaaatcttagtccacatctattaccaaaaagttttaaattttttcaagggaaaactccaggacgaagatattgccctggacttaacccaggaagtttttgttaaggtattattaaacatcaaaaagttaaagatggcagaaaactttgaaacctggctttttaccattgcccgcaatgaactaaatcactatttgcgaaaaaaacaaaaagacaaacatatttttcaaaaaatccttgataagcctcctggcgaagtaagcttcagtcttgaaaagtccgaggtagaagaattactaaaagaacttccggaaaaataccaaacagctcttaaattattttatttcgaagcgaaaagcatcaaagaaataagtttaatcactaaaaacccggaaaacacggtaaaatcctggctgtaccggggacgggaaattttaaagtcattattactggggggaaataaaaatgattgacccgaatatcgcccaaaaaattattgaatacgcttaccaacaaaggcgtttaataatctaccgtaaattaaagttctggctgtctttttattttatgcttttaagttttcttgttttagaaactgccgccttcatccttcatttcttcaaaagtcgcctgcaccttatcttttatgcagctataagagacggcgttttatttggagaaaaggttgtttactattttgaagctttaatggaacgttttccttttgaaattttcttcttaattctgttaacttttctctttatctccttttccagtaaacgcttcaagctttttgaaagccagttaaatttagttctaattcagaaggagttgtaaaaatgaaaaagtttttgaaattaatctttttgctgttactggtttttgcccttcttggtagcttttataagtactactacgctaaaaccaatgacaccgttagcttggtaggaactgtaagatcagttgctaatgaccacataactttgcaagaaaagcacatccttaaaaaaattgaaatcacccaaaataccaaaatttattttaataagtctttagtccccaaagctcggcttaaacccaaacaaagattggtagtattgggcaaaagggaatttgatggagacattgaggcactaattatccatttgatggataattagatattaaatcacaaaaagaaggaggtggtaaaatgaaaaggtttttgtctgttttaattgttctcggcatgttgttaaccagtcctttagccgtactggctaacacagcaaaaaaagcagcaaccaacaccgttaaaaccgctaaagtacaaattgttaaaaccaataaaacaaaaaatgtagcaaaaaaacaagcaagccaaactaaaaaaacaaaagccacaaaagttacaaagactaacaaaaaaactgctccaaaatcaaaaaaataaagaaggctaaggaaataactccctagcctccctcaaccacaggaagggggtaaaaccccttcctttaagttaatattatagcaaattaatattgttaaaggaaagatttgtatggtaaacaggtacagaaaacttgttacgattattctacttctcttaagtttattctcgatacctcactttcggatccttggcaacatgaaaacagtaacaaagcccgcaccacctaaaaaatattgtgccctgacctttgatgacggtcctgatccgcgctttacaccgcaggtcttaaaaatattaagaaaagaaaagattccagcaaccttttttgttgtcggccaaaacgctgccaaatacccggatttaataaaagaaatttattttcagggcaatgaaattgaaaaccacacttatacccatccggttcttaattattttacggacaataccaatttagatttagaaatcaaaaaaaccgatgcagtggtatatgcaaaaactcactatactcctgcattttttcgcccaccccgcgggcgtcgcccggtttacctttataaaattttagctcgaaataagaaaaccctggtaatgtgggatatttgcgtcgaaagtgtaatagataaaaagaaaacaaattttttagtacctaaaaataaagtaataattttagcccatgacggccgccttgaccgcagtaaaactattaaagcgctgccgcaggtgattaaacaatataaagatgcagggtatcagtttgtaaccataaaccagcttcacagtttaggagtgaaataatggactatacaattttccaggcaatcaataatcttgccggtcatagtatcgtattagataaacttatgatttacatttccaaatacggcatatttttttacggattaatccttttaggaatctttttaaccggttcaaaaaaagcaaaaatcgaggtatttaagattggcttcaccgggttaattgccttaggtatcgctggtattaccggcaaaatctattatcgcccccgtccttttattagccataaagttcatttattgtatgcccaccagccggacagctccttcccgtccaaccatgtaacgggaggtttcactttagcccttggcatttacaccctttccccttctttaggattgctggcaattgtttattcgcttttaatggccttttcccggatctatgtaggccaccattacccttcagatgtaattggcggaatgttattaggaacatttgtgaacttttcaaggctccttttagagcaatattatctatctggcaaaagaagggatatcaaatgttaagaaaagtttttgccgcatttttgcttttcctttttatttttatcttttccggatgcacgccttcttcctcttcttccagtattctggtcctggaatatcacggagtagttccagataatgcctggggtaaagttaatcatctttacaatatcagggttgaaacctttgaaaaccagataaaaactttattaaatgccggctacaaacccatctctgccgaaaagcttattgacttttactataacggctataaaccatccgggaaagaatttttaataacctttgatgacggctaccgcaacaattacctgtatgctttccctattctaaaaaaataccggattccggccgaaattaacttaattgttgcccgtattgaccaggcaaaaaaccataacgatcccataaaaggctatctaaactgggctgaagttcgagaaatggccaagtccggtttaatctattttggctctcatacctacgatagccataataaagttattaccggtaaaaataaaaagaaaaattatccctttttaggaccaatttatcttgcaaatcaaaaaagaatggaaacatggcaggaagctgaaaaaagggtaaataaagacttaatgctctccgttgagcacatttcatatgaaacaggaattagaccagaaatcttttgctatccccacggcaactataatacctggtttataagtcgtcttaaagaaaatggatttaaaatagctttagctggcaatattccgcaaaataataacccctttaccgtaaagcgtattttggtaaccgattccctgcgcggaaaaatacttctaatgaaattaaatcttgtaaaatactctaatattctggattttataattaaaaaggcttctggttctgcccagaagcctgatttttcaaaaacttaaaccttgattatttccactctggtatccaattcactggctccgccgccaataggatcggacaaacaagcatttttcaaggccacatccactaattgaacatcatttaccgaaaaaccggtacctctgcccaacgcaaatccggtatcactaactccagctacccattttgtatgaccgtaaggttgaacggcaggtatctttttgccgtcaattatcaccggtgctgcgccataagcaaagtggccgtaattataactgcatcccactactccgggtttaatgccattagttaccagggccttaccttgcacttcaaagtttggagatataattttgatggtatctccggagttaatcccgcgttttttagcatcttccggattaatccaaacgtaattttccgcctcaatttcccgtaaccaagcatcgctaatattacggtgagttccgatatgtcttgccttccaggtaattaaaattaggggataaccctcattttccaccctttgtccattgtaatgggtgatttcttcaattcggggaagaccatcaaaaggcttgccggtataggagtgcttacctttagccactttttcggagtaaaaattaacctcagaagctaatttatacttaaggtacggaccatcatattcattccccttttcttcaaatctacctccccgattaagaacatagaccacccggcgccactcttccggctttaccgcccgtttccaggcctccagatcaaaaaacttccccaacgcttttttccttgccctttcaaagattaacagttctttatcatccgcttccggtaccggctcctttccatcataggcaatattcgccaccagcttcaggtaaaagtcctcggctctgtccagggaactgccgtccggaaaagccccggctcccacccccggcagctttaactccttggccagctcaataaagaagtcctccatctgccgggcttcaggataaacccgggttaccggctgttgaatatgggtttctttcaggggaaaattggggtagatggtttcaaagccccagcgttccagataagttaaatcgggcaaaatataatcggcataagtagctgtttcactgattaccacatcggataccaccaaaaggggaatagctttctggtcttttaagatctctttatgagcttttcccaccggtaccgataataaaggagaaatccggtgaatgaacagggctttgatagggtatggataaccttcagcagcactgggtaaggcctcctgaatgttatttccggagtactgaaaccagggacgcttggccgggtaaccatcccgctcaaaaagagttgtcttttcataggcaaccttgttacgtaccagcggaatgccccaggctttaaatcctttcggcacttttaacagatcatacctgccctcgaaaggattgaacttcgctccggtgctcatactgccccctttccagtcatagttgccgatcaggtggttaaggcagttaatagcccggagattatagaagccattggtatgcatcgccggaccccggtaggaggttatagccgcttttttcccatgggaagtaaactcccgggccagttcgataatcagctgagggtcgatttcgcaaatcttggcatattcctcaatggtgtactccataacccgctctttaaacagggtaaacaccgacttgacatggataccgttaataacagtatccacttccaattgtccttcggtagcctggtcatggggtactggcttgccattctggattaccacaaactgttctttagttccaatcccaagatcactggcccttagctttggctttccttttgcggtcagattgaccaaataagttgcatcggaccaggtcggttccccgtcagcttttgctgcctccttgttgggattggttaagtatcttaagtcataacgcttgttttctataatccagcgggccatacccagagctaaagccgcgtcggttcccggttttatcggtacccagatgtgtgccttttcagcaatccggctcaatcttgggtccaccaccgccagcttcatccctcttttaagagcattcataattttgggcgcaagccaagttggccctttattggccaccagcgggtcggttccccagacaatgagaaactcagcattatccacatcggcgtacatgcgctttttcggtttttctgtgttaaaagactgtacatttccgattacaccgttaacaccacaaattccaccatgatcaaggctattaatgctgccaagggtttggctccagaaacgttctttgaaaaaatcccgccggtctccaaaaaaacctacaatttgattggccttggggcccaaatccggatgtttagtatcgataagcacatctttatatttcgcatcaaattcttcctgggacatctctccttttttcactttttcccaatcggccattaccttctcttcgggaacaaaggcccagatgctctttagccctggagttcccagatcggggctgccatagacaatttcctttaacgcttgttcccagctaatactttgccattgaccgcttccccgggggccaaccctttttagaggcttttgcactcgcaaagcatcataagcagtttggataccggcctggcctttaagacaggtccgtccacccctaaagcctcttccctccttggctatatcaccgctaccttttgctgcttcatccacaggagtattgtacggaatctgaccaaaaggttgcatgttaagcggactataagggttgccggctatctttctgatataagaagtaggaccgtttcctttagcaggggttataaccgcttttatagtacaatgggtattacactgttcgcaggtggtataaataacatcttcggcaccgtaatccaggacatcttggcccgtcccgtgaggatcatctaaaaaccaggattcaaccgccgactgctcagaccccaaggctgcgggagctaccaaacctactcccgccagaacagcgctggttttaagaaaacttcttcggctgattttaaccggcttcttttgttgatccatattattttccctcccttaattcttcaacggtatctattggtaatgctttaattgccactgtatataaaaacagaccgaaagccactattcctaaactactaagccattcaacaagcgtaggataataataaccccagggcaatcccggcaacaccgggacaattaaagcgggtaccacaatattaaaccgtacgcctaaaatgccgattaccaccaaaatagccgccagggcaatagcatttaccgattctttcagcctggggtgaaagaaaataaacagtggaacaactactcccagaaacagctgtatccaccagaacgaccaggaaaacggactccgaaaaatagtttcgatggtagccagttccgtatattggagtccataggcgcccacaaaaaattcgtaaaattccaagcctaaatcgataaatagaaaaagggttaagagtcccgccagggacttaaccatttccttatctacctcacgccccaccactttgctccggatcacataaattgccagtaataacgcggttcccgaaaccaaagccgaaaccacaaagattaccggaaaaagcccgctattccaaaaaggtcgagccttggctactgcgaaaagcgttcccgttccgccgtggactccaaaaatagcaacgggaattcctattgaacctaatattttcaacaaacgatggtcccgctgtttggaagcagcggtcaggtcggtactgccaaaggtaagaaaacgggctaaagctgcttgccacccactgccttgagcaacccgaattaaatcctgtcgcatggaaaaataaagttcagccattaataaaccaatataaactacataaaaccgaacttcccaggccaggatactggtgaaattccagtaacgtaaagcatgccagaagcgctccattcttcccaaatctatcaaaataaaacacatagctaaaaccatgctgagaatggcaaccagcaaagcatcccgaccaattttctcatattgttccattttaaacacaaaaatcatagtcgagagaagaaaagaaccggcacttaaacccacaaaaaagatataaaaggctacccaggctccccagggcgtagtactggtcaaattagtaacggccaaaccgcctcgaattcgttcgataatcgcccagccaccgagcgccattaatataacgagtaccccataccaggctttagtcaatcgtatgctgcttttcaccgcaccctcatcctccctctttttaatttatttcagataaatgacccttggtttggttcccatttcttcctgaagaacgaaggccctggggcttgcagctaatttggataccacactttccggatcgttaagatcgccaaaataacgggcatctcccaaacaaacctcaacacaggccggttcttctcctcgctgtaaccggtggtagcaaaacatacatttgcgaacattccctattggcgatttacctttctcccgtttgccgcggtagataccgtattccggcgcctgcacttcgttgtagccaatcatctcccggctgtaatcctcaccaaaatcaaaagacctggctccgtaaggacagcttacaacacaatagcggcaaccaatacagcggtcatagtcgatggcaacaattccgttttccattttataggttgcttttaccggacaaacttgaacacaagcaggtcggtcacattgcatacacggtcttggaatatgaattttagtaacattggggaaaatccccttctcctcttcaatgacaacattgtacgatattcccggtggcgtacggttttcggctttgcaggccaccgtacaggtatcacagccaatacatttttgcaaatcaattaccattgcccatttcttgtctgagctcactgcttattctcctttccaaacaactaaataggttgtaaaatttaatcgtaaaagaccggtgttacttgaacaatatctcacaaatatccctctccggagagtttaatttttcataaactttttaagcaaaaactataccaatcccaaaaggctcaaaaatcgggatagagataaaaaaaatccatgacaatttgtcatttgctgtgacaaaatgtcatggatggcaagtcacgttttaagttatttctttaattggtattcctcaattttacgataaagattgcggacgctaattcctaaaagttcggcggccttggttttattccattgaaccgcctctaaaacctgtttaatatatcttttttccatttcttccagagtataaatcttcttcggtgcctcttcccggggaagacagccaaaaaggtcttccttttggattttatccccggtgctgagcaacagcccccgttccaggatattgaaaagttcccgaacattcccgggataatcgtaactcataagtgcctgcaaagcctccggagtaagttccttttttaccccgttacccgccttttgcaaaaagtactcaaccagtaagggaatatcttcttttcgctcccgcagaggcggaacccgtatcttaataacattcagccggtaatataaatcttcccggaaattacctttcgccacttcttcctccagattccggttggtagccgctattacccgaacatccactttgcgtaagcgtatatcaccaactcgccggaattcaccggtttccagaaaccgcaaaagttttacctgtaatcccagttccatttccccgatttcatctaaaaacagagtcccgcggtgagcgctttcaattaaaccgatttttgtagttatggctccggtaaaagcccctttttcataaccgaagagctcgctttccagaagttgggccggtagggctccggagttgatagctattaacggttgttgggctctactactccactggtgaatcgcattgacaattaattccttaccggtaccgctttctccctcaatcagcaccggtgagtcggaagccgccacctttttcgctaactccagcaccctggtaatggctttacttttacctacaattactttggaacttctatcccttagcaaaacttctttcatccccaaattttcttccagtaactgccttttctcgtaagctttttgcagggtaatttccagctctgccagattacagggtttggttaaataatcatacgccccaagcttcatcgctccaatagccgattctatggtaccgtgcccggtaaggataatcacctgaagattttcatctaattgcctggcccgttgcagcagttctattccatcaattcccggcatcttaatatcaaaaattgctaaatgaaaagtttcttcctttaaaaattggagagcctcttcaccggttgccgctcccttaacttcatagcctttccgggttaaccgttgaataagcaaatcccgaaaattttcctcatcatcaactaccagaactttaattgtttccttcatctttctcaccttctttccgctccatcggcaaaataatagttaccgttgttcccttacctaaactgctgctaatttggatatcccccttcatttctttaacaataccgtaacaaatggatagtcccagtccggtacctttacccaacggttttgtagtatagaaaggatcaaaaactctcttcagctcctcctgggcaatgcctgttccggtgtcgattattttaattactaaatctttttctcttttttcagtaaccagtttaagccgtcctcctgttgtttccatagcatccagagcattaccgataatattgagcaaaacctgttgtagctgggagaggtcccctttaaccacaggcaaatctacattaaattccttctcaacctgaatgccaagttgtttaatccggtgattaaccagggccaaagtatcttccagcaattcgttaagatttatgtcaatcatatgaccggcaggttgtctggcaaaatttaacaaacttccggtaatttttttacacctttcgatctgtttaccgattacctgtaagtatctcgccaattccccggagcggtgaagctcccttacatcttcttcagcaatcctctccaacaggtcttcagcataagccgaaacagtagctaaagggttattaatttcatgggctactccggcagccagtaaccctaaagccgccattttttccgtttgaataagttctgcagatttttgttttatctgttgcgtcataaagttaaaagcatctaccaattgcccgatttcatcatcggtagttttgggtaaaacaaagttcaggtctccggcagccacccgcctggctccctgttctaaaacttcaataggtttcgtaaaacgcaaagcaaaaagaatactggttatcacaaccaacactaccacaaaaaatgttattattagaaacttaaacttcaaagcagtaatgggtttgtaagcttcacgaaccgggatttccataaccgctgcccaccctaatttttttataggtgcataaacccccaatactttctcgccgttaaaagaaacatatcttaaaggcaacgtaccttcatattcctttccttccataaaacggcggacagcaaggctggagtttaccggagtttgtcttaaaacctgactgaaatcttcatgggcaattaatttcccatcattattaaccacaaaaatgtcgccgtcttggttaccgtacttggccaggacggtattcataacaggccttaaattaacctgaacataaaaaccacctttaatttcccgggtcaacaaacttttcaccgggataattaaactgaccatggttcgccggtcagcagtctgatagcttttgaccattccttctttgcttaagagttccggatctacttgggacagtttttggggagtaattacttcccgtttggaaacccgggcaacttctcttccccgctcgtccagaagactaatatcttcaacggccggtatatcccgtaaaaagatataaaggaatttttcctggctttcccggttctgctgcaaaagcgcttccccgaaaacattaccggcagcggaaattttatcttctatttcggaaatcaactgaccgatatccatagctattccttttaccagatcagtattccgctgctgaatggataccagtaaatccttttcggctgcccgaacatttagataggccagtgacaccagaggtataatggacataagaataccaaaggctaaaaccttaatttttatccttttccaaaatttcatcgcaaatcgcctcaattttacttaattacagttttagcaaaactcaatccggttgcattaagcttaagtcctaacttctttgctgtacgcagatttaccaccaattccagattatccggtgtttctacaggaatctgttccggttgctggccctggagtactttggctacaatcctggctccctgatacccctggttgtacatggaaactccataagcggcaaaataaccccggtccgcctcctgctcaaaaatacccataaccggaatcttatattgcagagaaaggtttaataaatcctgggttaaagtttccagcaaaaaactggataaaggaagaatagcatcaaatccttttagggaatgttggttcaatttcgttttaaattcagcccgtgaacttactgctatggtttttatttctattcccaaatcttttgctgtatctttaacaattttcaaactggtataactgggaggtaccttagggtcataaagaacgataaccttgttcaccgacggcagcaacttcttcaacaactccagcctttttccggccagctccgcatgataattatccaccccggtaatttgtcctcccggttcgataaagctttttaccagaccaccttctaccgaagaagcagctccgataaaaacaatgggagtgtcttgatccttagctgctcttttcagggcatccgcttccacacctccggtggcgaccagcacatccggcttctcctggactaactttcgggctaaaggcaacagctgttcccgctcaccttcggcatttaaaataatatagttaatatcttttccctcgataatccctaaatccgctaaaccttgcttaagacccacgattttttccgcctttataccgctggcagctaagatccctacagtccatttggctttctccggttgggcaccgacctcgcagcctgctataaaaattattccgattattaatcctaaaaaggtaatttttttcaccatgctaaaacacctctttctaacaacagttcttgctcttataatagcacagaatacgcaaaaagggctgtccccacagtactacaaaaccattaacacctaagaaaaaaagaggctcctggtttccctgaagcctctttttatttacaaaatcatttaatcttggccttaagtgcttactgtaattaatttcttttttcctttggctaaataaagcgcctcatcagcagttttaaaaagctggtctttatcgtttaagtcgctttcctgcattgaagcaataccaatacttacggaaattctaacacgactttgcccaaaaacaaaatcataattttctatctgggttttaatgcgttgggcaatatttaaagcttcctgttctgtagtttcccaaagcacaaccgcaaattcatctccaccccagcgcacgataatatctacttttctggtaacattttttagaatctcggcaaccttttgcaatactgtatctcctgcaaggtgcccgtaaaggtcgtttatatttttaaaattatcaaggtcgagtaaaattaaggaaattggacctttggtttttatattgtataacttctcattaaaataatttcgattaaatagcccggtaagcgcgtcggtatttgcttgaacgcttacttctttaaaaagcaaactaagccctatggcccaaattacctgaaacattaaaaaaaagttccagatcaaatctccatccttttttaaaaaatataatataaatgttaaaagcaatcctccgattaataataaattaaaggccaagctctttcttcccgctcgcacttcctttttgcccccaacttagcaaaattaccctcagatatttttattttaatacataaaaagctttttgcaaataatatctttatgctatttgccaatctgctcttttcccaaaatgtctttttgacttctgtttttgttaaaatgttccactatgtactgatctattttttgactaatttttaggataatttctttattcatgttcattctggcggcgttatataagatatttctggcaacttcaattttatccactttacccaccctgctcactcccgatatatttttttacatcattttacataattttatgctaattgccaataatatttttatgctaattgcaaatttttctttataaagaattccgataaagttatatccacagggagtgagcaaacttggaaatcaatactaaagctatcgggcaaagaattcgggaagaaagggaaaagcttgagctttcccgggaagaatttgccgaaattctcgggctttcggattattacgtaggacaattagaacggggagagcggcaaatgagccttcccgtcttagttaacatcgcccagtgcttgcatgtatctttagattaccttatctttggaagtaccccttttgaaccgtccggagttcaggaaaatatttcattttataattttttgcaaaatcttgatccagaattgctaagcttgctttctaaatgctcccatgatgaattggaattgttcaaaaagcttatcaaaaccatcctcccttatctgggtaaaaagccggtcccttaagagaccggcttttctacttattttttaattttaaccgttaccgaaagccccggaataagcccttccggcttttccaaaagcttaatttttaccggtatccgttgacttaccttcgtaaagcttccggtaaaactgtcagcggaaaagaggttaaaggtcgattgggttgcccggcctatagattcaaccttgccggataagactttcccccccaaagcatccacgtaaattttaaccgaagctccaaccttaactccgcttatctctttctccaggatgttagcggtaacgtagaggttattaaagtccgccagggatacggcagcctggcctggagccaaaatttccccgggctttacccagactttgactacctcaccttttaccggtgcttttacctcggtcgcatccaggtttaatttggcaagttttaaagctgcttcctgggctttaacttgagcttctaccgctttgacgtcttcgagctgggcaccgtttagggccagatcaagtttacttttagcagcttttacgccggcttgcgcggtattcatttgggtcttggccgctaactgctggtactttaactgggcaatttgctttaaaagttcattggcctggtcttttacctcctggggggtagctggatttgccagtaagggctttacagcatcatattttttctgaaggtcatctatgtctttacttagctgctcgtatgattccttggccccattatagccagccagcgcttgttcatataaagccctggctgcgtttacatcctcaaccctggctccttttaacaccttttttaactgcatctgagctgcacttaatcccgcctgggcctgctctaactgagctttagctaaatcatcctcaaattttactaaaagctcacctgcttttacctcatcaccttcctgaactttcacttcctttactttaccgccggttttgccgccaatactgtaaatatcggcagtcaccttggcatcatcggtagtaacgtaatttttactgtcaaggtaagcataaattccataaccagctcctaaaagcacaataaccaaaactattgctaaaaactttttcttcaattccggcacctccctttaaaattccgccacaggtaatttttctttttcttcctggttttttctttcctctttcaaaaagaaagtaaggataaccccaaaaaccataataaaagccgttaccaagatcgcatcggtaatcgctttggcatacgctacctgataaagtcgcatagcaattacccccatagctcctttgaccgaaacaagaggtgaaacacccataaagctcaagccacttttaaggaaattaacggtattctgaaataccggagaagcctgattcaagccttccaccatacgggcagtgtgaaaagccacccgttgctgggtaattgtggtgataatcgccacccccagagaactacttacctgacgtaaggtattattgatggccgatgccctccccacctgataattaggcagagcattcatgccagcagtatttaccggcatcatcgaaaaaccaatccccatcgcccggatgattaataaagtttgcaaccaccagagttcggtattaatgtgcgtaagagataggccataggaacttataatcgccagggttaatccaaatagcactaccggctttgccccaaaacggtcaaaaagacgtcccgcaataggcatcaccaaacccgaagccaacgccgccggaagcataatgagccccgtatccatcggcggataaccccgcaaattttcaaagaaaataggaaaaagaaaaaggccaccaaaaagtcccatggtattaatcatggtaatgacaagactcattgcaaaggttggattttttaaaacgcttaaatccaaaaggggctccgggcttttaagttcaaaataagtaaaaagtgtcagcgataaagcagaaagccagaaaaggaacagtattttggccgaactccagccccaatcggtccctttactcagcgctaaaaggagggcaaaaaatcccaccgatgaggtgataaaacctggtaaatcaaaggtagcatggggccggcgcaccgattcttttaaaaacagaagcgccatgaccatgccaaaaagaccgatgggaatgttaatggtaaaaattagccgccagttaaaatactccactaaatagccgcttaaggtcggaccaatggccggggctaccatcaccgatatcccccagatccccaacgccatcccccgctcttccttgggaaaggtattgaaaataatcgtcatggacgcaggcatcatcatcccgccgcctatggcctgaactacccgggcagcaatcatcgagttattgctccaggcaaaaccacataaagcagagcccaaggtaaagaaaaagagggcagcaatgtacaatcttttataaccgtaagtatcgcccaggtagccggtaacgggaatgaccacacccatcactaacatataaccggttaaaacccactgaatttcttcggtacccaccgcaaagacctgcatcatcttgggaatggcaatattgacgatggaggtgtcgaggatagccatgaaagtgcctataaccaccacaaacatggtaagccatttattttccccaaaattatgccgctggtgctccaagctctcaccctctttacagttcaagtttttgttgtagctccttaatctttttccagtagtgttccttaacctctggttctatctcactgagaaaagcattaaaaagtttgggcaagtcatgatgatggaaaaaatggtgttctgctaaatggactactaccggatgcctggtccatataccaatagtctcattttcccctccttcttcagctaaaagaagctcatcatcatcaataatcagctgaaaccccaagcttcctcttttttttaaaaccgttttttccggtgttaagattacaggatcaaattcctgtaattcttccccctttccaatcaatgttaactcgacagccacctgcctttgcctggcgttttccagcagctcctggtagggtaaaaccattgccattgaagccagtaatttaatatttttcgttgctttctggagcatttcccgaattcttccggctatttgttcaccatttaaatggattaccctttctttcgcacctgggggagttaaggcttctaaagcttttttcgcttcgctaatttttaaggaaaactcctcttttaaccgctccaaatattccggtggcggttcagccagatactttaccggttcaccttgaattttctgcaccgcacctttttctataagcttattcaaggtctggtatatcattgaccggggaatcccggagtttttggccacctcgtagccggtagcttcccccaagtttagtaaagcaaggtaagcttttgcctcatactcactaaagcccaaagcctttaacttttctaacaataaaatctccctccatagtagttatatgtataactactttaaaattttagctactattcggaaaaaaggcaagaaaaatcttgtttcaagttaaaaaaactttcccagtaattcttgacaactccttaacactttcctgaaaggttcacaacaccttacggctattatttaagtaagctccaaacgtggggcaaatacaaaaaatttatggaggtagatatcatgaaaaaacaaaattggttcaaaaggttagcggcaggtttagtaattggaggagttttactggcaacagtccccgccaccatttttgccgctgagacaactacaactactcctgcagtagttcaaaccatgaaggggtacggggcaaggcttggtcaaactttcggcagcatgctggattccatcgctaaattcttgggaattgacactactactttaataacggaacggcaaagcggtaaatccctggcccagatagccaaagaaaagggtaaaagcgaaactgacctggtaaacttcatcgtcaaagaaagaaccgctcaattagaacaacttgtcaaagacgggaaaataactcaagctcaagcggatttagcaaaatcccagatggttgagcgggtaaaagccaacatcaacaaaaccactgtcggaggcaacggttatggcaagggaagaggtatgggacaaggtaaaggccagtttagaggccagggccggggacaggccggtaactgcatctatacaacccccagcactacaaactaaataaaaaagcaccttaaagcaaagaggcttctggtttcccagaagcctctttaattatttaaagttatttttctaaagtccgcaacttttcacaagtcgcaccatcgttaacctgtccggcccattggactatatatattcctaaaagaataaccatcgttccagcaataaactcaaaagttatcttttctcctaatattgcccaagcaaaaaagcttgccaataccggttttataaaaaacaccatcgatccattccctgcactaatgttagttaaacccaaaaaatacgtgtaataggctaaacctgtaacaaaaaaagtcaaataagccattggtaaaattgctttaggctgaagggaaaaaagtgggtagtgttttagtaagattataggtagtaagaatacacttcccaagataaaggaaaaagaattcattattacactgtcggttttttgcgaaaaccttttacccaaaaccgtgtaaagcccataggttaccgcagctaaaattagcatcagaattccataaacatgggaaattcctaattctaaatctttataaaagacaattactaccccaacgattccaataaaaagccccaagattttttggaagttcaatttttcatccaagattaaataagcaaaaagcaccacaaagagcggatttgagctaaaaatcgccgctgccaaacttgctttagtcatattaatacctatttgcaaaaatgacatacttagaaccacatttaacagaccaatcaaaaatgcaaacaaaaaatcactgcccgtaagttttacattttttcgctttatattacttagagccacaggcaaaaggacaaatcctccaaagaaaaatcttaaaaaatttaattgaaaaggattaaccagtcctgctaatgctctgcctactacttcatacgtactaaacaacactaccgtaattcctaaataaagataacttttattcactgcaaatttcctcctacaatttttacttaaaaatagaaattataatatgaaataacatgaattatcttaatattttttattgttaaaaaaccgcccattaaatgcttaacaggttttattataccataaataacagtatttgtgacttatggtacataattatatttttaattttttgttaaagataagtagcgattaacaattaactaatccttttttcaattgaaactaaaaaataaaccctgcaaataataaaacctgcagggtttctcaaaatttaaaggtttgtaaaatatttccatcattcattttttcgacaaaaacattaatttcctttaacgaacaattctaactttttaacctgtaggtcagtttttccggcttaggtttgctgaaatatctattctttttctaaccagcctaacccgatttaactttctattaaaaattgtttttattaaaaaactttaatataatttccatgaaaatacatctgactgagatagatgatggtttaaatttaaagatgaaacgtttacataagaccgcaataccatgagcaattggagcaaatatgttttataactttagctattgccatgcaggagattggtcttaaacattctcctgctttttgtttacttttctcttgcttgcacgtctttataagtgagaatggctttaaggaggaggggttaatgtggcaggaattgtaccgaattgtctattactatttacttaaacttgggttatcccatgccgatgcggaagatatagcacaagaagtcctattgtctacatacttacatttagacagtatccaagatggaaatttgaaattttatgttttggccacggcaaaaaataagtacattgacttttttagaaagaataaaagggaattcactgtaccatctcttggtgattttgatgtaaacaacttctcagaaatccatcaaatcgaaaataaagaagtactaaaaaaagcaattaataagcttaatcttaccgaacagaaacttttttacttgaagtactatttaggaatgacaaatcctgaaatttcatctttgcttaaaattagtccagcttcagttaagacaatgctgtggagactaagaaaaaaggtaaaggaatatttagaaaaggaggatgaaaattaaatggctgaaaatgaaaattttgaaaatgttaataataagataagttttgatgaaaaagcttttttacgtaaagctcgttttataagcattcttcgtattacattgatttctttaggagtggctattggtatatttgtattgtcctttgtaatccccgaaataatgctgcagaatcaagaaaaccgcatcgatagtatctatccagaacttattaaattcagcgaacccaacacctttgtcctttcaggagaaagctacaatgttagattgtttggtcgccaaaagaagtattacctattaagattgataggcaataaaccttatccggccggagcattaactgttgattttgatgtttggggtggagaacaaattaagggaaaccaagcctttactctcccagagggagaaaaagaatatcttgcgccctatgctgtacccaaattaaaattttaccacccagctgcaaattacgaaaaaattaatatagaatttaatatcctaaaaaatatacccaaagattattatgtggaaatggccctctcattcaggaagcctttaacacttgatgaaatgaaaaccattatgcctggtgatttaaagttaatgtggggggctgtatgtgttttttcagaaaaagattatgcgaaaaacagttatctttccgaaagattggttggaaatccttaccttgataaaaccaatggagaaaaacaattacttaaagaacttgaatggcttagtaatgttccgagtcatcatgcgaagaatctaaaaagaaccgtaagctacttgaaagaaaatggtattaaatattatggggtagttgtagtaggaaatccagatacccttgcaaaattatcttccaatccaatgataagagctgcggttttaggaatagttacaagaccagaataggataataattagcgcaggagcaacccttttccttaaaccctttcttgccaaacgtataaacattgtataaacttaaatcaaaaatgaggtgatcctatgtattctaccattcaaaagtgaggcaacaggcatgcccttaggattcctaaggctattttagaaaaagtttccattcaagaaaacgataaagtcgaaataattgtagaccaagatgcaatcctcatccgtaaagccaaacctaaatataaaaatctcgatgaactttttgctaactaatctaacgctttctaaaaagtatttaggtaaagtataattattccaatattttttcaaactcgatttcatgcaaaataggtatgccgtcaaacccgtataatggaatttccggttttaattttcttgctttttttaccgcatttaaataaagagccgccatgttaaatccccgtttctggtaaaaacgaatcgcctttagattatcattggtggtaataagccaaactcttttacatccttgtttttttgcctcacttagcacacaatcaattagtttactgcctataccctgattttcttttaaactatcaagggatactatttcacattccccgtcttctatatgataagttagtaatcccactattcttccctcatctaaagctacaaaacccggaagtttatctacatagtgcaccttacctttagcaaccattatcggcgcaccccagtgctcggtaaaaaaattaaaaacttcttttcttatggtttcatcaatgggtattattttcaatgcttctcaccttcttaaaagctattctgttttttatttcggtaatattttcttttagttcctattatttcctacacatccccctttagtccaataacatctgctactttccgcatacctttaatagtttcttcgattaatttgtctaattccatccccagcatttttgctccctcttcaataacctctctatttactcctgcggcaaaacccttttgcttccattttttctttaccgattttacctcgagatccaggatgcttttacttggtcgcataagagcagtagcggtaatcaatcccgttaattcgtcaattgcatatagtactttttccatcctttccaccggttcaacatcagtacaaatcttccagccatggctttctattgcccgaatgtaatcttccggccagtttctttcggtcaatatttctcttactttcttacaatgttcatcaggatacatttcataatcaaggtcatgaattaaaccgataattccccatttttccttatcttcttcgccaaaaagttcggcaaagtgcagcattaccgcttcaaccgccagggcatgtttaattaagctttcacttttgttaaactctttaaaaagtttaaatgcttcttccctattgggaacaattttttccattacccgccaccctctttccggctaaaattattttggtaattgttaagccttggatatcctgaacctaaattatattaaatcttcatcttaagtttcttcgacaaaaaacaggaaattccttccttagccgggctttgaaaatggtagttaattacgagttacgcaaaactttaatgtaataaattataaaagcgcaccttttggtgcgcctgtaagttaaactcttttaatatactggccggtacgggtgtcaatttgcagtacatcgccaacttccacaaagaacggaacctgaaccacgtagccggtttctaaagttgcaggtttgctgccaccggaagcagtatctcctttaattcccggaggggtgtcgattactttcagttcgacaaagttgggtaattctaccccgataaccttgtctttgaaaaacagtacccagaggttggtgttttctttaacgtaattaatggcatcgccaaactgctctttggtcaacggaaactggtcataggtttccatatccatgcagtagaagttatcgccatcattgtagagatactgcacttcccgacggtctacgtgggctttgggaactttttcaccggcgttaaaagttttttcaattacggcaccggtcattaagttccgaagcttggacctgacaaaagggctaccttttccgggcttaacatgctgaaattcaattacctgatatacctctccatccaattcaatggtaagcccggtgcgaaaatcgttggttgaaatcatcccagaacctccttaattctaatttttatttgagaaatcttagagtataattaaatttttgggagaacgggttaaaacttcaaagccgctttcggtaaccaataccgtatcttctatccgtacccccccgctaccggggagataaatacccggctcgatagttaccaccatccccggctgtaaaaccgccttccctttaggagaaaggcgtggaccttcatggatatttaagcctaccccgtggcctaaaccgtggccaaaatactcggcatatcctgctttggcgataatatcccgggccacccggtccacatctaccgccagcgctcccggacgaacggcttgtaaagccgcttcctgagcttccaaaactacatcatatatttcaagcattttttccgaaggttcccctatcgccaccgtccgggtaatgtcggaatgatacccctggtattttgccccaaaatccagagtaaccatttctccagaaacaatttttttctccgatgccactccgtggggcagggcgccacgctctccggacgcaacaatggtttcaaaggctatatcttccgctcccgcttcccgcataaacttctctaactcccaggccacttccttttcgctcatacccggagttaacttttttaaaaggtggttaaaggccgcatcggcaatggcacaggcttttttaataacttccacttcacctttatccttaatttcccggagttcatccactatttccggtaaacttaccagattcacccctgaagctttttcggaaagttcccggtagtctttaaagctcagggcatctccttcaaaatacaaagtatcgatttttaatccctttaaaagctcggctacccgggaataaatcgtgtcttcgtgtttttctatgataaatcccgggcattgcttggtcgcctgttccacatagcgaaaatcggttataaaataatttttctcgggagtaatcaacaccgcaccggaacttccggtaaagcctgctatgtagcgcacattttctcttttggtgataaaataggcgttaattccttcttttaaaagcttttttttaagcttttccactcgctccatcgttatcccgcctttttagataatcaattaacgctattaagccaagacgatagctatccaccccgaagccggcaatgtagccgatacaagcaccagcggtaaccgaatgttgccggaactcttcccttttataaagattggaaaggtggacctccaccgccggctttcctaccgccagcaaagcatcccttaaagcaatgctgtaatgggtataagcaccgggatttattaaaatcccgtctatttcccggtaataccggtgaataagatctattaactccccctcaccgtttttctggtaaaaaataatttccaccccttgattttcggcaaaaccggtaaggtccttttctatttcttctaaacttaccttgccgtaaatttccggttccctaattcccagaagatttaaattcggcccgtttaaaaccagtattttcatttttccaccccaatccttgaaaattgtatcataattttaaataaaaaaaaagcccggttaaccggtttgccgggcatgatcacccaaaaggcgttcacgttttaagtacttaacaaatactttcgtaagttcagggtcaaactgggttcccgcacaacgctgtaattcctcaattgcttcatcaagagttttaccttttttatatggccggtcggtagtcatggcatcaaaagaatcggccagggtcaatattctgacccctaaaggtatttcttctccttttaaaccatagggataacctttgccatcataacgctcatgatggtataaaatatacggcaaatatttatcataaatttttaaaggctggatcaactccaccccaaaaaccggatgctgctttaaaagctcccattcttcgcccgttaaaggtgtcttttttcttaacacctccccgggaatttctattttaccaacatcatggaaaaatgctcccagcttaatctcctcgaccttttccggtggaaggcccagttccagagccagcgcctcagcatactcggccaccctttcggtatgcccgtaagtgtacttatcccgggagttaattatggaaataatggtttttaaagacacaataatttcctcgttaactacaccgcttttacgtgaaagctcttctaaaacggaaaaatagcttttggtaatgttcttcccaaactgcttggcctgatacagagcatctttggctttattcatcaactcttctgctgtcttaccattttcaggataaaaggcaatgccaagggaagcagcaattactcctttaggaaatacttcccttccgggaaaatctatttcacttaaaagcttctggaccttttccgcaaaggaaaaagcctcctcaatattattataatcgggaattaaaaaagcaaattcatctccccccagccttgccaggaaagccctaagtggctttatctcattcaatttttcagcaattacacaaagtagctcatctccagcttttataccgaaagcatcgttataccggccaaattcatccaaatcgagaaggattaaagcaatcttattcccatatttttcggcaaatttcagggatacttctaactgctccatgaggtagctgtaattataaagtttggtaaggggatctttaaccaccatcccttccagttcggcaatcgttgctttcagcttttcttctaattcaatcatcctggtaatatcccgggcaattaaaaacatttctcgccctttccctggaaagtcataaaactggacatcaaccaaaaaagaatattttttcccgtttaacttaatattaattgtttcgttcataataggagatccggtagctaaagcttttcttaccacctctaaacgtcttaaaaccgcatgggaaaggttgttaaggttctcattaaggtacttttccgcttccgggccaataacttccatagcttttttgttcaagtaaatgatattgcccttttcatcaaaaattatcacgacatttggcgattgcgctacggttttgaaaaaatagaggtaattttgccggtatttttcaaggtaaagaaggtaggtaaaagcaccggaaaacagtgaaatcatctctaaaaaagtatgaaactctactcccacattcccggaaagatgtgctgcaacataaacaacaataaggtaacctacgtataaccagaatccactccacccaaggtagagcggtaataaaaacatgggaattaacaaaaaaacccaaaggggtaactctacccccaaacgcgctggaaacaggataaaagcggcaatggtaaaaataacgtttattaaaaaaacaatttttgcactcaggggaaaacccatctggtctttgggttttgttattaatttcccactccttttcttcatataattacctctttttctttttttaagtattttacaattatttcaaaaaagttgcaatattgcgaaatgttattattatcacatgttcctactggtattagtaattaataatttaataattatctaatattactttacgaaaattttctacccaaatttattaaaaaaacctatccccgaaaagataggtttatactcaaaactaatcggcataattaagccacttaagtactcccgggcagatttaccggtaagtgctacggtatctgatttagtttttaaaataacgactaactgccgcgctgaattcctcccagctaaattgatcctgggttgggaattgggcttttttgattttttccttaaatttttttatttcttccttatccactggtaatcctttagagcgattattaatataatcggaaaaatcaaacagcctttgacgtaaatcctctctaaacacttcaaaacgtgttttactaaggatgtcaacagtttcattttttaataagggattcaggtttaaaatgccctgggccataagttccgcatcttttaaagctaaataaattccccataaatcattaacatcagcaaaatttttcttttccgctcgctctaaaagctcaaccaaaccaatcatatccccggacagcattttggcataacctgttgctaaattttcacttatagattgacatttattattttgtaaagctaaattataaacaaatactgaaaaggttaaaataattagtaaagtagtaattattaacaaggtttttaatattttaaaattatccattatacttagcatagaacacctcactttttcatgatttcttccattttgttaatagtagctaaaaacctttctttatcttgcgaattttgatacccgttatcatttatttttctctcaagctggtataattccttaaattcttcccgcaactggcttaatttttgcaaatctttttcctctacgattttgtagaggctacttatataaaattccaggtcatttaaaaggttaaaaattggctgctgtaattccggaattattattttatccaggtatcttttgtcaatcgaaactatttccccaaagctaccgggtcttcccattaaaaaagcatcaattcttccttttaagtagtctaaatccctttcattcttaatctccgaagccttttttactatctgaccaaactcaaaaagccttgtagaatagtcatggttaaatgtcccaaaaacatatccataataagctgaatcaagggtaaattcagcttccgaggaaacgtctttggctgaacagccaattacaattaaaaaaattgacattatcaagataaggtacactaagttacgcactaaaaattacctcctcccctgctcattactcccaaagccacgcaatttgccacactccattaactttttcaacccgccccaaattcttacatctttacttatgtaaatttataatattttataaatttttacaacattttgcaaaaattttcttggtaaaattttaaagcccctggtcttaaatttaaaccgggggctttgtacacaactttttagttttaaaccaggccatttaaaatttcgcaggctttaacggtgtgcttgcacaataccgccgtcgtgaccgaacccactccaccaggaaccggggtaatcttgtcaacaatcggctctactttgtcaaaatccacatcgccgcagtacttgccgggattgtccgggtcttcattgatgcctacatctataactaccatcccgggcttaacataatcttcttttaccatcttggcccggcccactgccgccaccaaaatatccgcttcccggcatacgtccggtagattcttggtgcgggaatgacagatggtgacggtagcattttcccgcagaagaagaatagccgcaggtttgcccaccaccagagaacgaccaaggacaaccgctctcttaccctccaaaggtatgttgtaatatttaagtatttccatgaccgccgtaggcgtacagggcggaaagccggtagggtcatcggcaaaaactttcccggcactgcctaaagtaagggaatccacgtccttttccacgggaatcagggagcggattttccgctcgtttaaatgtttgggcagcgggctaaacatgagaataccgtggatatccttctttgctccaatttcgataatggctttttcaaaggactcctgatcgatatcttggggatattcaaacacctcgtaatccatgccgatagattcacaggttttcttggcgccaccctcatagtagaggtcatcgggccgggctccaacccggacaatgccaagtttcggcacaatccccttagcctttaaatcggctacccttccttttaactcctctttaattgcatcggccaccggtttaccggtaagtctttctgccattttttctccccctttgctactgattcccccaaaaaattaataatgatttattttttaatttgatttatcactaactccagagtctcatcggcaattttgctgccttcatttaataactgctccatctccgcttttgttttttccacaaattcctggtccttgatggtgttcaggttaattaaaacattgagcataccgctaataagggccgatttaaggaataccaccccgcagcctacatcggaaatggccagtttggagccaatctgccccatacgctggtgaattttaatcccttcaaaagctttgcgcataatttccatgggaaccgaacaggcatccttggaacacttctccagggtttcttctttgatttttttctgctcttccgtttccgccggaaggccataggccttggatagaggctcaaacacctcggcatctttgtcaaccaggctctttagctcttcaataatttggcttccccgggcgataagttcctttacttcgtcctccacatcggcgtacttctttttgcccaccgttaagttccccaccatgttggaaagagccataccaatcgctccaccgagagcagccgctccaccgccaccgggcacaggagctttagatgctaaagcttctaaaaattcgttacaggttttgtctaacatagacataaataaatacctccttaaaactttttatttccctgtttttaagatgcacttagccaccaaaagaaaaacctttttactatctaccgcttcctccccccttaaccattggcttaattttcttaaaatgtatttcttttgaatatttgtaatctttccaaaatataatttaaaccgttccccttttattttcccggagttacatcggtaacagtgttttatttcggcaggttttctttttttcctgcccaatcggtcataaaaaaccttaatgtttgccaatagttttatcgttaaaacaaaagcccacccggtttaccggatgggcttaaatctctaccagtatgcagtaaacaaaaaagctcccacttatgggagcctttactttcaatggtcgggctggcgggatttgaaccacacttgtcagatggcttaaccctttgatttaattttttctaaatcaataatatatatggttgtagtcagatctatctcatcaaatgttgccacaagctttccattacattcaataattgaatcaactcttatttcaagcggtatccattccagtttatccatagaatacaattctaaatcactttgactgtccattaccagtatatattttttccctatcctaaacctggttatgtgacccgtaatatttgtgtatgtattatttttaatatcatactcttcaaatttatgagaagtccagtctctaatgttattaaaatttagggaataaattttattcccggcaaattccgcatatcccgggtataaatatttcgactcataggtttttatcttgtttgtttttaaatcataaaacttataatatcctttaccatcgtacgagtcagtccaaagtattttgttgtcattaatgtaaacaaaattgttatataattcaagttgtctaattgtaccaacaacttttgttttgtggttatttaaattatataacactacttttccgttaaaatacttgccatcgtaacgggtgggttcaacccaggcaataaaatccttatacaaaaaaggtgaaattggggtaagtcccttaaaggccaattttgcaattaattttatttttcctgtttttaaatcctttacgtaaattcggtgaagtaacccgtctgcagttgagtcggtccagataagccagttgtcattaatcataagattttgcaccgaaggatcatcaaactccgaggtaaatattttttccgtttgcttggtttgtaaattatatttaatgatattttttgcaaattctgtattatcacttacacacatatacaaatcattacccactaaaactacatctccgattcttccaaaaggaggttttagtgatataatcgcatcagcataaggatttttgttttcttctatggtttcgttgtcttctatattagattctcctgttgcctcattagatggaggattttggttcaccacttcgttttgagagcatccgctccctaaaaagaaaatataattaatagaaaaactactattattagaaatctttttttcaaatttatccaccccaaaaatttataacatcgcttgacgtgcaattgattgagcccaagcttttgagctgttaaaaccacaatagctgaactttcttttttaagtcggccggagcaaggtttatcgttatcctggtgatgggaaaatcaaacccagaattatttggaatatttttgaaaatttttgtttaataccactaaaattctggtataataaaaagaaaatctggtggtttactctttcactttaattacaggtgatttagatgaaaaggaatttgaatgatattaaagggcaaattgaagaattaaaaaaatactgtgaacaaaataaaaacattttagcactatatatatttggatcttatggcaccgagcttgaacgtattaccagcgatattgattttgcaatgttatttagaaatagcccttcactttttgaagaacttgagattgaatctgacatcagccagattttcggacgggataacattgatcttgtcaacttaaacaaaaccccattagatatttgtcatcaagtattatatacaggagaccttttatattgtactgatgaaatagcccttgcagattttaaggagaaagtttttaatgcctacggagattatggaattacattaaaaaaattttatgatgattatatgaaaggattgagagataaatatgcctgaaattgataaaaaaagggttcttgataaaatccgagtaattgaaaacagcttatccaaattaaaaacccttgctcagctcccggtaaatgaatttatatctaaaggtggaatatgacgctaacatatataagttaatggctaaatttcgaaatcgcatagttcatttctatgatgaagttgatgacatcgaagtttacagaatcttacagagcaatcttggagattttgattcatttatcctgcaaataaacaatttgcataattaattttcatccctggaagcccgcgacctccactatttccccattaatgccgtttaaagtaacggtatgtactttggcaagcatttatcttctcctttagccatttttaaatcttattaggcatagatcccaaaattcctctaaaaagaaaaaacctgcttgaaaaagcaggtaaaaagcagatttaaagaactattgtaatccaaaaaaatgataaattttcctcataggcaagaatagccagtaatcgtcaatcattagaattgatacaaaccacatggctaaacccaaaaaggatgctaggacgctttttttgagctggtaattaaacccaaggaatgaccaaatgttaatgaaagtgaaatccatacaaagcttaaaaatagccaccataacgaaaatcctgttaaatagctgacgttgtaaaaagcaagaattgatagccagtaccagcgaaagtttatgtgaattcccaaaattataccaattatccccacaataatactggcgtaagctaaaaaacttaggaacttcattgtatatcacctcaaaaaaagaaaggtagtattataaaaaaatattactttgtaactatccaaaaacttattatttatttaaggaaaatatatttcaccatgaagattacctttagcttctccaaaatgatctatgtcccacatttatttctttccatttttaattctccttttttatgttatctctcgaactactattcaatgaaatatcagactattacgagaaaaatagcatcataattacatcaaacctggaatttaataactgggacactgtttttcttgatgaccggctggcagcagccgcgataaaccaccttattcaccatgctcatatcctggtgtttaaaggtgcaagtaatagatttcaaattgcactctcaaacttaaattttacctcttaagtatctttttacgctggcaatggccaatatttttccgcatttttcattgccgttttaatgcatttttatattgccaatcataatcaatagttttgttttcgtataaaacatattaatttgcatttttttaaaatttaataatgtgctattgtagcaatagcaatagcaataaatagtaatcctacagttgctaacaatgtatttaatcctgtattcatattattattatgaattttctttaaaattataaccatattaataacaaataaagcacacgaaacaggtaagaaataaactaaaaaaattaaaaaatttttaataaaactattcatcaccaaactcccctttaataacatgttatatcactttaatttgacttttacaagtaaattataccatttaactttttaaaaaataaattgtttttaattgcaaccttataacatttattaaaaataataggagccagttaggctcctattatttaatgtaaaattgaacatcagtatccggagcttgatcaaaagcaaaagatggagagaccgacattgaaccgctaaaaaggtcaataccaaataaaagcgctacttgctgatgggcatagtggccaaaagcatttgaataaccaataaaattagaaggtgtagcatttactttatataccatataaccacgattattttcaactacataaccaccatcacttcctaaaaggtcaaaaacaaaagcataaccatttacattttttgcataagctttataatatgtttttgttatagtatctacttgccataaaggaataccatcatcataaaaccatcggtcatatatatattttaaatattctgaacctgaaatagtacttgtagaactactatgagttatagcaacaacatcatttaatgtccaaattggttccgttaaccatgtaaaagaatttttaaataaaaactgtttattccctaagtctgttacagtggtagtttgtgtcatccatgaacaagaatttgtgtcagttccaccactaagaatactaatactacttaaactaattttattattatcattcttttttattctttttttctcacgatagttaaatacttctttgattgcttgattttttgaaatttctacaaaaccttctttaggagtaactctgtaaaatttttgaacagatgaaataacttttccgtttaatttcgaatattcttgatattctctatcatcaaaatttgctatctcatcttcggtaaaccccaattccttaaaatgttctatttcatttttagtataactttttgcaaaagccacccctgaaaacaaaaatgttatacaaaaaattattgtaaatacagtaataaactttctcatataaacacctcctctggagcccatgtgtattttacctaaagctaagctatcggcgaaacgcactcttgtcaaaccaaagccgatgaaatggtatgctggcttgtcgagggctacttttctctgtccttttatccgcagtcgacttcttcgtcacccctaaccaaccatgttcttgcaaatgaaaattaggtaaaccaaggaaagcagaatttatttttttgtcactcctttacttgccattttcaggaatgcattccccttatttactatactgcactttttttttttttttgtcaagacaatttttaaaattttttgttatttatgttaagatttttcttatatctaagctttagatgtgctcactttaacatggcattacaaaagctgattattccaatcccatgaaaaatattaattacacacaaaacaagtaccgtttttctgttatatccattcttctataccggacagaattaattctcttataagtgttgttgttggtatgtttaatttttttgaccagctttctaatttttataaagcctatcttcaacgctgaatgttttcatagcgtttaatactaccctgattcccgtggattttttaccgtatagcttaattcttttttgcttactatttaaaaatcaagatgccttcaggttttttctccgtatcgtaagctttacaacccgatttgcacatacgggacaaacaaatgtaccgcatttttgaaagtcgttttaaatatctaactgtttttcaagatttaattctttataaggcgtgtataaacccatgctggtagcgttgtttaaaacattcatcttctaagcatgatccatgcttggacgcaacaaatataaggctgtagacaaaggtcaatagtcttatgtgaatagattttctttttaatttaaaaaccatgttcttttttgtaaaaaatataataaattaagccaaatggaggaaaacaaaatgcagcaaaaaatccccaaaatagagcggtcaaaaaactccaattatgtttacgacaatcgataaataccaatattcctatgatggctatcagtccaataaccatgatactgaatagacttttaataagatcatagttcatacaatcaacacgatcctttccaactcttaaaagttaaatgaaatctacagttactttatccatatatataccagaattggtgtcatcccaaaaatcagaaataaccatttgtggagaataatttgatacgctggtacttaaatgatatctcaaacagtaggtgtgtccagcctgaagcactacatatattgaaaggttaataggaacattggtgaattgggaaccgatgcctatagaatcattcaccaaaaggatagtagaacttccaatctgactgccggcagtaacatcataaactgtaactttcacctctgctccagcaatacctcccaagaagccaggcacagttgaaccgctgtaactccctttgaaacggatataagcacctttagaacccgctccagacacataaatggttttgcctatataggcccatgacgaagcactccctagaccagtagtccaagtatgggaatcaatagtataagaagaataacgttctgaagcacctgctatcccaaacgtactatgtcctttgttacccatatcagcaacgtagaatgtggcatccgaaccaagataaacagtatttgcactcatggccgaaaccgtgtttccagtgttataagcttcagctgcattcatctctttatctgcctgggacaagagataaataacatccatctttgctcttttggttagtcgatctggatccttttttagttgtttaatttgttccgctgtcaagtccctagttcccaactcaactgacatagggttttggtcagcaaaagacacagaagcaaataatattaaaattaaaaatatagtaagtaacaatattaccagaattcgttttttcatttttctttatcaccccttgaaatcaatttttattttatcctttttaattttaatccttttttcttctgacttttctaaataccatttaaaagaattcggtcatacccaagcattttcaattaatgtccatttttcttcctgttccttagtccaacgctaaaaaaaagattttaatttccgattgaaagatcctcattacctgcccgttttaattataaccccttcctatattccattttcaggaatgcattcccttttattactatactgtacatttttttttttttttttttggtcaatgcaatttttaaacttttttgtcaattgagaaaaatctctttcctctgcactaacggctactgctaccttcgccgttcgggatttttaatcgtgaggctgcaaccatgccgggaacacgaaaaaacccacccggatatccggatgggttttaaatggtcggagcggcgggatttgaaccaccaaagtagtctaaaacaccccaagaactttttcaatctattttccaaacataattaaccgttaaaacttgccaagatctatttttatttcaaagttattttaaataaatttttataactaaaaatatagagattattgggattttcgctgtcgaaaataatttcttccaaaattcgctcactgtgttctaacgatgctacaatcttggctttattctcataaatttgatataaactaatttcataatgtgatttgtttatttcctttaaagttaacacaaaaatttttttagtatcatctcttccaataatacccaaaatttcttcttcttgatgtattgcaggaagttttacttcttcaatttttccttctctcaagcgatataaacctctaccatcgataaaataaagattttttaaatctactggatcaaaagcaatgccccggggctcaccatctaaaaaaacattttgccaatgtttccctccatctaagctttcccaaagcccattacgtgctgtaatataaatttgtttttcgtttaggggattaataaataattgggtagcataaaaaatttcctgcacagaaaatttgaaattccaatgttctccaccgtctcggctaatataaactttaacccctataggctctttattttgaataagataataagtatcagggcttttggggtcaaaaattattttttcaactttgccttgaaaaattttatgccattttcccccatctttacttttataaactccttgttctccggtgtaagaaataaaataaatctccttgttattttttgggttaataaaaaactgaccaaattgatttggaaattgtaccaccaagttataattctttaaatccttactttcgtaaagggatatgaactttttcgggtaatcctgcccttgctgtgcaaaaaccgtagttcctcctatccaaagaggacgaaaaaacccttcaggtaaaggatattgagttatctttacctgaaaattatcaatacggaataagtttttcttgtttcgctccacattcggccaacaaccacttaaaataatggtaattataaaaaaaatcatcgttttctttaaaattgaccacatttatatttacccctttacggcattcgcacctgttcttactgctgctggtgctgtttactttaattaattctacttttcaatatataaaatagaatctccatatcttattccgaattttcccttatgtcctttatctaagacaaaaggttttgaatccatcgaggtcatttgcaaaagctttgccaacctatttgtcttaatattataaatgaaggcattatgacttgttgaatcaataaggagaattctgtccccttggattttatatgaaaaaagattttttacatatttcgaaaaatcaattttataaaatttcccattctttttattaagtatgaatagctcctgattaaaatatttccctctaaatatcacaaattgttgatttccctctacgctaaagggttcaaattcctccggtatttttatcgataatgtatcttttttattacctaagccctcactatggagataaatattaccggcagcatctttttgaagataggttaagtaatcttcattaataattgcccgcaaatacgtatgtggtatataaatgttgttcctttcttccgttgtattatcattgaagttataaatctttagtattaatccagaagtgtttctcttatctggttcaaaccatgttaacaaattattattagcttcaataagtaatggagcaaaatttatttcgtaaattttttcaaactgttttttggtcaggtcatactttattattctggtataattaccctcttcttcccaaaataaatagtttcctgaaaccgagagttccgcaagaccatgtagcccttccttagtttcatacaaaacattatattgatgattttttaaattatagttaataacttgtgttttttttacttcaccaaaatttccatagaaatctacggatacataaacattgtcaccatcaaaacagtaatctcccatcgatgtattgttaggcaggttaagatcattcaacgttatcttattaaaatgatcaaggactgtacctttagataattttggagttaccaaaatgagatcattcagattaaattcgtattttccatctacattttttgttttatgattagatagcaatataaagaaaaaaaagaacaatattattatactggtaaaaacaattataagttttttcgtcatttctttaattctccttttttatgttatttaacaaattatcttctctgaaattgccaaaaatttttcaaagtaaagctgcatgctgaggtggttaggttagcagctcaggatgctggtttctaatcgtgcccggtagcacttattcggccggttttctttttggcattattacttataatttaattatattaatatttttcagctttaatcttaaaggtctggtcgtttccagtagcaatcatggaaatagtataataaaattgttcttttgttttttcattaattataggaataattattccttttatctggccttcctcttctttaaatgttatctgtaatggttctttaaatataaaatagggtttatcggcagctacatctattgcataaatgcctcttttgccaacgtacgcaacatttgatcttttccctgtctttttatcttcatagagtactatcaaatcaaaatttttatcattatcgaaatcaattattttagtatataatatattgctatctggccaaaaagatttaaaatcgcttaaatatttttcttcaagttttccataatctatggctaatactgtttgtttttgcttatttacaatttcattgtatgaaggttcttttttaatattatctttacatcctgttaagaataggattaaaataacaataaaaattaactttcctctcaatttaatcacctcaaaatacggcttctatttgttaaatatattaagaattagataatatcgtgggaaaaataatgcaacctttacactttcatcaaatcggtatttaataattaagatacttataagaagtaaggttattaaaattaatagtagaccatggcttttatttaatttcattatttcaccactattttaattttttatgctatgttttgaaacaattaatctgcatacccatcggatgattggatagaatagaaaaatttatccgaaccaaaattaattttttgtataaatccatgctacttatcagacggcttaaccctttgattttattttttctaaatcaataatatatatggttgtagtcagatctatctcatcaaatgttgccacaagcttaccattacattcaataattgaatcaactcttatttcaagcggtatccattccagtttatccatagaatacaattctaaatcactttgactgtccattaccagtatatattttttccctatcctaaacctggttatgtgacccgtaatatttgtgtatgtattatttttaatatcatactcttcaaatttatgagaagtccagtctctaatgttattaaaatttagggaataaattttattcccggcaaattccgcatatcccgggtataaatatttcgactcataggtttttatcttgtttgtttttaaatcataaaacttataatatcctttaccatcgtacgagtccgtccaaagtattttgttgtcattaatgtaaataaaattgttatataaaccaagttgtctaattttactaacaacctttgttttgtggttatttaaattatataacactacttttccgttaaaatacttgccatcgtaacgggtgggttcaacccaggcaataaaatcctcatacaaaaatggtgaaattggggtaagtcccttaaaggccaattttgcaattaattttatttttcctgtttttaaatcctttgcgtaaattcggtgaagtaacccgtctgcagttgagtcggtccagataagccagttgtcattaatcataagattttgcaccgaaggatcatcaaactccgaggtaaatattttttccgtttgcttggtttgtaaattatatttaatgatattttttgcaaattctgtattatcacttacacacatatacaaatcattacccactaaaactacatctccgattcttccaaaaggaggttttagtgatataatcgcatcagcataaggatttttgttttcttctatggtttcgttgtcttctatattagattctcctgttgcctcattagatggaggattttggttcaccacttcgttttgagagcatccgctccctaaaaagaaaatataattaatagaaaaactactattattagaaatctttttttcaaatttatccaccccaaaaatttataacatcgcttgacgtgcaattgattgagcccaagcttttgagctgttaaaaccagggttttgcataactaattatctccttagtggtaacatttaccgcataaaaaacttaaacatttttaaactttagaatatcaaggaaggtctccaatatttgtgggttaacacatctctttcttcatgcatcccttagaacttttgttataaaccatttatcacctatttttttgaaacaaatatgctcataatatattgttgaagttggagcaccaggtgcaatagaagccacggctactataatctctttctcttcttttatattgcttttttggaatttaaaagaaactattttttcaaatttatgttccttaaaaagcttcagttctccacttataacttctttataagcattttctttagtaattttaagtaaggtcttttcatcacctttatacttagccaatatatattttgtcgccaactcttttaagtttttttctaagtcacttaattctggactttccgatttatcagctttatatactttgtttttaaccgttctattacgggtaaccgtcttttttgtagtattttcggtttcagtacaaccggtaataaggcttagtaaaattaatgctacaaagaaataatatgctcttttttcaataacccacatttttattccactcccccaataaacttcccctgaatccttcgttctacctgctctggagatgaaatataagaaatgctcactttaatggactcaaacctaaaattatttggaatatttttgaaaatttttgtttaataccactaaaattctggtataataaaaaggaaatctggtggtttattctttcactttaattacaggtgatttagatgaaaaggaatttgaatgatattaaagggcaaattgaagaattaaaaaaatactgtgaacaaaataaaaacattttagcactatatatatttggatcttatggcaccgagcttgaacgtattaccagcgatattgatttagcaatgttattcagaaatagcccttcactttttgaagaactcgagattgaatctgacatcagccagatttttggacgggataacattgatcttgtcaacttaaacaaagccccattagatatttgtcatcaagtattatatacaggagaccttttatattgtactgatgaaatagcccttgcagattttaaggagaaagtttttaatgcctacggagattatggaattacattaaaaaaattttatgatgattatatgaaaggattgagagataaatatgcctgaaattgataaaaaaagggttcttgataaaatccgagtaattgaaaacagcttatccaaattaaaaacccttgctcagctcccggtaaatgaatttatatctaaaggtggaatatgacgctaacatatataagttaatggctaaatttcgaaatcgcatagttcatttctatgatgaagttgatgacatcgaagtttacagaatcttacaaaacaatcttggagattttgattcatttatccggcagataaacaaattgataaattaattttcatccccggaagcccacggttttgtccacctccacctctactttttcgtcattaatgccgtttaaagtaaccgtatttactttagaatcgtttattttcttcttttgccatttttgtttcttattcggcatatttaccaagcaggaaaaaaggattcgcctagtaaagcaatcagagacagctaaaaacgtcaccaactaatgtaaactaaatatagttatttagcattagcagtaacccattattattcaaataaactttctgccactttagttaaatcgtcaaccgatatatttagtcctcccacaaggtagtagcaattatctttccagaacatgatttttactggttctccttcactttcataaagcaaccaagcatcagttcctgcaatctttattttttttgcatcgttaatttcatttggctttgtatttccgttatcatttgattgtataattaccaaaaatctcctttcattttttatatcttgccacccttgaattactgctttaagagcaccaacattttcaaccgtttttttcttgaaaacaagtcctctgggtaaatatttaggtatttttaaattgtacggtaaagacacttcattattattagaatttatactagaataattactatttaatcttgcactaactttattattattttcagctaaagcataaagataacctgaaaagattaatatcagtataaaacttattaaaaaccacattttaagatatttcatagtattacgcaccttcctttataaacaaataaccgttaatttttcaaagtcatgatctacatgccagtaatcattttgatttgttaaactacaatcaatgtaccaccctgaacaagcatccctaaagtactttgcaggatactgatcagaaaaactataaataaaggcatagaattgtcctgaaccaccattggttccaagataaaatctatagtcttgaaattctccccacgtaacttttccaacaattccatcaacttgaattttttcactacgttgaaaatcttctatacctttttgggttaaagaaccataatatccatcaacactactatatccatatggtgtatcttttaacatccgttggattgcaagaacatacccaccagaagttacatatccgtaacctacatagtcattattataccaattgtcttgcattggatgtgctaaaactatttcaggtagagaaattacgaaaatagtcattattatagctgtcataattttctttcctattttcataatatcccccctttaaatgtacattcaaggatttcattaattaaaaagtaggataatcacttaaaagcacctttcaagtgatttaatgtagcgatgagtatcccagagtaccacatcttcaaaaattattttgctttcagtcgtgtaactttttacattctattggaggtttttatattttaccaaccattattttttagtaagctttttgcgtaaattttccttttctttaatctattaactcattaatttactacctttaattataccaccccttatttcccattatcaggaatgtattcccttttcttactatactcacacatttttttattttttgtcaatataatttttaaatttttttgtcaattaagaaaaatctctttcctctgcactaacggctactactaccttcgccgttcgggacttttacccgtgagtctgtacccatgccgagcgcacacaaaaaacccacccggtttaccggatgggcttaaatctctaccagtatgcagtaaacaaaaaagctcccacttacgggagcttttactttcaatggtcgggctggcgggatttgaacccacggcccctaccaccccaaggtagtgcgctaccaagctgcgccacagcccgacattcatcggagacatcttatattttaaagagaaaacagcttcatgtcaagtacacagaaccttttatcttattccaggtatagcaaataatgcttcccgggattaaagggaattcccagaagtttttctattaaagcaaatccgtatttggcaaggtagtaaaaaacattatacacccgctcctgccattcgttctccggcaggaagtttgtttttaaataccataatttttcaatgtatttactgttcttttctcgatggtatttttgggcccgctcctccaggtacttcacctgggccataacccttcctaagttttctccggtaagtttttgaaaatccgcccccagtggggcaagtttttcctgcaagttcttataagccgaattgatactttcttttaaggctttaaaggtatcgtcaattccaaggttgtccaatcgctccaatacccggtgaaatactccgtcgtaatcttgataaatttcctgcggtaaaagggcaaattcttttaaagctttctccacccgcggctcaattaaagttgccgtaaacctgggaaggattaccggcatctgggtacccattatttcatacacttcttttaacattccgtagtaaccgatttctccagggccagccacataagccagtaccggaaaaaccagcgactggatggaagtcctgactaccaggttcggacttaacttttccgggtatctttccataaactccaaaaactcttcccgggtaaagcttacttccccatcccggcttaccaccttttccccggccacttccaaagcaattctttcgtcgtttttaaagataaacatgttgcagtggttaggacaggggtcaagctgtggctcaattccaagactttgctgctcggtatatactttaaataaagccttttcaatagcgtccctctttaaaaaagcatttttaagatagcctttggtaacccttttaaattccggatttaggccatcataaactaaaaggccgaatttaccaaaaagctttaacattaagcgggcaaaggcctggcctaaattggccgaatggtaagcttttttaatttccgtaaaaacttcttctttgtaatcaaaatttggtaataggccctcgaacttttcaatggcttcaacagtttcaggttctgctggcctcagtccagccgggatttttcgcaggtcagtaaattctatttttatttcctggggcccctcctttccagggaagtagagaaaatttacctcctccacatcgtggtcttcactgccaatccaaaagaggggcacaacttcgtgatttagcaattcgcttagtcgttttgcttcaataattgcatgaactgctttatatatggtatacaagggtcccgttaaaaagcccggctgctgcccggttaagacgataaatgctccctttttgattttgtcgagattttccacaaccttttggtcaagtgcaaaatctttcaggtaaaagcttaataaattatagagagcttccggattactcttatcttttaaataatctgccctatcataaaagcttcgggtattccaggggttgtaatggtaaaacttggctactctgtcgtacccggttaaataatacctgaccagatttttttcgtaacctaaatttatttcctcgtaccgcattgcctgctcctctgtttttcttttatcttaccatagttttctttaaaagttaattgtcgccctccggccagccacatactccaaaaagttacttaagattggcgccattttggaaaactcaattaaaaaagcatcgtggccgtgaggagaggaaagttcccagtaataagcctcttttttggcttccttcaatgcttctacaatttccttttgctgataggttgggtaaagaaaatcggtgtcaatgccaatagctaacaggggcgttttcagttcctttaaaatttcccggtagcgaccccttccgcggcttatgtcatgcaaatccatagcctttaagagatacaaataagtattggcatcaaaccgctttactaatttatccccttgatagtaaaggtaattttcaatttcaaagcgggaagtatgactgaaaagctcctggtccgtttcataagtgtgggttcgcccaaaacggtactgccaggaaatatcgcttttgtaggtaatgatgccaatcatcctagccaaagccaatcctctttttgggccctcaaacccgtaataatttccaccacgccactcggggtcggtcatgatggcttcccggccaaccgcattaaatgctataccaaagggggaaagcctggcgctggtagcaatggccaccacgctttttaacatctcgggatacatgtaagcccactctaaggcctgcatgccccccatggagccgcccaccgccgccaggattttcgtaatccctaagtgacgcaccagcttgtactgaagattaaccatgtctctaatggtgataatgggaaagctcatgccccagggcctcccggtagcggggttaattgaagaaggcccggtagtcccgtagcatccccctaaaacgttggagcaaacaataaagtatttattggtgtcaaaaggccttcccggtcccaccatggggtcccaccagccggccactttgtcttccggccggtgttttcccgctacatgggcatctcctgttagagcatgtaaaatcaaaatcgcgttatctccccgctcgttcagttcgccgtaagtctcataggctaccgttaccggagcaattttttcgccgcattctaaagttatttccggaaaagtaaccttcttggtttccacaataccaaccgagccgttcatttttcctcctacacctgtgctaaagcattatctaaatcctggattaaatcatccacgtcttcaatgccaatggacaaacgaattaaatcttctgttactccggcctttaaaagttcttcactgtttaactggctgtgggtagtagatgccggatggatgattaatgatttagcatcccccacattggcgagatgggagaaaatttttaccccttctattacttttttcccggcttcgcgtccaccttttactccaaaagtaagcattgctccaaatccgtttttaaagtatttctgagcccggttatagtgagggtggtcgctaaggcccgggtagttgacaaaggtaactttcgggtgcccttttaaatactcagcaattttaagggcattttccgaatgtttcttcattctgagctccaaagtttctactccaagtagtatcaaaaacgcattaaaaggagaaagggatgcgccaatatcccgcaaaaactgagtgcgggccctggcaatgtacgccgcggccccaaacttttcggtataaatcatgccgtgataggcgggatcaggagtggtaaactgagtaaaaccccctgcttcccagtcaaaatttccgccatcgacaatgatgccgcctatcgccaccccgtgaccgccaataaatttggtaagggagtgaataactatgttagccccatgttcaagaggccgaaagaggtaaggggtagcaaaggtattgtccaccaccaacggtattttatagctctgggcaagcttggatagagcttcaaagtcaggaatagtaagtccgggattgccgatggtttccacataaagggcccgggttttaggggtgattaatttttcaaaggattccacttcaacattttcggtaaacttgacatttatgccaaaggatttaaaagtattggctaacaaggtataagttccaccgtaaagattggaagaagcaacaatttcatccccggcagaagcaagattcaaaagggcaaaggtgattgccgcctgaccggaagcaaccgctaaagctccaatacctccttccaaagcagcaatgcggttttccaaaacttcggtggtcgggttgtcaatgcgggtataaatgtaaccgccaccttccaaattaaataatgctgcagcatgctcggtgctttcaaatacgtaagaggtagtttgatagatgggaaccgcccgagctctggtttccctgtccggtttttgtccggcgtgaagcgcttttgtcgcaaatttcactacaatctctcctttctttccggctactttagggacgggtctgatatttgcgtctaaacgcctaaaaaaagaacctccctgattttggtgtttaaataaaaaaacctcttccgacaagaagaggctttggtttcctcctcttatctctcaggattatcctcctgcaggatttggcacctttgccaaaaaggccggttgccgggcttcatagggccagtccctccgccgctctcgataagagtgtttcgctattcgctatttacttgaaattaattctataaaggataaaactatttgtcaattacttagctcaaattttttgtagataggccagagaatagctctcgatattgtgacctttttgtaaaggtcagttatccttcctcagtttccagaaccttttgcatccgagtaataatctccggataactatccaaaagtattttaacacactctcggtcaattctgttggcccgaacttcgttaagtaaaatctctttaacctcccggtattctaaccccttccggtaggggcggtcttcagttagagctacaaacatgtcaactacacctaaaagccgttcttgtagagaaatttcttcgccttttttcttaaaaggataaccactaccatcaagcttctcgtgatgaaaagcagcggtgcggacaatctcctcaggaaaaacgtctatcaaccaatagtaggtataaaaagtatgctgttttattacgctaaactcttcccgactaagggccgcaggtttttccagtatttcttcgggcaccgtaagttttcccaaatcatgtaaaagtccagctacttctaaagcttttctctcttccaagttaaagccaaaaatctctccggcaaactttgccacttccgctataagctgtgaatggtaaaatgtgaagtgagatttatggtcgatgattttagcaaaaagttgcgcaatatttatcacttcatcaagctccagccacctgtgctggcctggatgtatatttaagcattgatttagaatatccccatcccctaaagtaagccaaaagtcctcagtttctgcaaccactaaaaacacatctactatctctgggtcgaaaagaatattcttaccagaaactattttttccactaccttatctttcaccagtaagggatgcatgttatcctgaaagaaaaacgctacccggtcagcaagataaattatccggctaaacagcggaatttccttaccagcaagcccggttttatttttccctttaaaatgatcgtgatggcttaaaataacgggagcatattgatcaaaatacgtgtttttaagaaagttataaccccgcaggcaatgttcaaactcctcttcctcaaaaaagttaataagctgctcgtccttgccccaaggcaaaactccaatatcatgaatcattcctaaatatataaggtcgtttttttcaaactctgtaagtcctaatttatcaccaagcaagtaggaaacataggcaactttccaatgatgtttgttaaggcctaattcgttagcatcaaaagctgaaaacatattttttattaagttaaaaaagttaaaaaagttaaccttaatggtcaaaactaatactcctttcaataaaattaagtagttttaccttggacctcatcctggcactacttttgtgtgttatgagaaatcaagaaacattggtcccctttttgaaccagatgaataacctcgtctggaggcaatggtttgctaaaataaaaaccttgaactttatcgcacccgctctctattagacactcaagctgctctctggtttctaccccttcagcagttacaggtagtttcagcctgtgtcccaataaaataatcgcatctattatagccttatttacatctatcttaataccattcacaaacgacctgtcaatttttaaaccatcaaccgtaaatttttgcatatatctaaaagaactgttttcagtgccaaaatcatctattattattttaaccccagcttttttcaagtgataaaggttttcaaccaccgtttccaccgcttctataaggacggtttcagtaatctccagttccaggtatctcggttcaagttcaatttcttttaggatatcacacacaaccttcgcgaaattaggctgctccaactgatgcacagaaacatttaccgaaacgctgaaacccgaataccccataccgagccattctttcatttgtctacaagctgtccttaacacccactcacctatagatattatctgccgggtctcttcagcaataggaataaagtgaaaagggctaatcattccttttttaggatgttgccacctcaaaagtgcctccatactcgctattttacctgtctttaggtcaataaggggctgataatataaaatgaactgatttttttccaaagccaaccttaaatctcttttaactgtattagcaaattctacctcgctcttcattgctatgtcaaaatattggaaaccattttttccttttcttttagccgtgtacatagctatatccgcattcttcagtatagctctttcactttttccatgatcgggatagatggcaataccaatactaatagtaacgggcaattcataattattgagttttattggttggtcaaataattccaatattctttttgcaaccttatccgtatcctcaatactatttacatcaggcagtaaaatgataaattcatcaccgccaaccctggatattgtatctgtttcccgcacacactttgttaattccttggcaatcttcttcaatagcctgtctcccgtatgatgacccaaagagtcgttgataattttgaaattatcaagatcaacaaaaaacactgcaagtttcttcccattccttctggcatctgccatggcaactttgagcctctccagaaaaacatcccgacgcggtaggttagtcagagggtcatggaatgccatgtattctaatttgctttccatttgttttctttgagtaatatccgtgtgcgatcccgccattcttatggctttgccctctttattccataaagcctttcctctgcttaaaatccatatatattttccgtcctttgttttgattctatattcgcataagtaaaatggcgtctttttctctaaatgattacgtaaattattaattactgctttcacatctctgggatggataaatttaatccatgtttcacagtagttatttattacttctttatcaaaaccaataagatctctccacctttcggagatgtaggcagtatccgtttccaaatcccagtcccataacccatcacttgctccttcaactaccaatctgtaacgttcttcactttttttcaattcatcctgctgcctttgtatttcaattaagttctgtctcacttcttcttctcgagccataagttcttcattcattgccgacagctcttcctgctgagccaataattcctcgtttaaagcaagaaggtttctatttgcttcttcaaatctcttttcggttttctttaattctgtaacgtctatcccggtagaaacaatgtacttatgcccttcctcatcgctgaaaatactattatgccacataatataaatttctctaccgttctttaaaaccatcggtttttcgtctatgtaacgaaaacttctctctccagtatcatccaattgttcttttaggtaactaattaaattttccggaatgattaaacttacatctatcttttctaattgttcctctatcgctatatcaaataaattctgagtatatctattgaaccaaactactccactttccagcgtccaaaccactattaacaactgctcgttttccagaattttacttagaaattcttctttttgcttaagataggtgattgatttctgggattcttccataaaatttcccttttttctgggatgaaattccctgtcattcattgttagatttccttcctcctctgtgtcttaactaatattgtaagtatccaaaattttgtgcagtcctttttgggcctaaacagatttttatagtttcggatattctacacaaagtttctaccggttttgtcctgtctggccgctttaatgagacttttcagaccaaccagtaactcctggctttctttcatgaaatcaaaaaataccttcgaccctcgaacttgagataatattttacacgtataaaaagaatgacttcattgtaatgattatttcttacaaaattattactctctaaaaccttccctgaatgggagcatcaggtaccaaaaaataactgtagacgaaaattgtttattttaattgtactcactgtccaacatttttcaaccactttactatgttttttgggttgcaattttttagtccttaaagcttttagataaattagtgtttttttattttcttttttacttttaaaagaatataaaaataaattggacattatgtccatttattgccaaagaaaagcacttacgttaaaatatttaaaaaataaatttttttaatttataatatttttgcatcaaataaaaattttaatgaaaagagatgccgggttgatgattatgagcggtataaacaagataaaaaaacttcgggaagaaaggaaaatgagcaggaaagaactagcagataagcttcagatttcctactgggctttaagtaaatatgaaaataacgaacgcacccctgatattacccttttacggaaaattgctcaagaatttggagtaagtattgaataccttgcaggactttccgacgaaaaccttctcccttcaacttccccagtaatccaaaaaatccttcaacttccacctgaagctttaaacgaaatcgatctttttgttgattttttaaattataaatataagttaaaagcaaaataaacccaaaaaaagcactgcaatttaggcgcagtgctttttgtagcttttaacttataccccattaccgagttcaaattttttatggatggcatttaccgctctttccaccgcatcttccgcaataatgcaggaaacctttatttcggaagtgctgatcatctgaatattgatattttcttcataaagggcttcaaacatcttagccgctaccccgggataggtaaccataccagcgccaacaatcgacaccttggccaccttttcatcataagtataccctctggcggaaagctttttgactacatcttccaaaatttccacagtttttgccaggtcattttttcctatagtaaaagatatatcgttttgtccttcttcttttcctgcactctggataatcatatcaacgttaatgttatgggcagccaattcggaaaacaagcgatatgccaccccgggctgatcgggaacaccaaaaaccccgattttaaccacatttttatcatgggcaactcccgtaacaacaccctttttctccaaatctctttcctcctttaaaaccgtaccttcgttataattaaagcttgaccttacatggacttcaactttataattccgggcaaaatcgaccgagcggggttgcaaaaccaccgcccctaaacttgccagttctaacatttcctcgtaggatatctctttaattttccgggcatcgggcacgatccggggatctgccgtataaaccccgtccacgtcggtataaatctcgcaaatatcggccttcagggccgccgccagcgccaccgccgtggtgtcgcttcctccacggccgagggtggtaatatcgccctctcgatttactccctgaaagccggccaccacagctaccttaccggaatttaaacaagcgataaccctttccggtttaatttcggtaatccgcgctttggtgtgtacttcatcggtataaataccggcctgcaacccggtaaaagaccgggcgggtacccccagttcgtgtaaagccatagccaagagagcaacggaaacctgttcccccgtagataaaagcatatcgatttcccgggccggagggtttggacttatttctcccataagatctaaaagttcgtcggtggtatcccccatggcagaaaccaccaccgccacccggtgccctgcccgatagtattcggcaacccttcgcgccacattttttattctttcaggatttgccacggaactgccgccgtatttctgaactactaacaatctccttcccccttgtaatttattaaatcaatagctccccgctcttccggacgggtatagataatttcagcttccacaccaaaatttaaaaacgtttcttcaatcgctctgcctaccgccttaccctctctggccagagcaattaccgtaggcccgcttccgcttaaagctactccgtaagctccggcttttttagcttcctctactacctgataaaagccaggtatcagttgactgcggtagggttgatgcaaataatcttccatacctatttgtaaatattcatacttttttaagcaaaaagcagcaattaaaaaggaaacccgattaacatttagcaccgcttgggaaaagggaatttccgccggcagtatctgccgggaatcggcagtttttaactgaaacttgggtatagcaaccactacctctacctcgggaacgggaagtttcaggtattttaccttatcccggtcgaacccggaaaccaccacacccccgagaagagccggtgctacattatcgggatggccttctaactcggtagccaggcgtaaaagttcatccttcggcagcggatttcccaggtaagcgttcgctgcaaccagaccaccaacaatagcagcagcactgctgccaagcccccgggctaacggtacgcgatttttcagggttaactttaagtttcggggcgtttttcctaacctctcaaatattttagttatagcaacgtaaacaagattatttttatccctggaaattaattcagccccatcgccaaaaacttctatttccagttcctttggcgatggcccaaggcttacttcattgtaaaaggaaagagccatccccaccgcatcaaagccaggacccaaatttgccgaagttgctggaataagtacgcaaaccataaccacaccttataagataatttttaaaacttcgttataatccggctccaccactgccggctgattggcattttgttttaaagcattgtccgggtcctttaacccgtgaccggttaaaaccaagaccaccacatcgtcctggttaaactcgtgctcccggcggtattttaacaatcccgccacgctggccgccgacgctggctcggccataataccttcttttcttgccaaaagccggtaagcttcgataatttcttcatcggttacataagaaatttttcctcccgattcattggccgccgccaccgctccctgccagcttgccggattgcctattctaatggcagtagctattgtctcgggattgggaatcggctcccccttaacaatggccgccgcaccttccgcttcaaaccccatcattttaggaagttttttagttttacccagctcataatactgtttaaacccccgccagtatgcggtaatattgccggcattacccaccggaataaataagtagtccggcgcatcccccagaacatcgcaaatttcaaaggctgctgtcttctggccttcaattcggtagggatttatcgaattaactatagcaatcggatgatttttcccaatttcccgcaccaattttaaggcttcatcaaaatttcctttaatggcaattacttttgctccgtaaaacaacgcctgggctaacttccccaaagcgatatttccttcgggtatcaaaaccacacactttaaccctgctttggccgcataagccgccgctgccgccgaggtattgccggtggaagcacaaattaccgcccgggctccctcttccatggctttggcaaccgccaccaccattccccggtctttaaaagagccggtaggatttgccccttcaaatttaagataaaccttagcccctaccctttgggaaagataaggtgcgtaaattaacggcgtattaccctcatttaaagttaaaaggggagttttttcggtaactggcaaatactcccggtaagctttaattactccttcccagcgcatttagaaatccccctcagctcttattacgttggcaatttctcgcaccgtggacatcccttttaagatggaaaccgcatctctgatatgccgctcttttacccggtgggtcataaccaccagctctgctaaatcttcgatggagcgtttttgaataaccgaagcaatgctaaccccctgattaccaaacacctgggcaaccgaagccaaaaccccgggtttatcttccaccacaagtctaatataatacttggtgctaatttccccgataggttttaccggcttttccaggtaacaggtacacccaattcgtccggtatcgtggtggctaatattttttaccgcctcaataatatccccaaccacagcactggcagtagggaactctcccgctccccggccgtaaaacatcagaggtcccaccgcatccccttccacaaaaatggcgttaaaaacatcattaaccgccgctaaaggatggctctggggaataatggtaggatgtacccttacctcaatcccttcctcatcttctttggcaatccccagcaattttataactccacccagctcccgggcgtactgaatgtcaatgggagtaatccgggtaatcccttcggcatacacatctttaaaagtcacccgggagttaaacgctatggaggctaagatggcaagctttcttgccgcatcaaacccttccacatcggaagttgggtccgcttcggcatagcctttttcctgagcttcttttagcacctcttcatagggagcaccgtataatgacattttggtaagcatataatttgtggttccgttaatgattccgataacttctttaaaattgtttcccgcaaggctttcctttaaggttctaataatggggattcccccggccacactggcctcaaataaaaagtctactccctgttcttcatgcgtggcaaaaagctcccggccatgttcggcaaccatgtctttattggcggttattacacttttgccgttttgcattgcctgtaaaacgtaatccagagccggtttaatcccgcccatcacttctaccacaatttttatttccggatcatcaattacctcccgggggttttcggtaaataaatttgaaagctcggggtaagttttttgatacttttcgagatttctgaccaataccttggcaatttccacttctacgcccaaggtgttataaattttttcccggtgggagtttaaaactttataaactccccgccccaccgtaccaaaacccagaagtccaattttgaccgctgccatttcctctcccccttgtttttttgtttttaactctggcctactaactccactttgcttactccatccatttggcttaacgcttctaaaagctcctctatactcaccttcatttcttcggtttctatgctgatggttacattggcaattcctcccaagggcaggttttgattaattgttaaaacgtttccctggtactgggcgataaagttcaaaactttagatagaaccccggcccggtgttccaagtttaacgccaaagtaataatttttcccgaagctttatggtaaaagggaaaaaccccgtctttatacttataaaaagcgctccgggaaatccccaccttttccaccgcctcattgaccgtaagctccggccttttgctaagtaactccttgacctcggcggttttccggatggcttccggaagaatgtccacagccaccagtaaaaatttggtttttttcatcttcctacccctctatgtccttgtagggtggatttttatccgtaattggtagacattataacattgttttccccgtttgacaagatgttttggtaaatttacgcataaaaaaacaacctgctttaaattaaagcaagttgtaatcacttaccgtaatatcataaaaaatcctacttggcaaaataaattactcccggtaaatctttaaaatgctggtcagaagtcaccacccgacaaccaaaagctgagccagtagcataaataatagcatcagccataggtaagccataacgaatagctacctcagcagctcccagagccaggttgatatctaaaggaactatttttgtttgctgcatttgagcggcaataagtaaagctttctcttttccctgttcttgccaaatcttttttgttacttcataaattacaattgcaggtgtaagtatctcctccggttttttaaaataaggagcgaaatcttctgccagcggaccatcagcaaggaattcaagccacccacacgaatctataagaatcaaaaccgttcctcctcatcccgctcaatatttgtatccataccccgtaagaaaccacgcatttcagaaagcggacggcttggaattaaacgtatacttccattttccacaaggacatgtaagcgctgtcctttctttattccaagggttttacggatttcagccggaagcactatttggtacttactggaaactatcacttctgccatcaaaacaaacctcctcatacttaaaccctattgttaatataaatgtataccaaaaaagtaaagccgtcaatacaaaaacccgctccctttaaagagcgggtttctcgctaaataatgatacagattaaaccgccgccgccatcgttgacaatccgctggagggtctcctgaagtttgacctgggcattttccggcatccggtggagcttgttttgaataccttcccggactaagtcgtggagggacttaccgaaaatttccgactcccagattttcttgggattttcttcaaactcttttaacatatactggaccagctcttcgcactgcttttcggtaccgataatcggagtaatctcggtggtaatatcggccctgatgatgtgcatggacggagcactggcccgaagtcttacgccaaagcggttaccctggcggattaattccggctcttccaggttcatttcttccagccgtggagtgactaccccgtagccggtttcctttacttcttttaaggcaatcgccactttatcgtattccttcttagcgtagcttaattctcgcatgagccgcagtaattcgtgctcgcctcttatggcatagccggatacttcctctaagaccctgtagaacaaaccttccttagcggcaactttaatgcttgcctgcccggtacccatatcaaggttttctaattcaacgttatccacatactcgttttcggaaagtctggccacagcgttgttgatatcttttacttttttcacattttttaaagcttcatgcaccgctgacgtaaacttttcttttaaccagtgggttgcatctaactcttcaatccactgcggcaggttaaaattgacatcgaccagcggaaattcatataagagattctctaaaagggcgtttaagtcatttatgcctatctccgctacatcaaccggcactaccgtaacgtcgtacttttgctccaactcttccgccaaagctttagtttccggagcattggggtgggttgagtttaaaactataataaacggcttttctaactgctttaactcctctaccacccgttcttccgccgccagataattttcccgggggatatcggtaatagaaccatcggtagttaccagaaacgccatagtagagtgatcggtaatcactttccgcgttccgatctccgccgcttccgcgaagggaatttcttcatcaaaccagggggttaaaaccatccgcggaccgtcttcttcctcatagcccaaagctcccaaaaccggataacctaccacatccaccaagcgaacgttagcttttacactgctgttgatattaatttcgatagcttcgttgggaatgaattttggttcggtggtcataatcgttcttccggcaccgctctggggcagctcatccttggccctttcccggtcgtaaacgtttttaatgttgggtaaaattaaaagttccatgaattttttaattaaggtagatttccccgtccgaaccggaccaactgcgctaatatatatattgccagaagttctttgggcaatatcccgaaataaatccaccctttccattacgctacctccttcgccctgtatatttaaatcttattgaggacaagataggttttattaatatcctcgctaaaatatattggggcgaaggaagttttattactatttttaaaaatttaattcttcttttttagctcgcgtcattaaaccaaaaagtccttctcggggaggcaaaccggcaaacagcaccttatataacgcctcggtaattggcatctccacttctaaccgttgggctaactgatatgccgcccgggttgttctaatcccttccaccaccatatttatttctttctgggtttcttcaagggatttgccttccccgattaaaatcccggccttataattcctactatgccggctgcccgcagtcacaaaaaggtcccccaaaccggataaacccataaacgtttcctttttggctccaagcttaattcccaggcgggtaatttcaataagtcccctggtcaccaaagccgcccgggtattatctccaagacccagtccggtacaaattcccgaagcaatggcgataatattttttaaacttccgcccagttccactcccgttaaatcatcgttggtataaacgcggaagtattctgtagaaaaaagctcctgtactttataaagtttttccggagaatacccggaaactacaatcgccgtcggaattccccgcccgacttcttcggcgtggctgggaccggataaaatcgtatagttgtcgcggtattccggtaacacttcggtaaacaccgcagacattcttaaaagacttccttcttcaatccctttggcagtattgacaagaatctgctcaggtttaaaatagggttttattttttgtaaaaggtctcgaaacgcctgggaaggtaccgccgcgacaagaaaattagcatctttaagtgcaaattctaagtcagcggtagcaattagttcttgagaaatttttacccctggaagatatcttttattttcccgctccctgtttatttcttcaattaccgccgaatcccgtccccagagcaccgtatttacgcctttttgggctaaaagattggaaagggccgtcccccagcttccggcccccagcacagtaactttaatactacccatggcatcttcacccgttagccatttttcctggtaccaattttattttcggtaccggaccgtaatctcttaatattatcccggtgtcggtaaaaaatcattaccgcaagaaagattcccaaataaatgtaagacaaatctaatccaaataaaagcataattagtggaattgataacccgcaaacaattgagcccagggaaacgtaacggctaataagcatcaccgtaagccaaataaaaaaaaccacaaccgtaactttaatggaggtcataattaaaaccccaaaagtagtagcaacaatcttgcccccatgaaactttaaaaaaattgagtaagcatggccaattacaacaaaaaacgatgctaccagagccccccgttcaccggctaaaagggacccgatataaaccgccaacatccctttacccacatcgccaatagcggttatagctccaggataagggccgaggttccggtaaacattggtagcaccaatattaccgctcccttttttagttatatcgacaccccagagatattttgaggtaagataaccaaagggtaccgaacctaaaatataggccagtaaagcagctaaaataatcaagtagttctcccccgctcccgtaaaacaaacttaagtgtggtaccttcaaaaccgaaattttgtctaaagacattttccaggtatcgcaaataagaaaaatgcatgagctccgcatcattaacaaacaaagcaaaagttgggggcttcgtctcaatctgggtagcatagtaaattttcagcggtcttccccgatctgccggcggtggatttaaaaccaccgcctcccggagtacttgatttaaaatacttgtagccacccgcttttggtgttcaaaagaaactctatctacaagctccattaatttgttcaatcgttggccggttttggccgaaacaaaaattaccggggcatattttaaaaatcccaattcaaaataaatatgttccttgtatctatcggcagttttggcatccttttcaatcaaatcccacttatttacaactataataactccccgaccgtattcgtgaataagtccggcaatttttttatcctgttccgttaccccctcttcggcggatattaccaaaagcgctacatcggctcgccggatggcttttatcgaacggttaacgctgtacctctccaaatcttcctcaatcctgcttttccgccgcatgcccgcggtatctattaacaaatacggctttccctgataccacattggagtatctatggcatcccgggtagttccgggaatgtccgacactaccacccgctcttcgcctaaaagggcatttaccaaggaagacttaccaacattgggtctacccactacggcaatttttactaccggattctcatcttcataatcttcgggaaaatttagttttgaaataacaaggtccagaaggtcaccaacgtttgtaccgttggcagcagaaacaggaaagggctctcccaagcccaaacggtataagtcgtaaaagtttgcgggaggatttaaataatcatctactttgttggctactaaaatcaccggcttatccgattttctgaggtttttggcaacagcttcatcggtagaggtaatgccttcacggctgtcacagacaaataaaattaaatccgcctcattaatggctttttctatctgctcccgcactttggtagtgataaggtcttcggaaaactccaggccgccggtgtctattaaatcgaaaacctttccctgccactccgcttcactgtacaatctatcccgggtaacacctggggtatcttccacaatagcaattctttcgccgataatgcggttaaataaagtagatttgcccacattgggtctgccgacaattgctactaccggtttcttcatttttttcacctcccaaactgcttaattaccgctaatagctcctgaggcgttaaaaccggatatacgggcattttaagttttaaagctacttcattaacggttaaatcgtctaaaaaccggttatctccttcttttaccattatatccggaattacaagataatcaaagctcttaggttcaacttcccgcaaaatatcgtgcccggttaaaagtcctgctaccgtaacctccggcccaaataagccgttttccagaggaagtaaagtaatgtttaatcccggaatatcgtttaaacgctccaccaaaggcgctaaaatcttcccgcctaaaattccggttataagtccaaccttctgcggtattactttttccggtaatctttttaatacccgcttcatcttatcaacaaaatccctgacgattcccactccattttcgtattggggaaatccttcgtaaaattcccggccgggtatctttttctccgccaaaagaaaaaactcatcggaaggataaattagccttgttcccagttctttttttaacctgcggccgtatttcagggcaaggtcaactacagcgatagcttcctcttttgtaaaacggcgcaactttttatttttccgaaagcgggttaatcccaccggtactaaagcaatcgattgaaccgccggaaaaaactttattaagtcggtaaggctcttttccaaaacttccccatcattaataccgggaaccaaaaccaactgcagatgaaaagcgataccgttttgcgcaagaagctctaatttttctaaaatatccccggctttcttatttcctaaaagcaggcctcgaatcttaggatctgtggcatggaccgaaatataaaggggagataaccgttctttaattatccgctgaaaatcagcatcggttaaattggttaaggtgatatagtttccgtggaggaatgacaagcgatagtcgtcatccctaacataaaggctttcccgcatcccgggcggcaactggcgcacaaaacaaaaaaggcagtggttttcacactcgcgaatcccatcaaaaaccgaactttcaaagataaggcccaaatcttcaagcccggaatttttaactttaattttccgaattttaccgtttttttctttaatttttaaagtataacttttctttaaagttaaagtcttgtactgaatataatccaaaagtttttgaccgtttatttccaaaagctcgtctccgggattgataccgaatttataagccaggctttcgggtattacttctacaatcttgaccataaaatcccctacttctttaaatgttttctttcaaattatcttttaaccggtttatttctgtcaagataattttaataatatcgtctcgcttttttttccgaaagccccaaagattaaaacgccagtaaaaaagctctaatttcgtaaaataaggatttaagtccaaggtcaatacctgattttttttagcgattagttctataaaattatcaacgatggtttttaaaagactatcttcaaaggttgatatggccaaaacttcaatttcaaacaactctccaagtttatacaaaacatttcgttttaaatcctgcgagcatttaaaaaaaaatttccaatctcctttaaaactaaagtgctacgacaaagtattattagcatcgaaactccccttaattttttttacttctgcggtaaatttaacataagctttacgcgtaccccagagaaccagaggtcttccaataaaaaccaactttaaccgtcttgaaagaaatccgcccaatttcatcggaaaatttacatggttaacggcatttaccaccttaatcatttccccaaactttgccgcaagatagtttaaaaccggttccactaccaaatttagcgatcttcgccccagtacgtacacctcattaccgaattcatcctgaccgcaataaaaaaaagaaccgtgttcttcctgctcctgtttttcgtataggggcatctccataatttctttattatccggtatgcgatccatcggcaaatggcccaaatggattgccgccattattaccgaagaatgggcaccaccgtagcagtggtaaattattttcatcttctctcccctttaaccggaacgggatggagaggggctccctccatcccgccttttcttattttgtttcctcatccttttgttcttcctttttgccttctttccgccggggtaacatactgcttgttacctcccgggaaataaaactcccaagccgctctttggccccacttatacttccggcacttatgagtaagaaagcaccacctaagattaaagcagctataaggacgataaaaaagtttcgccatgcaccgggagatttggctacgtcgcttcgcactccttgagttgtaccctgggttccgggcattgaagttgcaacccccaggactttaggaacggcatcggcaaataagcgaactcctttttccgcttcataccgtttgttggtgtgagttcctacttcaattaaaagagcggtaggcattaaatcctgattgtagttgcccttacctatatagatacctttaatcaaacctggatgggttttatcaacgtaagctttcatcttccgggcaaaatccagattcgcagccatttgcggattttgccggcccaccaccaaacggattttggttaccttttgcccctgaatatttttctcgtaaaaatccgggtcgggtacagcatcccggtgaacgtctaaaattgctatcggccgttttttcattaaacgcaccgccgttcgccgggaacggtggtaagcgttggcatcgtggggatcatggggagttcgatcgtaagctacctttactcccatcctgctgagcttatcggctaaggctgcaccaaccttgtaaatgccaccccgggccggaatatttgcctttccatcggagggctgataagcttcatcgctatgggtatggtacatggccacaataccttttttctttggcatagcaccggcaggtaacacaacccgctcaaaatattctttataacccagcaaaatttggtcttctcccagataccgggcgtaagccctttcatggtccacccgggttatcttgtaatgccggtcatcttccgtgataatttcatcccctatagctacctttcgggccattttatctaaaacccgaccgttttcatcataaatggtaatgtaaaaattaccactgtgttccgcaagctcactatttagttcggaagtaaaatacctttctccgtaaaccggtagagggaatagaagtatcagtaaaattaccagcaggggtagaaaattaattgttcttattttcattttccttcgcctccccggtgattcctaaactactggtaagctccggttcaggattttttaacccttctaaaagcttttggtccctcttttccgtagcaggtcccccttgaagcctttccctggtttcccccaccacttccgccaaaattaccgctaaaatccctgccaccacgattccgtcaaacaccccaccgccaccaagatctactcttcccggcgtattggtggttatgaggtaaaagagatggaataaatcgtttaaaattaagcccaccgttgcggctataaaagctccccgccgcgaccggcccgctatatatcccaccactgccgccacaattggggcaacatataaggggtcaatgatttcaaagcgccccgccggctccacatttccccgcattaaaactgccgttacaaagtaaaccgcaactgccgccaccaccgaacctattaaagcccgcacccattctttggtggaacccgctttgtaaagtaagtacccggctatgaccaacggaacaattccgccccctaaatttaaggagaaggttatccgtccgcgtaataaggttaagtcaagaaaacttccgacaatcattaaaccaattaacaccagtgcttcccggtcggtaagcttcatcctgtctaatacccggtgcataagtccaaaaaagattaaggcaactaaaattaccagtaaaatggttcccagagaaaacatcctgcttctcactccctcttaaattgcaaaataaaaaggctaactcattaatagagttagccccagtgccggtttttatacatcctttaattttcctcttaaaatttcccccaggctaaaggtcaggttttcttcctccgcaagttctttttggtattgctctttttctttttcccgtaaagcctctttctgggaaagggtcatcttcttttccagcggctttaaggttaaaatttttacctccattttctgtccaacctgatattttttcattaaaggttcattttcggcctcggtttcccgggccggaagatagccttcaatacccgggaaaagctccaagattaatccgtggcgtaaaatcttaactaccgtcccttctaaaaccgcaccctcttttaattcatcggggattttttgccagggatcgggagttagctgctttagccccaggcttactttcaggttgtgccggtctacttctaaaactaccacttccagttcctgtcccacctgtaagtgctcttccggccggacattgcgctgccagctgatatcctgcgcccgcagtaatccttcaaaacctccgaggtcaacgaaagctccaaaaggcatgattttggtaacctttcctttaactttgctcccttcttttagcgtggcaattttttcttttttggtttttatttcctgctcttttaagtaacttttccggtccaaaactacccgccttttggctaaatccacttcaatgacataagcggttatttcttccccctttaaagcttctaaatcttccacataatttaaagctattaaagaagccggtaaaaaggctctaactccaatatcaaccaaaactccacctttaaccacttccacaattttaccggtaaccggtactttatttttttgccattctaaaagtttttcttctgccaatatttctaaggcttttttgcgggataagattatcttcccttcctcatcttcttttaaaaccaaaacgggaaactcatccccttcctttaccgcatcccgggcccgctcgatacggtaccaggtaatttcctctaaaggaattaccccttcccctttggttccaatatctactaatacttccttttccaaaacctttaccacttttcccctaacaatttccccttctttaaccggttttatctccaaaagagcttgttccattgacgccatctgctccactttttttctaacctcctcgataatccaggccggagtagaggctccggcagttatcccaacttttgctttaccggcaaaccactccggctttatttccgaagcttcttctatcaggtaagttggagtattggtggcggcacaaatttgggccagctttttggtattggcactgtttttcccgccaactaccaacatcacttccacttccgtagccagcttgcgactttcttcctggcgggttcgggtagcgtgacaaatggtattaaacggtctcacctctccgccttttttctttatcacctcaactacctgccaaaaattttcgcttttttgggtagtttgggctattaccgcaattttaggataaaaaggtagccgggcggcttcctcgggattttccaccaccagagctttgtagccactccagcctactattccctgcacttcgggatgttttttatctccgaccaccaccacctgataaccttcatcggtaagtttttgagctaaaatttgggcttttttgacaaaaggacaggtggcatcctccaccacgtaacctctatcaactatttcctgtagcttttccggagtggtaccatgggaacgaattataatggttttgccgtttccctcttcaatttcctcgatgggaattattcccgctttttttaatctctccacttcctgagggttatgaattaacggacccagagaataaaccggattgttattctcggcagccttttgcgccgtttcaatagctcttttaaccccaaagcaaaaaccggcattttgcgcaactatgatttccatccaaaacgctccttacaaaagttcttttactttttcccgtaaaaacctggcccctttctccaattcgtttttatcatatggaagctcgttaattattttcccaatcacaaccttgcagcgtttaaatccgcgggtatttttcaggcctaccggtaagatcggcacggaagcttttaaagctaaagccgctgccccttcgtgaaactctcccagagtttttagccgggttccttcgggaaagatccccaccactttaccctcttttaagtactttaaagccgtttttactgccgttaaatccacttcatttcttttaaccggaaaagcccccagcttttttaaaagcaggccaaagcccggaatatcgaacagctcttttttcgccataaaatacacctgatggggcaaagcacagccaatagccaccggatcaaagtagctttcatgattggcaacaaccaagtaaggcccggatttcggtacattttccagtccttcaactttcatccctttaaaaattatcataaaccagcgggcaaccatacgggcaaacctataaaacatcatttttcctcccgattatctctaaaagttttgccaccacttcttcaattttaagtcctgtagtatccactaaaattgcatcttccgcctttcttaacggcgaaatttcccgggtagtatctaactcatcccgctttagcacttcccggaaaacctcttcataacttacctcataccccttggccagaagttcccggtggcgccgccgggcccgctcctcggccgaagcggttaaaaagatttttacttccgcctcgggcatcaccacggtaccgatatcccgcccatcggctaccacattacctttggcgatgattttcctctgaagttccgttaaatatttccgcacctcgggcagggccgaaactttggccactaattcggaaacttgaggagtccggatgagttccgttacatctctttcatttaaaagaattttctggccctcatctccgggaataatttttatatctgtcttttccagtagcctcttaatcccgttttcatcttccaaagaaaggttgttttccaaaaataacaccgtaactgcccggtacatagctcccgtatccaaataggtaaagctaagctttttggccaagattctggctaccgtacttttccctgctcctgccggtccgtcaatggcaatgcgcattggattacgctccttcggttaattttgtcaactgttgaaaaaactcgggataagaaatggcaacggcatcagcatttaagatttctgtagtccctgcggcagttaaccctaaaaccgccaggctcatggctatccggtggtcatggtgggaatcaacagttgttcccagaattttattgccaccgcttattataaagccatcgggaagctctttaaccgctacacccattttgctaaactcggaaacaatgctttttatccggtccgactccttcactcttaactcctcggctccccgtaccttgctttcgccgtaagctaaagccatagccaccgctaaaatcggaaattcatcaatcatggccggaacaatttccggaggaacctcaacagcttttaaaggagagtatttaacttctaaatcccctacgggttcaccgctattttcgtgaaaattcaggatttgaatatttgcccccatttcttttaaaaccgttaaaagaccggttcgggtaggatttaaacctacatttttaataattaaatgactgtcaggaacaattaaagccgccacaataaaaaaggaagcggtcgaaaaatctccgggaacaatcaccttctgacctaaaagtttctgtccaccggaaatttctactctaagtccttccctttttatttttgccccaaaaccaaccagcattctttcggtatggtcccgggacaattgcggctcggtgaccgaagtattcccctcggcccgaagtcccgccagaagtaacgccgatttcacctgggcgctggctttttttaagataaaatcctgcccccgaagctttcctccctttatcgcaaaaggcgcataatctccctgcccccgcgccaacaccctggctcccatttgcgttaaaggctccaagacccgcttcatcgggcggcgccgcagggaagcatctccggtaaaaaccgaaacaaaaggaaaagtagccgcaaccccggataaaagccttagcgtggttccggaattctgggcatcaagaacatcctgcggttcggaaaagttttgtgccgtaccaaaaactctgacaaaagtatctctgcgctcaattctaactccatacttttctaaacaatttaaagtggccagagtatcctgagcgaccaaaaagttttcgatttccgttattccttccgctaacgctcctaaaattaatgcccggtgggaaatggatttatcccctggcaccgttacctggccttttaaaccttttttggcagcagttatttttttcataccaaaacccctttacaaaatttccagcaccatttttaactcattgataaagcgcgcgttttggacaggtgtacccaccgttactctaatccaatcgtccatcccaaaaatgtccccggaacggacaattacaccccgttttaataattcccgaaatactaatgctgaaggcttttcggttttaatcattaaaaaattggcagccgaaggaatgtaggaaagccccatccgaattatctcctgatagagaaactttttcccctcatcagtatttttgactacttcccttacatactcctcgtcatctaaagcagctacagcagccatctgcgctaaaaagtttacgttaaaaggcggacgcaagctattaattgccttggctaaattctcaggagcaaaaccgtaaccgaccctgagaccggccaggccataagctttggaaaaggttcttaacaccaccgtattgggccgtttcttaaaaaaatttaagccatcgggataatcgttaaaaagccgggcaaactcaaagtaggcttcatctaaaaccacaactacttcctccggtactctttccaaaaattcctccagctcacctttcgttatataagtaccggtagggttattgggattgcagagataaacaagcctggttttttcatttaccgcctctgccattgtttttaaatccagccggtgttcttttaagggaatttcccgggcaattccgttcatcattgtaaccaccggttcataccggggaaagctcggcaccggcattatcgcttcatcccccgggtcaattaaggccatcgctaaaaacattactaactcgtcggacccattccccaggataatgttatccggcgtaactccgtattttgccgcaatcttttctttcaaacgaaaagccccgccgtcgggataataatttaccttatccaccgcttctttaatggctgcggcaactttgggagaaatgccccagaggttttcattggaagcaagtttatcgatattggttatcccgagctcccgttcaacctcttctaccggctttcccggcacgtaaggttttaagttttccaaagctttacgaaccatcctaccgctcccccttttatattttaaaaaaagccaaaagctaagcgctttggctgataaaccttttaaccatcgtcattaaattttgaaactcgttatagtccagggattgctggccatcggatagagcttttaccggttcgggatggacctcaaccattattccgtcagctccggcggcaagtgctcccagagccaccctacctaccagctccctgcgtccggtagcatgggatgggtcagcaataaccggaaggtgggttaaatcaagagcagccaccatgcccgccaggtcaaaagtgtttcgggtgtaatcctcaaaagttctaattccccgctcgcataaaattacctgttcgttgcccgccgcaacaatgtattctgccgccaataaccattcctttaaagttgctgctaaaccccgttttaataatacgggtttattaataagaccaacttctttaagcagggtaaaattctgcatattgcggctgccaatctgcaaaatatcggcatattgcgctactatttccacatcccgcgggtctaaaacttcggtaaccacgggcataccggttatttccctggctctggctaaaattttcagcccctcttcccccagtccggcaaaagtgtagggagaagtccggggcttaaaagcaccgcctcttaaaatctgcactcccgcttcttttaaaaataacgcttctttaagatactcctcttcaccttctaccgcacaggggccggcaataattaccggcttgccgctgccaatttcgatatttgaaactttaacaattgttttttccggtttggatttgcggctaactttaagctccattattccactcccttgcggtaaacctctaaaaagttttttaatagaagaagaccatactcggttaggattgcctctggatgaaactgtaccccttcaacgggataatctttatgccttaaacccataatttcaccttcagcagttttggccgaaacaatcagctccgtttcctccggcaactcaacgataagcgaatgatacctggtagctaaaaagggagaaggaatccctttaaaaatcgttttaccatcatggtaaatgggggatgtttttccgtgcattggccgggcagcccttaccacttttcccccaaatacctgccctatcgcctgatgcccaaggcaaacccccaaaataggataccggtaaagatttttaataacctccaggctaatcccggcctcattgggagtacagggaccgggagaaataacaatatagtcgggatttaaggccctgatctcttcaacggtaatcttatcgttgcggtataccgttaccgcttctccaagcatttgaaagtattgaacaagattataggtaaaggaatcgtagttgtcaatcagtaacagcaacctgtaaaaccccttctttagcctcaatttaagctaagtcctcacgtaattttgctgctccttttaaatatacatgcttaacattctcatcagcccctaaatcaacaaaaagcaaaacccttataaccctcggcatcccgcctatcacatctggctcttgcgctgacattaagggaatcccttttaaacccaattcccgagcagttttagccggataagcggaaacgatatcctttgtttgggtaaataataccgccactacattatttactgttaggttgttttccttaaaaatagtctccagcagctcccgggtagcttttgctacttcttcgggctggtctctttcaatcgttatcgcaccccggatgccttttaacaaaaacacacccccttatcagggaactgcccggtgaccaaggccaacccccacttcatctaagtgcagcaaaccaacaccaaaaaataccgccaccgcaacgtggtcctgaaaacgcgcaatacctattttaccgccaacatttaatcctaaagccttggtcattaactgcgatatagcttcccgggtagcaccggcaaccgccccttcatcggcgtgggtttctttgataaccccttcccgtttagcagcaaccaccgcccgctcaacaattttattaacagcggagataaaatccccaccgtaatcaaccgcggctgcccggatattttcttcggcaagctttatttttaattctttttcttcttcccgcgtctcggttaaagccatcattaaggctgctttggcagcctttttactgccgacatttggcatactctcagttcctccttacctaactttcaaaaacaattatacacgtaaaaaccgtttaaaccaattcatttttaactttttcctgctaaatatccggtagaaaaagccatctgaagattaaagcccccggtttctccgtggcaatcgataacctccccggcgagataaactcctttgataagcctggactccatggtggaaggatttatttccttaacatctactcctccggcggtaacgtaggccatctctaacggcattgtcccggtaaggttaaaaaaggttccttttaaagcttgggaaactttcgtaacaaccttaggagaaagggagtgaaccaccgctttcggattttgcccgtaataattaagcagccactcccgaagcttttcgggaagtttgccgggaagagcatttttaagggttttatttccattggaaataattttttcttttaactcatccacagaatattccgggaaaaaatcaatttttatcttggcttcggaaaaatttaacggtagataacagcttaaatttaacaccgtagggcccgagaggccaaagtgggtaaaaagcaaggggcctcttctggctttaagttttttccccgaagaaaacaatgctaaattcacatccattaccgttatcccgcttaactctgcgactttttccgcaagctttaacggaaccagggcaggtcttggggaaataatgttatgtcccaatttacttaaaagctcaaagccatctccggagcttccggtttggggaaaagaagccccgccggtagcaactatgactttagcagcataatatatcccgtctttcgttctaacacctaaaacctgcccatcgttaaccaggatatctttgaccttttgcttatataaaatctccacgccttttttccttaataatttttccagtaactttacaacatcctttgctttatcggaagcaggataaacctttttctcttccacctttaatttaagtccatttttaataaaaaaagccattaaatcttcattggtaaaagtaaataaagcctttttgagaaattttccattgtggtagtactcgtaaaagttatttattggtgttatattggtaatgtttccccgaccgtttcccgtaaggcagagttttttaccgagtgaatcggtcttttcgattaataaaacctgtcctgaggcagataaagccgccatcatcccggcggctccccctccaattactattgtccttttcatcttacttccccaaatacttcttttcaataaattctcttaaacgatttatctcttcaaccaaacggaaaatcattttctcggcctcacctttgcttaaaaccagttcctgcggttcaaaaatttcaatttttttaaactcctcggtagccacaaagcgaattaaatcttccaggctatcggcttttaaagttaccaaaaccggcgcataggaaacctcggcattggtgagttcatcgaatacggtataaatgtcaatgcttatgtcaatatcttcgacggtaatcccttgaaaaggaagatttcttagtttagccacctgactttcccgaagttcttccgccattttatcggagcttttcccaccaaacagaaattttgttttgccgcttgctttataatcaaatcttaccctggcaagaatttcgttcttcatccttttccctccttgccatttggtattcgcttttttcctgaaaaatcctgccgggatttttacattatcctctggtaatttgacaaaagctataaaaaagtcgtttaaggagggataccgtgaaagaagttattattgcttattttaaatccctggaacaaaccgaacgggccattgattttattaccaatgctcgcctcgcaaactcccatatttctttgatctgcccggtaaacccgtatactgcacaaaaatttaatgaagaatatgccatcgagctcaccggtaccggagaagtgggtatgcttcatgattttcatggtcagttagtcgaaatgccgttagctgaagttcccggtgtcggcaaagttgccttggccggcccactttccgatgatattgctaaaaaggggctatttaaagctcttttgcctttaggatttaccgaaagcaaggtaagaaaaataaaaaaagccttaaaaaataacgaagtggtagttataatcgaaaccgaaaaagaaaaagtaaacgaagcggccaatatcttagccgactttggcggaagacatgtagaaaaatggaatcctcacaccgaaagggcctcaatcacccacggttagaattgaccagacgctttagttttaaaacttccgcgggagttaaatagcgaaaactaccttttttcaggccatatccggttaaaaaggcgatgcgcgtacggattaattttaaaaccgggtggccaatttttttaaacatcctccgtacctggcgcttgcgcccctcgtgaatagtaatttcaatccagctgtttttcccttcaggttttttaaaatttactttggcaggagcggtatagccatcttccaggagtacgccccgttctaactcttttagtttcgcccggttgggagtaccccggactaaagccaagtaagttttgggaacctggtgtttaggatgggtaagagccatcgccaaatcaccgtcattcgtcaaaatgagaagcccttcggtattcatatcaagccttcccaccggaaagacccgttcctttaccttacccgccagtaacgataaaaccgtggggcggccaaaggggtcgtccacggttgtgatataacccgctggtttatacattaaaatatacacgagtttttccggcttaacaattcgcccgtcaacctccaccacgtccctatcacttactttaaatcccagctcttttaccactttgccgtttacctttacccggcctgctaaaatgagctgctcggcatcccgccgggctgcaactccagcccgggctaaatatttttgtaacctttccatattatcacctttttttccaaaataaaacttccgttattattattgttacaataagccaaaataaaccggcaataaatcctcctaaaacatctgtgggccagtgaacccccaggtaaattcggctaaacccaattaaaagaggaaaaccgattcccagaataagaagcaaaattttgggaaggggaaagttattttttgccaaaaggtaaaaaagcattccgtaaactgccatgctgatcatagcatgtccactgggaaaactgtagccactttccgatattttaaagtacagcgttggtcttaatcttaaataatgaagctttaagacataatttaagaccgaggccccaatgaagcttcctaaaaaggccgtaaggctatcataacgtcttttcaggtaaaaaaagtaagaaataaccggcaccagcatcatataaaaaccaatggaacctaagaaagtgatgcctttcatcaatggtaaaattccgggaaagtaaattgcctgaaccttttttagaataatttcgtcccagacaaaatttttccgggaagtaaaaattacttcggtaagttccccaaaagcccaaaataaaacgccacccgttaatgcgcctacaattaaataaacaattaaaccttttgtctgtttcttcataccttatccccgaaaaaattaatattaagtgccaaaaaagatttttaccacaaagaccgaggcaagaaaagttgtaaaatcggcaattaatccaacataaggagcataacgaaattttttaatcccaacagaaccaaaataaagggccaagacgtaaaaagtagtatcgctgctcccttgcattgtagataccatccgcccaatcaaactgtcgggaccgtatgcctccattaatttggcggcaactcccaaggcagccccaccggaaaggggccttaaaagggcatgaggcaggacttccgccggaatgccaagtttatttaaaagcggatttagccctaacgccaatacttttaaagccccggattcaaaaaaaatatttatagccactaccatccctacaagataagggatagtccggatggcggtgttaaacccatctttggctccttccaagaaagtttcataaacctctactttttttaacataccgtaaaatatcacaaaaaacaagattaacggtaaaagccaattgcctaattttataatcattttaccaccttgattttttaaaaaagtaatcggcaattaacgccaaagtaaatcctattaaggttgctaaaaaagtgggaattacgatgtcagcaggacttgccgccccaaatttctgccgaagtccaatgatcgtggtgggcaataatgttatggcggaagtatttaaagctaaaaaagtgcacattgctcgacttgcggtatctttttgcggatttaagcgggaaagctcttccatcgcttttaaaccaaaaggggtggcagcattacctaaacccaaaatattggcactcaaatttaaaagaattgcaccttccgccgggtgccccggtggaatctccggaaaaagcaggcgaattaatggagccaggatctttgagagattttctactatgccgctttcttccatgatgcgcattatccccagccaaaaggtaataatgcttacaagtccaaaagctgtatctaccgcaagcttggccccctctaaagccgctttaactattagctccggctttccctgccaaaaagccgccaaacacccaagaagcaccattcccccccacagataattcagcatctttctctcctccccaggcttgtactactatcctattcaccctcctccccctttagaacaccaaaaaagggacggttctttttttaggcgtttagacgcaaatatcggaaccgtccctctttttggcgtatggacgtaaatataagaaccgttcctgaattaggcggttggagtttcgaaggcttcgagggggaaatcgggttttttgcggttgttgccaacaaagttctggatttttgctaaaagctctggggtcaggtcgataagcttatccaccaaagcattggtatctaccggtaacaggcgaatttgtcccttccccactaccaaaaaacccaccggttgcaccgaaacgccggcgccgctgccacccccaaagggtaaagatttttcctttccttcgccggtagaaaactcacttcctccagcagcaaagcccagggttactctggatacgggaataatcacgctgccatcgggagtttctacggcgcttcccaccaccgtatccacatctaccatttcttttatactttccatagccgttttcattaaactttcaatgggatgatgctgagtttccatttcctccacctccaatttacttttcccctttaatttgtaccaaaggttgcctgaatataccttttattttttgttttaggaggaggaaaaataagaaggtggcggttagcagtaaatgataccagggtatttctattaaaagagataattttaaagaaaacctgattcccaggcgggggtctatatttaaaaaaaatcgctctacttttttaaaacgccgggcacaaagggcataaagcgttccaaataacgaatacaaaacccccgaaactataccaaagtaaaagggatctttcagaccagggcttaattctacagatagttttttaattattacccctttttgaaaataaaggtaagttttgttaaaaagtttaaggtaatcccagtaggtttttagaaatctaattacctttccccggaatattttcacttttgtcgtttttttaaccgccttctggttagaaaaaataaaatgccccactaccggaatttctccaccaaaatgctcggtaaattccggtaaaggcagggcaacttcaaaattcaaaagcccaaaaaaaagacgaaaaacaaggttaatttctacatcttcggtagattcaaaataaagaccaagctccaataactgccacctcttttaccaaattactcctcaaaattattatttccatcatttaccgcttcattctccaaatttaacggtggcagttcatcgagacttttcaagccaaaaaactccaaaaacttggcagtggtcctgtaaataataggacggccgggagcgtctttccgtcccgcctcttcaataagccctttttctaaaagagtggcgatagagctatcggcttttactccccggataagttcaatttccgttttggtaaccggttgcttgtaagcaataatggccaaggtttccaaagtcgcctgggttaaatgctgggccgggggcttaaaaagcctttctatataaacggaaaaatccgggcgggtggtaagccaaacctcctccccggaaaaatgcagcattataccccgctggtcctgctcgagtttttcctgcaaccgcaaaactatttcttttgcttcctctacggataattccaacgtctgggcaatttttttcagggataagggttccggactcacaaaaagaagcgcttctaaagccccttcaagatttattggaaacagaaccgacataccgtatccagatttctccatccgttttcacctgccaagcctccaccacttcctggcgcaaaagctccaatagggctaaaaagaggataatcgcttctcttttactttccacccgggcaaaaagctgggagaaaggcagagctttttcctgtctgagtaagtaccgcaaaatttctcccattttttcttctatggtatattccttttccggtaaggtaattggttttggcgaagtttcaaggcgcagcaaggtctggtttaagctttcggtaagtttttttagaggaatttctttcagctcacgcaccgaatacatctttaataactcttcaacgttaactttgcggcgataaacgctgggaaagtttcccctaatttcttttaaatactgggctatttcccggaacttctggtagactaccaggcgttcgaccagttcggttcgcgggtcttcttcttcctcttttttcccaaacaacatttttacttttaaatataaaaggtggctggccatcactaaaaattcgctttttatttccaaattgtgtttctggtactgctctaagtaccaaaggtactgccgcgtaatttccgcaatgggaatatcataaatgtcaattttatttttttccactaaatggagcagtaaatctaacggtccttcaaaaaccggcaggacaatcttatacatataacttacctcagcttcattttttcccgaacttccctcattgtttccttagctgcccggctcgcctttgcctgcccttcggccaatatttcaagatactttttgccttttaaaaattcttcccttctttctctaaggggttctaaaatttcgttaatttttaaagccaactgtttcttgcaggccacacagcctattcctgccgttcggcactgttcttctatttcggttactttttccggataaaaaacttgatagtaagtatgcaccacacaaacctcggggtggccgggatcggttttccgaacccttgccgggtcggtaatcatatttctcacctgctcagagacttcctccggcgtgctggataaagcaatctcatttttataacttttactcatcttccgtccatcaatccccggtagcagcggaacggcatgaagcaccgcctgcggctcgggaaatacactaccgtaaagatagttaaacctccgggcgacctcccgggtaagctctaaatggggaagctggtcttcccctaccggcactaaatttgcccggtaaattaaaatatccgctgcctgcagtaaagggtaacctaaaaaaccgtaagtatttaaatctttccccatttctccaagcttttccttttggtccttataggtgggaacccgttctaaccacgaaaggggagtaaacataccaaacaaaagagccagctccgcatgctcctttacttccgattgcacaaacaatgctgatttttccgggtcaattccggcagcaagaaaatccaaagctaaatattcaatgttttgtaaaacttcatcggtattttcatattcggtagttaaagcatgccagtcggcaatcatataaaagcatttagcttcctcttgcagtttaacccagttttcgagcaccagcaaatggcctaagtggagcctccccgttggtctcatcccgcttaatacgattttttccatattcaaatcctcctatcctaccaaaaacttaaaaagtgcaaaataaaaatttaaaataaaccgcgtaattggttgtaaaacaaaggaaatggcgccggtaaaaagtaataaaaggagtattgcctgaccatagctaaccataaacttccggatttcgtaagaaaaaaaacgattaaatatcttttccccgtccaacggaaaaaccggtaaaaggttaaatacccccaaagatacgttgatcgctaccgcagtaatgccaatttcccaagcatagggaagatttatccccccgaaagccaggaaaagaacgataataaaagccagcacaaaattggataaaggtccggctaaagccaccaaagccataccgttacgcgggtcaccccggaagttgtaaggattaacgggaaccggtttagcccagccaaatccggcaattaaaagcagcaaaacccctaccgggtcgatatgggaaaggggtgataaggttaaccttccttccctccggggcgtatcatccccgaggcttgtagctaccagagcatgactgaattcatggatggttaagccgacgattatccccggaagcatcactcccaggtcgtataatgacggaatccttaagaacccaaaaaaactatccatggtaactctcctcaaaaataattttgtttaacatacaaaatttcctcatctttattttttaaaaccccatcaatttttaacatttttattttatgtaaaatttctcgatacaggggaccgggctttaaacccaaggcttttaaatcttcgccggtaatttcgggcttgataaatctcagttcttcgaaatacgttttaaaccgctctctggcccggaatctatccagtaacagatataaagcccagtaaccttccggaggaagtttcgttaaagtttcgaatatttccaccccttttacttcccgggagagagataaaagttttaacgcttccttaattcctaaagctccctgtcttaaaacttcttcttcttcccccgttaaaggatacttttttataaactcctcaattccctctaaattttttgcataaacccccattaccccgtgcagccagggaatcttcatttcttttagtaaccggaaatattccacagtataattgaaataacgttttaaataatcttcttcataaaaagcttttggaaaaacttcctgaaaaacaccgtaatgctttaaaaatttaaggatttttaaaatatctttttcggcaaaaataagttttaattcgtacaggattcttgcggaagaaaccaagtttaaaaatccacctgcaatagcatcaaccaaaagcttttcggtgttttcttcaagtttaaaattaaatctacctaaaaaacgaagcgcccttaaaattcgcgtaggatcttcgacaaagcttaagttgtgtaaaacccttataatcccttctcttaagtccaaaagccctccaaagggatcaaaaagttcaccgatatggccgtaggtgatttctatagccatagagtttatggtaaagtcccgccggtataaatcttccctaatagtggaaacttccacctccggcagtgcggcaggatgctggtaaaattccacccgggaagttgaaaaatctatcttttgcccgtttttcaggataatcgaggcagtcttaaaacgctcatggggaataaactttattgccgaaagggttttgccaacttcttgggctaaaacaagagcgtccccttccaccacaatatctaaatccttttgtttatggcctaaaagtaaatcccgcacaattcccccgactaaaaatacccgcatgccaagttgacttgcccatttgccgacgacgttgattagctcctgaccttccggggaaatattttcatccaaaagcttctttaagtttacctcaaaactcccttcccggtaaagggttttatggggccttaattcttcaggccggtgatactgctttaaaagatccgtccgggaaataatccctattaactttcctccttctaccaccggcaaccggccaatatcatgctttattaaaagtcttaatgcttcttccagggacgcttcaggttcaatggttacaggatttttactcatgtaagctttaaccggagcatgtcctaagttatgatggataattttatcgacatctcttcgggaaataatcccaactaacttatccccttccagcaccggtaaccccgaatggccatagcgaaccataatttttcgcgcttcttccacggtactatccacagtcacaaatttcaccggccagctcataatttctctaacggtttttgcgggaatcttaaaattattaagcaattttaaagctatttctaaaacttcttgaacatccctatctttaagggttaaagaaaccgcctgcgggtgtcctttgaccccaaggccgtataaaattgaacgtaaatcaatctcttccttggtagaacggccaactaaatgcaccgttttacccatctgcacggccatgataaggacatccggccggtgcatttccattaaatagctggccataaaagatagcccgggtaaataatcatcggctctggcccaggtggcaaggtaaaaaaagcccttgctttcttcggtgacagcattatttaaaagttcttttaacaaaaactcctgttcccgggaaagcggtctttttataaaccggttcactacttccaagttgaccccgaaattaaataaataggctaacgcttcaatatcctctttggtagtagagggatacaacaaccctcccgtatcctgataaattcccaaagccataaccgtagcttcaaccgaggaaatctctatccctaattcttttaatttttgtattaacagggtaacagtcgctcccgtgggctttacaaatttttcagcaagataaggctttaaatcgggagctaaaggatgatggtcataaaggataattttcagattttcgtttagataatgccggatatgagaaaagcgggaaagttccgaactatccaccaggattagcctttttacatccctgggggtagttatttttttctgaatctttaagctatctttataaagagcaagaaactcctccactgctggcaaaaccttggccggcaaaagaagatttgcctggggaaataaaatccccgcagcaaccattgatgctaaaccgtcaaaatccatattgtgatgggtagtaattaaatccataatttcctccgttacacttaatctatataattataccataaaacgttaactaagtactctttctctttttgataatggttaaaagtaataagatgtagggaaaaattacttcaagaaaaaatgccaaccaggataaggttcccaggtcatcctttacttcggcaatattttgaggagcaatagcccaaaaaaatactaaaagcaagattggagccgttaaatgccggtaatctttttgcccaaaggccttacgtaacactaacagcgcagcaaaaatattaagtcccgccaccgtgaaaattgccgtcatccagccaccaattagtaagctatccaagcggtaaacaacatacccgatatttaacattttgattatctcataggagggataacgcatccgtgctaacgattccggtccaaaaatcattagacctactaaacatacagctgcataaattaaagttacaagccccatacctacgaccgaggcttttatcccgtctttcaagtcacggaaatctttggcaaaatataaaaaaatactaaaacctgaaaaggaaaatacactaccaaaaataccttttaaaagattaatttcgggatttattaccggctttaaatattctacctcccatttattaatgataaaaaacgttactacaaacagtaaggcaagttttataaacataaagatcacatttatatttttcaccgtttcgtaaccggagttacaaaaataaaaaaataataaaaggaataacattatcattatgtaagtcggcgtttcttctaaaagcgtatctgccgcaaaatcggtaaaaaccctgagaaccaagcttgccaaccagagaaaataataaacaaaaataagggcaaaaaaacgacttaaaaatttaccgtaaagcttttccccgtactcgataaaagtttggtctggccaataactttggacaacaactatcgttaaaagtgaaagaaagtttataaatcccccgggaaaaatgagcaaccagccggaactcttggcagcctcagccattactgccggcaacgagataatgcccgatcctaccgttgcacctattattaaagctactccttctccccagctaattttcataaaaaaacctcctgattctaaccaatagtatggaagaatcaagaggtttttattctaatacatggtaactaccttgcgcgtttttaaatgggcggggattaaatcgtggcttaacaggtcgtcataagtttctcggcgaacaatcagctccgcctttcccccaccaactaaaaccatggccggtcggggtaaacggttataattcatcgccatggaatagttgtaagctccggtattgctaaccaataaaaggtctcccggcttaatttccgccaattcaatatcccaaatcaacatatcccctgactcacagcacttaccggcaattgaaactaacttgaccggctggtcgttagctttatttgccactattgcttcgtacttagcctgatataatgccggtcggggattgtcacccatcccaccgtccaccgcaacataggttctaattcccgggatatctttaattgccccaatcgtgtataacgtacttcccgcgggaccggcaattgaacgtcccggctctactatcacctttggtactttaagtccgagtttttggcactgactttctaaagttgtaaaaatagtctccgccattgccgccaccgtaggagggttatcaccttcagcatagtaaataccaagaccgccgcctaaatccaattcttccgtcataaaaccggtagctttaaatacttcagccataaaggcggtcatgacttctaccgtgtgagcaaaagactcaagttcaaagatttgcgagcctatatgacagtgaaaaccttttaattcaattccgtccagttccaaggccctttgggccgcatccattgcctgaccggtttcaatgggaaaaccaaatttactgtcaatttgcccggttttaatatactcatgggtatgggcctcaatcccgggactaacccttaataatattggttgccgtactttatagctttttgcaatgtcatttaaaagatacagttcgtaaagattatccaccacaaagcggcctactccggcttcaactccaagcctgatttcctcagggcttttgttgttgccatggaaatacaccttgtgcaaaggaaagtctgcttttatagcagtataaagttcgccaccggacaccacatcaagccccaaaccctcttcttcaactaaacggcaaattgcagtagttaaaagggtttttcccgcataaatcgccagtgacccggggtgtttttgggtgaagttttggtagtattcccggcagttttttcgaaattcttcctcatctaaaatataaagtggagtaccgaactcccgggccaaatctaccgtatcgacaccgcctatttctaaatgacctttttcatttaccctcatcgtaccggtaaaacgcatgccatctctcccccttataaataataaaatattgcgggcccttggtatttccccaaagacccgcaattggcatgcggcaatagcgaggaaatacctcagctcccagcaaggtagcgctccacccgctaaaacgggtgacagtcctatacctgttcggcataggcccaaccccttacgtccgctaccgtaagggatttcggcgaaggcccctttcaccgggcagcattaacctgcggggtttttgcccggttactcttgaccatccgcacctctacctcacctcaaagagatgaggtattagcgtattaagttttaattgccctttacttttaataactataacattaaacttctaagttcgtcaacctatccccgctaattttttgttattcatctgactgtaacggccgcagcggtcatttaaataacccactacctcgtaatcttcatatattttaaccacttcacaaaagttaggacagttttggcattcaaaattctcggtttttaattcggcatctttcacgttaaagcccttgaacctggttttataaggctgtttttcccgctcaaaagctgcaattaacgctgctcctaaagctcccattacctcaaaatagggcggcacaattacttcggtacaaagcgcccgcctaaacgcttctcgcatggcaatgttggccgccacaccgccctgaaaaacaattttatcgtaaagctttttgcccttagctaaattgtttaaatagtttcttaccagagcatcgcaaaggcccgcgagaatatcttcaatacttaagcccaattgttgcttgtgaatcatatcggactcggcaaataccgcacaccgcccggctatccgcaccggattctgggcttttaacgctatttctccaaatttttcaataggaatgttaagcctttgcgcctgctggtccaaaaacgaaccggtaccggccgcacacacggtattcatcgcaaaatcggttactacaccatcttttaagagaataagcttggaatcctgtccaccaatttctaagatggttcgtactccgggtaccaaatagttagcagccaccgcatgggcagttatttcgtttttcacggtatctgctcctaacaccaacgctgccaactgccggccgcttccggttgtccccacccctaatatttcttcttctttgattcggtcgtaaatttttcttaaaccttcttttaaggcaacaagaggccggccgttcgttctcaaataaattgcttccagaatttccttttcttcattaatcaccactaaattggtacttaccgaacctacatcaattcccagaaatacgccttttttcatgatttcctcctttctggcgaaaacttaaaaggtcacaaaaagcttccaaccgggtgataagcccggcctcaccggtatgttcatcaaccaccaaagataagaccgggatatcctcgacttcgcttaccgccggcagaactgcttgagcaacaatttccggcatacaggtaaaaggtaagagctgaattaccccatcgaatccctgtttttttaagtatttaactccgcctaccgtttcctgcccgtgtccccccacaaaatggcaaagaaagggcggtgcttccttcacaatttctttatgccggctatagtttttaaaaagtcccagaaaaaggtggtcgttcacccattcacttaaataaatggtgcgttgcacttccactcccaggttgccaagatatcgttcgatattaaagttggtaaagggttctaagagggtaaaaatctccccaaccactcctatctttaacaccttgcgggccaaatccatgggtatccttgccaaagccacgactgcttgatttaccgcttcttcgatttccttttcctctcgagcccgatttaaattttgcaaaaactcctgccacacccggtcagttgcccccttggtaatttcccgggctctaaaaaaggctacttttttttcaatttcatcggcagcttttatttttaaaaatccttttttaaccgcccttataacctgaaaaattggtttattatcggtaattttttttagtttagcgataaactccataatgtttctttcgggtggttctaacactaaaaggtcataattaatccccaaatcctttaatatttcctgctccacatatgcgtaataaccaaagcggcaggggccagttcctcctgccatgaggattgtatcggcacccagttcatacgcctcaataaaattcccgaggttaagctttaaaggcaggcaggcaaattccggtccgtacttagtacccagagttaaggtttttttggtaatgggcggaggtaggaccacttctacccccagttcttctaacattgcttttacccctatagccatattacccatgtgcgggtaggtaactttcaccggcaaaactcctttccaccgtcatatcccaaaaagcttcaagacgggttacaagtcccgcctcaccggtgtgttcgtcaatggtaaggtttaaaaaaggtaaggaaaattttcttctcaaataccggcccgtaagttcggttattattgaatcaggtccgcagccaaaagaatttaaacttattatcccttttaacgggtaattttcagcgagataaatactgccaccaaagtttttaatcgcaaaactccaaaagggttttttgggtagaatcccagctttttttaccgcttccgcaaagggaacgttatcaggagttaaaacttctcctccaaaccggcgaattttttttattaaatccatactggcatgacggtcattaatattgtaggcatgacccaccaccgcaaaaagcggtttctttaagtccggcacataattttgcttcccatcaattaaatccagcggttgatatccaaggtactttttttgcaaataagctttttgatttttccaggctgcataaatcgctcgcattattttcataccgtttggcgtaatttttttcccaagaacataaaccccccggtaaaaatcttctccctttcgataggccgttaagtcatgggaaagaacattttgggcttttaagcgaaagataatcatttcgggcaatcccaaaaatttcgggcagatgtaagtacgccggtattcactaacatagcggggtataaagagataatctacccggtcttttaaaaaccgcgcatggccgaaaaaaactttaaccggcaaacaggcatcatctaccgccgcttctacccccaagttaagggtctccttatcggtaggttttgaggttacaacatctactcccaactcttggaaaaaagtttcccaaaagggataataatcgtaaaaatataaacctcgcggaatacctattttcatctaaccaccccatctttaagagcatttccagggaaaaaaatttttatacctaccccttgggtttaaagataagggcaattatataaccggcaataatcgccaccgaaatacccgtggcggtatttgctattccgccccccaaaagccctaatatccctttttgtttaaatccttctattgctccctgcgtcagtaaatgcccaaaaccagttaatggtaaagttgccccggtaccggcaagttctactaatttttcgtaaactccaaaaccggaaataagtgcaccggcagttacaaagctaaccaaaacatgggcaggagtcacccgaaagcttgtgagatccatcattaactggccaatcacgcaaattactcctccaaccagaaaacttaatagaaaatccatcttcatccccctcagtaacattcaaaggatactgcatgagcaattaccggtatggacattccctgctgggatgtaacttgagaaagtaaagcacccgtacctatacccaaaaatttatgaatctttccctgacttaactcgttaaaaacgtagccagcggtaactaaagccgaacaagctgtaccgctacctccggcatttacctgctgatccggtcgataaatcatgattccgcaatcggtaagcctttgaccaaagttgatattacgttcctgtaaaagtttaaccaggatttgccatccaaaccgggctaaatctccggttgccattaaatcataataatcgtaagacaaacccgtttctttaaagtgggcaagtaaagtgtcaaaagctgcaggagccatagccccacccatgtccgaaggatcaaacataccgtaatccaacgctttgcccaccgtaacccggggaattttaattttgccttctccttcccccaaaaccaccgcggccgcaccggtaaccgtccactgggatgtaggcgttttctgaaccccctgttctgtaggattacggtactgccgttcaacggtggcgtaatgactggaaacacccaccagtacttttttggcaaaaccaccggctattaacatagcccccaggattagtccttcgtaaaaagtagcacaagcattatataatccaaaaaatggaatccccaaactttttgcaacaaaattagccgaaataatttggtttaataagtccccggccaaaaaaaagtccacttcttcctttttaacagaagctttttgtaaagccatttcgactacttccaaaaacattttttgctccgctttctcccaggtatcctcataataataaaggttgttaataatcttatcaaaataggtagccagggggccttccccttcttttggtccagctatagttgcataacccaatactaccggcggattagcaaattcccgggtttgcctcataattttcccagcccccttaaaataattgccacaataagagagctaagtaccccgtaaataataaccggaccggctacggtaaatagtttcgccccaacaccgagaaccaagccttcctgtttatgttccaaagccggcgataccatggagttcgcaaagccggtaatgggaacgattaagccggcaccaaaaatccgcaccaaatcatcataaatcccggtacccgttaaaattgccgagattaagataaacaccacacttacaacggtgtaaccgtctttttccgatatgccgtagcctcttaaaaaatgaaacaaaacttctcctaaaagacaaacaaagccccccattaaaaaagccaataagcagttttttagtaccggcggcttaggtttaattttttctacagttttttgatactcatttttatcaatagccatcacattttcacctcaaaatataattttccccttaaaaaataaaaaaataacggaggaaaacctccgttattccacataagcaacttttacattggccttatattctactacccgtccgccttccacattagcggtaaaatttaaaatttctactccggttaccgtccccagggaccgcgatgcttcatttactgcggtttgtaccgcatccttccagccggttggtgattctcccactaattcggctacttttacatgcattgctgattcctccttaaaaaatttttttccatttattaaaatgaaccctggaccggctatttattaaggtaatattttattgttttgttattttttgtattttagggaaataaatttaactctcgttcaggtaccgttttaattttaagagggcctgtctttcaagccttgaaacctgtacctgggaaattccgagagttctggcaatctccatttgggttttttctttaaaaaagcggttaattaaaatataccgctcccgcggttctaacttgcttagcacttcttttattgagatattttctaaaagggtttgttcttcatcaccctcctgcttaatctgatctaacaggtatatcgggtctccatcatcctgatgaaccgtttcaaaaagtgaagccaagctctgtcccgcttctaatgcttcaacaatcgcctcccgcgagtaaccaagagtttcttccagttcggcaattgtaggttcccggcctaactttacggtaagcgcttctttttcttttaaaatctttacccccagttctttggtagaacgactaatccggatagcctggtcatctctaagaaaacgacgaatttcccccacaatcatgggaaccgcatacgtggaaaacttcacctgttgttttaaatcaaatttatcaatggctttaattagcccaatcgtcccaatttgaaacagatcttcaacttcgtagcctcggtgtaaaaaacgttccaccactttaaagaccaattttaaattacaattgataagtttttcccgggcagccacatctcccttttgggctttttctattaattcttttatttcctgttcaccgagccttgggaagcggggtaaattcatagaagaaaaacgaaagttcacacggttctgttatcttttaaaattcttttaaataaaatcacttttgtcccccgctccataggcacgatttccacccgatccattaaactctgcataaagagaaagcccaaacccggatgctcatcctccgggtccaataccattttttccctgattttttcccgttcaatacctttgccaaaatctattacttcaatatacatcccctcctcggtaaaataaccattaacctttatttctcctggattattaccgtagccgtgaacgatgctattggtaaccgcctcggataccgcaactttaatatcgtccaagtcgggaagggttaaatccttctgggcagcaaaagccgccaccacaatccgtaccaaaccgatattttcttttaaggcgggaatcgtcaggttaaaataattatgcttcataagctttttcctcccaaacttcctcttcccgggaaattcctttcataatccggaaaaaaccggaaagttctaagatctttttaatcttttcattggttgaagctaaatataccctgcccccaagacttcttatttttttaaaccgtcccaggatcaccccaagtccggagctatcgataaagtcaacgttctttaaattaaagacaatatcttttaccgggtaattttcaattatttcatcaacttcccggcgcagccggtctgcctcctttaaatctacctctccggttatccgaacaaataacaccttatttttaacttccttttccacttccaaaaaaatccccccaaaaatgtgtttcaaaacaataattctatataaatccagatttttcctgcaagaagttttaaaaaaataagtagcaaaaagctactcaaaagttaaaaggctttttaaaaatcgcccgatggcaaaatcgagtcgagcttttaaacaatcctctaaagacttaaggggagctctgccgattatctttgtcccatcataaataacaacctcacccattacctgaccgttctttaccggagccgtaattttttccggaagttttaattcataacggggatttatttttttccctttttcttcaactaacagtaccggcgctccggggccaaccagtatttgttccttttctccctttaccactttaactttaacagaaaacttttcagctaatatcgggtacgccttaaaattggcataaccgtagttgtaaagctttatcgattcggtaaagtggccttttttgaccgggcaacccaaaaccacggcaattaaacgaagatcgtcacgacttgccgtagaagccaaacaataacccgcctcttccgtccagccggtttttccggcgtctaccccgcggtagtaccagagcagtttattggtattaaagcggcgggtttcaccaccccttaacgtaaactctttaatctggctaagttccaaaaagagcggatgcttaatcgcttctcttaataaaatagccaggtcatagcaggtgctgtaatggttaggatcatcaaaaccgtagctgttaacaaaatgggtattggtcatgccgagctcttccgcttttttgttcatttcttccacgaaagcctgttcgttccccgccaccgtttcggcgaccgcgacacaggcatcgttggccgaagcaactgccacggccattaagaggtctttaaaggaaaactcttccccggcatacatgtaaagctgggacccacccatggacgcagcttcttcgctaacctttactatatcctccaggttgactttccctttttcaaccgcttcaatggctaaaagcaacgtcattaattttgtcacactggcaatgggcagttttttatgaatttctttttcgtataaaattttaccggtataaggttccattaaaattgccgccctggcgttaatttccagaggagctgctaaagcgttagtagtaagtccaaggcctaacaccagtaaaaggtaaattataagccttttgggcataaaaattcccccctcttgtccctatttcaccaatagtatatttgagggaggaaaggtttatgcacttttcttttattttcttatttcgccccaaaaactttgacctattcccggttccaaaccaaaaatctcttctaaagttgccgctacatcggcaaaggtttcccgggtacccaggtttacatcttctttaatactgtgaccataaactaaaagcggtacatactcacgggaatggtcggtactgggagttgtagggtcacagccgtggtcggcggtaattatcaataaatcatcttctcttagtttttccataatcttgggaagataggaatcaaattgttttaaagcttcataataaccttcggcattatttctatgcccgtacaccatatcaaaatctaccaggttggtaaataatagacccgtaaaatctttatatagaaggttaacggtttttacaaggccatcttcgttatttttggtagattcatgccaggtaagtccccgtccggcaaaaatgtcgtaaatcttgcctactcccaggacctcatacccctgctccactaatttatctaagacggttttccccgttggctccaaagaataatcgtggcggttggcggttcttttaaagtttccgggagtgcctgtaaacggccgggcaatcactcgccccaccgcatgctcgccggtaagaagtccgcgggcaatcttacacattttgtataattcttccaggggtataacttcttcatgggcggctatctggaagacactgtccgccgacgtataaacaataggatagccggtccgcatatgttcctcgcccaattcttcaataatagcagtaccggaagcgggtttattacctaatgttttccggccaatggcctcttcaaagcgcttgattaaatcttccggaaacccgttaggatataccggaaaaggcttttccaagatcagtccgcaaatctcccaatggccggtagtggtatctttgccgggagacttttctcccattttaccgtatgccccaagagctttaatatcaccttttagtcccaaaataggatggattttaccaagtccaagtttttctaagtttggaagctcaaacccccccaccttttttgcggtattggcaagggtattgctgccttcatcaccgtaaaggtgggcatcgggtagttctccaatgccaacgctgtccaaaactattaacactactcttttcaccttaatacctcctaagctcgtggatgtgctttacgaaatacctctcgcagttttctcgtagttaagtgggtataaatttgcgtcgtttctataaaactgtgaccaaggagttcctgaacaattcttaaatccgcaccgttttccaggagatgagtggcaaaagaatggcggattaaatggggggtcaagttttttactattccagctttttgcccgtatctttttagcattttccagaatccctgacgggtaaaaccactgcccttccgggtaataaaaagctttaaagagttgcttttccgcttagctctcagggctaaatactggtttaagtagtgggctgctacttctccaaagggaacaatccgcatctttgctcctttacccaagattttaacatatctctcgtccaaatataagttaggtagttcaagattcactaactccgacaccctaagcccggtggcataaagcagttctaacattgcccggtctctcaccccttcccaggtagaaaggtcgggggcttttagaagcaaatcaatttcttcgtaacttaagatttccggtaattttaacccaagtttaggcccgtccacatccaaagcaggattttccccgacaatcttttcccgaagtaaatatttataaaaacttcggattgcagcaagatttctcgctacacttgccggttttagcttccgggctaaatcctgcaaataaagtttaatatccttagaagttgcgtcaatgatactgatatttcgtttttccaaaaaagaaacaaacttctctaaatcccggcggtaagacaggagagtgtttagagaaaagcccttttctaacaataaataatcgataaaaaggtcaagcatcaaaccaccttactttaaaaagtaaaaaattattttgggagataaataagcttctatcgccgccgctccgtaagccgcagccgcagcaaaaaccattaaaaccacgtaaccggcaaaagtaaagcccaattttttctctctgctaaagtaaaccttaaaaagttttatggcaaaaactaccgttcctgaagccgccagcaataaagaaggcagataaacaatgttctggggtaacagggcggccagagccaaaaatacccctttaccggaattctgggaagctaaaaccgcaccggtaaaaccaagcataactccccggctaaacaccaccgcaaaagccaccggaaatccaattaccgaaagccctaaaagaaaaagcaaaaggtaaatggaaaaaagttgaccgctggtgtaagtaaagaccgtttccggattataactttgtcgtacggtgttcagtaatttagctgcctcctgcaccactatttctttttcctgcctatctaaaagaatcgcttcccgggccccccaccctacaccacagagaaaaaaaataaacatcccaagataaagtaaaaaatattttttttgcggccaggtgctcaaaaactcgttttcccgcattttttcaccccataccttttgaacaagagcttaataataggtatgaggtaaaaagcttatctataccttgctaaggccaggcggtagtaataaaaagccccttcaacgtcttcaatactgcgcccactggctgccaccagggcaacccgtccatggtgatctaaagcattttttatccgggcaagacctttttccaccacctctttggtattgctttttaccgttcgcgctacagttaccgtaaaaacttcgggagcaccggcagtaaccgcagcatcaaaagcaaccccgccggaatcggttaccgccaccaccacttttccgtaaaaatcggttagtttaaccgtttcttttcctatattaggaactacttttattacctggccaccagcggcattaatcccatccaccaccggctggatgcgcctttgcctttctatctcatcccccacccggggttcggcgataatgataataccggtatctgcttttaccgcctggattccggcctttttcccgattccataaggatttaggggtaccggcgcccgaaagttggcaggacttgctccaaagacagccgcagctccttcctctaaaaccccctccagagttgtggacatatcgataacgtccaccaccgctaccgccattcccgcttgaccacaccaggcagccatactggcgtcggaagtaaccagtaacttagccatttttttcaaccctcttttgcatttctaccgcaagaacccctccagcagcggccgttaaaaagaactcccggtcgctggtaaaatccctacccatggtagatagattctccacctcttcaagtagaagcttatttaaaaattcttcgggaaaataatgaacttgcaccctttgggagaatgctttggtctgctctaaaaggcgctcttttttcttataatcttttaactccggtagagccagaaaaaaatcaacaagggcaatttcgtttatgacagtgagtgaatggtggcttaagccaaaatgcctttcccggggatcggcaaaggagaccctgggtaccatgatagggcaacctcccaggatttttaccgcatttagatactccccttgagccagggcggtagaaccccattttgtaccggtacccacattgcccggtcccatggcaattactgctacatcggcttttagcgctacttttgccaaaatcaaggccgaataaacgttaaccgcctcgatatcgccgccaaaggcgtggccaaaggtaatggttccacaaattaaaccctttttccttaaattttttaccgttttactaaaagcaatgggcagtgccccctggtcgctcataagataagcaactcttaaattcttattttgggagttaatcccggcaattaccggtaataactggctatgcaaactgcaaaccaccaccggcattccctttaaactttggaaattttggacagcagcgtgatagggactgccttcctcttccgccgccaggcactttaactgcagcggagtataccgaagtttaataatatgccccggtcctttcaggctttgcctgggccggctaaaattggccactacaaaatgaaagccgccggttccaagttttaaggtaactgccgtggtgtttaacaaaaggcggtctcctacccgaacttttccggtaaggttaagataacatacggctttttctaaacttccttccacatccaccaataattcctgagtttcttcatcttcagccaaaatctctatggccttgccttctttaagttcaatcatcttaagcctccgtccgttcatcaattcaccaatattataaacttatttaggataaagaacaaattgacaaaaaaagaggagattaactccccccttactcttcataaattaacccgccatcactgcaataggccaaacaccgccggcagttccagcagcggtcgtattttataaaaatttttatttctttttgatcaaaatttaaggccccgggaacacaggatgataccgcccggcaattggttaaatgagcacatttccggcagagttcatttttcactttaactggcattttcctaacccccgacttcttttacaacttctaaaaaagcctccacaacttgcgggtcaaactgtttgcccttttgttttataatttcggcgatagcttcctcttttgttagtgccttgcggtaagaacggtcggacgtcatcgcctcaaaagcatcggccaccgccagcactcttgcttccaaaggtatttcttcccctttaagccttgccggatagccagttccatcataccattcgtggtggtggtaaatgatttcaataatatcctgcatttgctcaatgggtttaattatttccacaccaattcccggatggttttggatttctcgatattcttcgggcaatagtttaccgggcttatttaatattttttcagaaatcccgattttgccaatatcatgcaaaagtgcagctttcctgagtttttccaggcgctccagcgaaaagcccaactttttcccaattttttcggcaatagcagtaacccgcagggaatggccggcagtataagagtccttggcttcaatggccattactaaagcctgagtaatactaaagcaaagctctttggattgttcataaagacgaacaattgacatttgtgacgccaaataaccgcaaaatatcgttaagtaatcgaggtttttaaactccccgttaccgtataaatttaaaaacccaatcctttgctcttttccggctaaacaaacagtataaactttctggtagtttttctcaaaagttaatttagtaaaactttcaccggtaataatcgcctcacaattttcagcagaaataagcgaagaaagaatttccgcagggaggacccacggaagatcttttttttcgataccaaataccgctatggggtgaaggtttttccgcctttcatccaaaacccagactatccccgccaaagcaccactaatgtttaccgccatttttaatccaaaatcagcaagctcttttaaatcctgtatttgggcaatcttctgggttttagctgtcaaatcccgaagtttagaaatttcctcaagatataacttttttaaccggtaattttcccagtataccaccgccaccccaataaccatgacaaaaagaaaaccagctttaaacaagaaatcaaaccacttaacttcagggtctaagtagcaaacgataaaatacatagcagtactaacggtggcagttaataagccaaactgcggaccataataaaaggtgtgaatagccaccagcagcacataaccaaaataaaataaactatgaccgagaccggtgtaataaattagtgctgttaacagcaaacaatccagccaaaaagaaactttataaccaaaatctcttttttctggtttttttaacaaatatgcatacaaaacaatagaataaataacagcaattagaaaaataagaaaagcttttttattaattggctccgagttaaaaagaaaaaaaagcaaagctcctaccagggcaagaaagcgcaaacggtgaaaatcaccgattatttggtccaccataaaatacactccagctaccttttaattaactgtttcgacatgatttgcccgttttcctgcatcctcgtatccccgccaaaaagctttttcgtttaagggataaacaccttttggtccaaatatttcttttaaaacccctgatatagtttcagtctttactatcgaagttaatgctattaatgctcccagaagataaatatttaccgctttcatgctccccagttccaaacatgcctggtttgccggcaaaaaaacctgctttaccggaccggaaagttcaacatccactaaatcggagttaactatcacaatacctccgggtactgttctgggtaaaaactttaaatacgaaggcttattaaacgccaccagcacttccggttcaaaaaccaggggacttaccacttccccttcctcttctattaccaccgcacagttagcagttcctccccgcatttccggaccataagcgggaagccaggatactcctttattttctaaaaaggcagctttagccaggatttcccccattaacagcactccctgaccgccaaaaccagccattaaaaaatttttccccatcactccaccccctcttgcggggttttatattccccgagcgggtagtacgctatcattttttcatctacccattttaaggcctcaaccggagaaaccccccagttagttgggcaggctgacaatacttctataatggaaaagcctaagttagctctctgtaccttaaaagcttttcttaaggcttttttggcttctaagatgcgcttaggggtatttaaagccacccgggccgcatacgctacaccatctaaaacgcttaacatctccaccatttttaccggatagccctgatgggcagggtttcgaccttcgggggtggtggtagttttttgcccggtaagggttgtaggagccatttgccctccggtcatcccgtaaacggcattattgataaaaattgccgtaattttctccccccgggctgcggcatgaactatttccccggtaccaatcgcagccaggtccccatccccctgataagtaaacaccagccggtcaggctttacccttttaactccagtagccaccgccggagctcgcccgtgggccgctgccacccagtcaatatctatataatcataaataaaaacactgcaacctaccgaacttaccccgatggtttcttcgggattaaattcctctaacacttccgccaaaagccggtgcataataccgtgatggcatccgggacagtaatgaaaatttttttcggtcaaaagggccggacgcttaaacatttattccacctcccgggccagggctaatactttttccaaaacttctttgctttcgggtaccatacctcccgttctgccaaaaaactctacgtcaattcttccattaaccgccaggcgcacatcttccaccatctgtccgccgctcatctccaccgttaatatttttttagctactggaatattggccgcagtaaaagctttcctgggaaagggccagagggtaataggtcgaatcaagccagccttaattccccgctcccgtactttcagcaccacacttttcgcaatgcgcgccatcgtgccaaaacttactaagataatttgggcatcttccactaaaaaattttcatgtaatggctcactttcttcaatttgccggtatttggcaaattgctgttctaaatgcttttcattttcttccggaacgatatagagggaatttattatccttctggtcttatcatcccgctcaattttcccggtagccgcccagggtttgggcggcgggtttatttcctttaaaggcggcagttctaccggctccattacctgccccaagattccatctcccagaaccatcaccggcatgcggtatttatccgctaaatcaaaggctttctccattaaagtaaaaatttccgccacattggccggtgctaaaacaataacccggtaatccccatgtcccccaccctttacagcctggaaataatcggcctgggtaggagcaatattgcccagccccggacctccccgcataatattgacgataaccgccggaagctcggctcccgctaaataggaaatcccctcctgcattaagctaatccccggtcccgaagaagacgtcatcaccctggctccggcggcagccgctccataaaccatgttaattgccgctacttcactttccgcctgtaaaaacacccctcccacttccggtagcctttgggctaaataatggggtacctcactttggggggtaatgggataaccaaaaaaataacggcaaccggcccggaccgcagcttcggcaaacgcttcattccccttcatcaacactttcattttttgttcacctccaccgtcaaagccgcatcgggacagaccaggtaacaaaaaccgcattcccggcagttttcgggatttaccacttctacagggttataacctaacaaattaatctcccgggaaacccccaggaccttggccggacaaatattaatacaaagtccgcaacttttacagtactccttagaaacaactacacccaacttgctccccccctctttatcttaaaagaaaaagcggtccccataaccgcttttttaaaatttttgtacttattcgacttttttggcagaaatccttcttaccttcccagttcatcaaggtagcttaatacccgattatttttaataatttccgtcagtgaatatttttccgtaaaaaggtgaaacaaaatcaaaaaaaccacaactccaacttttactttaaaagaaaaaaggagcactcccgaataacctaaaataaatccaagcacattggaaccggcatctcccatcattaccttggcctttaaatccaaaggtaggtaagcggaaataatccctaaagccaaaaagaggaaagtcaccgccgggtaattaaagtaactaattccaatgatgaggccaattaagataaacaccttccccgctcttcccggacgaagatcaaaaaggttcataaaattaatccccaggactatcagtaaaaaatctacgataaaataccaaaaaggctcttttaccgtcaacatcaaagctaagaaagcaccaccaattgcttttaaagctccggtagtaagttcgtgctcaaaaattaactttttaaaatgaccttttagccctttggccctggcatcgcccaaaaaatcatcgataatccctaaaaaagtcatggtcgaaacccctgaataaaacaaaaaccagtaacttccccgggaaaaaattaagattagcggtgccaccaaaagcatcactaacaaaaaaaccactccccccgattggggaattaactcaccgcgaaaattttgccttaaatgtcctgtcttgattagcaagtttaaaacgggagatattgtcaggcgagttacaatgtaggcaaccacaaaaaataaaactttcgtaaagattggttacaccccctatttactcccaacctttcgtctgataatttcttttaaaatatcggcaaattgtctaccgcgatgaataaaaccctttaaatccctcccggtctcccggtgggtcattggcaccgccacttcaacaatccggtaaccttttttaagagcatccaccgtcatcccaaactccaaagcataaccttccgccagaggaagtaatcctaaaaagctttcccgggtaaaagccctttgtcccgataataccgcttccaccacctgtcccgtaaaactttttaatccccaccgagttaacctttttaccaggccaaagcccccttttttcctcggagcaccaaaacgcgcaataaccatatcggcttcgccggtaaaaagtggagttaaaagtttttccgcatagactgccgaatttcctaaatctccatctaacaataaaacaaaatcgccggtaaactccctggctcccgcttcaatagctttccccttgccaacattctgggaaagtttaataactttagctcctgccaaaaccgcctcattataggtgttatccgtggagccgtcatcaacaacaataacttcttctacaccggaaattttaaacgaagcttttacggtttccccgattcttccttcctcattataagctggaatgattaccgaaacttttttccccatattttcccccttactgccccatgggcggtattaaccttttggcagtgcttttaatgccgtaatctccctttactcccagtaaaccataaactaaacttaactgtcccgaaggcaggtccaaatcatctattgtcgtaattctttccttctggtaaaacttaatataggacttttcaacgttgctgtactctcccccaattaccaccggtacagtctttaaaaacttaataagcggaaggtcaagatagttcaccaaatcactttcatttagaccgccaccgataaccaccacaccatctaaaggcactccatatttcccggttatttttaaagcatcggttttggctaaagttaaaagggtcgaaccgtctcccggagttaaaagattcttccccacttccagggcaaatttggtgtagaattcttttttatccttggtttgccatttcatctggcttttaatataatctatatccgcaggattggtaagttcctccggtataatttcagtaacactgacaatttccgctcccgccttttttaaaacttcttttacctcatcgtttaggccgtaatagccggttacaacaatcgccacttttttgccggttaatttgcccttaatcagcacgggtaaggtttcttcctgatattgttttaaaactttattggttacttccaactcttcatttagagcttccagctcatcattttttttcttaagttcgtccaagcgtttttcaatccccagggtaagttgcttttgctgctttaaaattgcttcaccaattcggttatcatatcctaaggaagttccgataaaaattcccaggcccaaagctaaaaataccgctattaacgacgcaatgtggtatttaaaatctataatcataacaaaatcgcctccaatactatattccaaataaaagcttgagctgaattaacaaaacccggaataaatttctggtaaccggcgacacagctaaaataattaaaacaggaattaaagccgcaacaatcaggtggagtaaatatcttgctttcaagcgacttttgtacagtttattaacccctttggcatccacaagtttagcgcccacaagtaagcgcaccaaaaaagtactacccattcctttgcgccccttctctaaaaaatcaaaaagattggaatgggttcccaccgcgacaattaattccgcacctttttcatacgctaacagcatggctatatcttccgatgttcccggagctggataaattttagcgttaagtcctaaatcccgaagtcgttttaaacccggcgcttcaccgttcggataagcatggacgataatttctgccccgcattttaacgtttcatcgctaacgctatccatatctccaataataatgtccggacagtaacccgcttcccttaaagcatccgccccaccatcaactccaattaaaacgggtctgacttcatttatatatatgcggatagcttttaaatcctcctgataattatggccccgaaccacaatcaaggcgtgccttccccgaaaatcagtttttatcggcggaggcggatactgtcctaaaacaagccccgtctccttttgggcataatgtaaggtattttcgataaaggccaacatggtttctcctaaattttccttggtagcttccattttagctttgattttttcttcatttaaaaccgtgccttcgcccaaaaactcgtcatttctataaattttcccatccctaataattaaaaaatcgccttcgtttaaaatctcaaaaagtttttggggagcctcatcaataaggataatcccattttgcacaagtaaaagcggcccaatgttggggtatttaccgctaatggattgagcgcagttaataactgcctttaccttcttttcaatgaggccacgggccgctacctcatcaatatcctggtggtcaataacggctatttgacccggttttaagcgttttactaaatttttcgtttttttgtctaaaagggctacgcccttgatttccatttgttgccaccccaagatacttttttccttcctattatagcacagtaaaaaacgccaggaaacctggcgcttaccgtaaaacttattattaactaaccttggcttctaaacgcaaacggtcggcaattatagcaataaactcggaattagtaggtttaccccgttcgacatcaatagtataaccaaaatacttgttaattaactcaatattccctcgatcccaggccagttcaatggcatggcgggtggccctctctacacggctgggagtggtatgatacttttgagcaatcatgggatataactccttggttattgcccctaaaagattcacttctttcgtaaccattaaaatggcgtcccttaaataatgataacccttaatatgggccggtacacccatttcatggatgatattggttaccaataactccagattttttgttttgggtaattgggacgaaagaacggaagttgtattggaagcagttattggtttgctggcaaccgtaccctgcgctaactgtcttatgcgcgcagctaaaaccgaaaaatcaaaaggttttaaaatataataatcagcacctaactccaccgctttttgcgttattgattcctggccaaaagcggtgagcaaaattactttaggtctatcttcaaattcggtaagtttttccagcacgccgatcccgtccaaatggggcataataatatcaagaactacaatatcaggtttttgctgggcaattacctctaacccatcaacgccattatgggctattccagcaaggaaaaaatcttcctgctggtttataaattcttttaaaagctcacaaaactcccggttgtcatcaatgatgacaattctaattggatccacttcccccgcctcctaataatttcctttttattgcctaaaatacatttcgacggtataaatctttttcctgctattgacaaaatatttttttccgaaaaatagcgacagtattttacaaaagaaaaagtagagttaagcacccagaagttattactattatacacttcttttaacatgttttctataagaataccataacctttgctgctatcacttaaaaacacgtgggtcactacccctataaacttgccttctttaattatcggcgaaccgctcattccctggacaatcccgccggttaggcttaacagccggggatcttttatccttaagattaagtttcgaccatctttttgatacggtctcactttttcgacataaacggtaaatttctctattttttctccctttacaaccgtataaatttccgcaggcccaggtttgacttcctccttaaaagcaatcggcaccggttttggaaaataaggatttattatttcctggcttgctttgccaaagatcccgaatcggttatttaaatacacggtgcctacaatgtttttatggataaattttccaattttttcccccggctgtcctcttcggctgggataaattgcttgaattttggcctcgacaatttttccctgctgtaccggaaaaactttgccggtatccggatcaataatagtatggcctagagccccaaaggttttgtcctgcgggttatagtaagacagggtccccagtcctgcaatattgtcacgaataaatacgccaatgcgccagcgtttttcctcatcactatataccggatttatttcccgcttaaacgtttcttttccccgtttaatagttaaagtaattttttgtccccccagatgattaattaaattttttaattcaaattcatgattaaccggaaggtcgttaaccttaaaaattaggtccccttctttgagctttgcttcccgggctggatttatttcgccatctttggtttttacgtcggaaaaaccaaccaccataacgccaggggttttaagataaacccctatactttgccctccgggtacaagatattttatgggaatctttttttcggaattttctttaatggtgattaagcccaataattttacttcaagacaattttctttagcttttgccagatttggttgttccggaaggctacttaattgtacacaggtgcttaaaactcctaacagcaaaataaagacaattaccagccatttatcacgatatttttcttttatcaatggatatcaccccatttcatcgagtttttttgttaattttattttttctcttgttttcgtcgttatgttgttatttttctggagtgatatccaaaaaaaaaaaaaaaaatagcggtaataaccgctattttccttttttgagaattttttcagccatttctaaatttagcgcttctatctccttttcgcccagcattcgggcaatttcccattttctttcctcaaaagttagttttttcacccgtgtttccgtacgttcctcgctcactatcttttccacaacaaaatgggtatccgcaaaaccggcaataattggggaatgggtaactaagagtacctggtgatttgacgataacttttttaatttttcgccaaccacttcgataatactacccccaagaccggattcaatctcgtcaaaaatgagagtttcatgctcgtctacctggttaaagtacagcttaaaggaaagtaacaggcgggataactctcctcccgaggcaattctggccaggggttttaaatcttcaccgggattgggaagaaaataaaactgaatagcttcatccccgcgcggaccgggggatgcgtcggtaaaaacaacttttatttgagcatgcggcattaaaagctctcttaaatgctgcgcaatgctttcttcgagcttaaccgcaagctttcttcgatattctttaaccagggaatttattttataatagttttcccgcaattttacggccttttcctgataaaaagctttattttcttcaatttcgcttaaattttggtattcttgccgcgccttttccaaaaaattcaaaacatccttcagggtaggcccgtactttttctttaataactcgtaacgatagagcctttcttcaacctcatcgggattaacggattgattctccatatcgtccaagtaagtttttagatccaaagccgcttcttctaaaagaagggtagcttcctcgactttttttgaaatttcctcggtaaaagcgtcaaaacgggccgcctcttttaaatccttgatgattcttcccaaccggtcaacaattcccggttcattttcgccgtaaatttcccgataggcattgccaataagtccataaagcttttcctggtttaaaagcctattgtgtaaaagcttgagctgttcttcttcttcaaaagaagggttgattttttctatttcattaatgcaaaactttaaataatcgattctttttaaccgctccatttcctgggaagttatttcctcgtactgtttttccgcctccacccacgcttcataggcctcttttagctgtttacaccaccgctgaaattcctcattacccgtacggtctaaaagctttaagtggtaagaaggagcaagaagcatttgctgctcatgctgggtcataacatcaattaaccccaaagtcacttcccggtataacgttaacggaaccactgtgccgttaatccgggcaaccgacttaccgtccgccgtaatttcccgggaaaaaatgttcacctcatcggcaggcaaaccgtactcccgaagtttccggcaaagcttttccgactcaaaggttgcggttaaaagggctttacccgtcccttttctcaccatatccccgcgggctttctgtcctaaaagtaaaagtagcgcatcaattagcatcgactttccggccccggtttcaccggtaagaacatttaagcccggggtaaattccatatttacccgctcgatcaacccaaaattctccaccgtcaaagctaaaagcatatcatcacctaagtcaaaaattcgtcaaatctcgctaagattttgggaacctgttcccgatcccgagcaattattaaaatagtatcatccccggcaatagtcccaagaatttccggaaatgctacctggtcaatagcactggctactccctgggctgcaccgggtaaggtcttaataactatgaggttttcactttggtcataactgcttaccgcatcggcaaaaagtctttttaaacgttcaatagacgcagcggatacagttttttgcggcagagcataccgatagctgtccttttgaaagggaattttaaccaagcccagttcctttatgtcccgactaacggtagcctgagttacatcgaaaccggcctcttttaaagcttccgctaactcttcctgggttcttattactttctgttctacaagttcaagaatttttttctgacggcgaattttcaaccgtactcctccttttcccaattatataaagcttaggataagtttggggtcgatttaaaaattcatgcttaatcacatacccttcgcggtcgggaattttttgcgaaaactcctctatcaccatcctttcctcctccccgcccgcatggcccacatacacggtaaccgttattattcctccgggaagtaataacttgtaacattcggcaaggccggtgatagtggtagacggttttgtaactatgcttttatctcctccgggaagatagcctaaattaaaaaccgcagcttttatgggaacccgaacatactttaaaaccttttcgtgggaatccaagataaaaactgctctttcggctacaccggcttccttaagcttttgttccgttattttcagcgcttgttcctgaatgtcaaaagcataaactttaccgttttcccctacccggtgagctaaaaacaatgtatcattaccattgccggcggtcgcatcaacggcaacatctccagcttgtacgacttcctgcaggtataaatggacgaggccggtaattttctctaaattaatcatggtaacgattggcctcccgcatcttctctcttaaaagctgatagaaactgcgatttttaagtttaataaattttgcctggtaaggagcttttttaataataatttcatctcccggtttaatcccaaacccctgctgtccatcaacggttagcatactgctttccaatgcggtcttaaccacaattcttatttctttatcatccgccaccaccagggaacgggcggcaagagtatgcggacaaatcggggtaataataaaagctttgacctcgggatcgaggatagctcctcccgccgagagggaataagcagtagacccggtgggagttgccacaattaccccatccgccgcatattctgttatgtactgttcatcaacaaacactgcaaagttgataatccgggcaaaagcacctttggttaacactccatcatttaaaccataaaaaactgcaacttcctgattggcacgcctgaccctggcttcaagcatagtacgatcttctacaaggtattcccctgccctgattttttgcagtccaaaatctatttcctgggggtcaagttcactcaaataacccagttgacccaaatttattcccaggatgggtattgctttaggagcaaaatagcgggtggcacataaaatcgtcccatcgccccctaaaaccagaaccagatcaatcttttcggttttttcatcgatttccgctatttcaactataccgcattctcccgaaacaaggtagcggtttttcagcaaaaagtcgtaatccctggccttttccattattttttccaataaaatgggcccaagttttttatctttattcaccgcaacaccgatcgttttcaaagtagccaacctccgctattttaattctcgcaaacctcccttaattcctcctttatacttaaaaagcagggataacccctgcttatttattaaaacgtaaaaaagcctccgttacaacccggtcaacatcaattttaaccttttctttagtattgtcggtcgaaagatagagtaaatattcaatgtttccttcgaggccggtaataggagaataggtaagccccaaaggttgaaacccaagcccttcggcatactctaaaagatttttcaacacttcccggtgggtagcgggatccctcacaaccccttttttacccaccttttctcgtccggcctcaaactgcggttttattaacaccaccgcttctccccggggtgctaaaatttccttaattttcggcagcactaactttaaggaaataaaagaaacatcacaggtagcaaagccaggtttttccggtaagttatccacagaaaagtagcgaatattcgtcctttcaaaaacgactaccctgggatcctgccgcagtttaagacttaactgaccgtagccaacatccactgcataaacggtatttgctccatattgcaaagcacaatcggtaaagccgccggtggaagccccaatgtcaatgacaattttcccctgaagatttatcttaaattcttctaaagctttttccaacttataaccgccccggctgacatattttaaaccctgccctaaaattctaatgggtgaatcttccgttaccatcgtgccgggcttggtaactttttgttctcccactaaaacttcaccggccataattagggcccgggctttttcccggctctggaccaatcccttttccaccattaaaacatcaagcctttttttcatagcttacttaagatctcccgaaactttaaataaagcttttcttccgttaagccgtaaaggtttaaaatttcctccaccttaccatgaggaggaaactcgtcagctattcctaaattaaccacctttgttccaattcccctaaaggagaaatattcatttaccgccgaaccaaaacctcccgcaacaacattttcttcaacggtaataaccggtttatgtaagctaccaacttcctctaaaagcttataatccaaaggttttacaaaccgggcatcgataacagttaaagatataccttcgttctcaagtttttgggcggcttttaaagcatagtttagcgggcgtccaactccgataacaactccatcgctgccttcttttaaaatttccgcagtgccaataggtagctgctcataaggtgttagttcaacccctaccgccgctccccggggataacggagagcaacagggccggagtggtttaaagccgtgaacaacattttccgcaacatatcttcatttcggggtaccataatggtaagattaggaatcatccttagataacttaaatcaaaaatcccgtggtgcgttggaccatcttcaccgacaattcccgcccggtcaacggcaaagaccaccggaagattttgcaagcaaacatcatgaattatctggtcaaaagacctctgcaaaaaggtcgaataaatagccaccaccggcttcaacccttcacaggccattcctgccgccatggtcaccgcatgctgttcggcaattcccacatcgtaaaaacgctcgggataattttgggcaaagtaatttagtccggtaccggttggcatggcagcagttatggccaccacctccggacggtcctgggcaagctccaccagagctttgccaaaaacttcggtaaaacttaccctgggtgcttctaccggttcaccggtgcttatgtaaaatttgccgacaccgtgaaagccatctgggttttcttcagcccaatgatagcccttcccctttttggtaatgacgtggacaaccaccggtccggcaaaagttttggcccggctgaacacttcaatcatttcttttatattatgcccatcgataggtcccaaataagtaaatcccagctcttcaaacagcatgccaggcactaaaagatatttaaaactatcctttagtctttcgccaattttcaccattgtcggtccaatatgcggaatttttttgatgagggcttctaattcatctttacccctggaatatttggggtcggtacggatgcgacttaagtaggcggataaagccccaacattctgggcaatggacatttcattatcatttaccacgacaattagctttttctgtaaatgcccggcatggttaagggcttcaaaagccattcctccggttaaagctccatccccgataaccgctaccacttcgtactgctcaccttttaaatcccgggctaaagccattcccaaagctgccgaaatggaagtactgctgtgccccacaccaaaagcatcataagggctttcatcccttttgggaaaacccgacagaccgccaaaagttcttaaagttttaaactgtttttttctgccggttaaaattttatgagcataagcctggtgccctacatcccagataattttatctttgggagcctcaaaaacaaaatgaagggcgatggtcagttccaccactcctaaacttggagcgagatgacctccattctggctggcaacggtaataatgtattcccgcaattcctgggcaagggccattaattcactgggttttagtttttttatgtcttccggcagggaaattcgctctaaaataggtcccaaagggagtcctcctttaactgtctttgataatcttaactttcatatttttttccaaatggtatatagttatgcccgcaagggctataaccttttcggccttttcaattgcgatttttttacctaaagcctttccggcaacaatcacggcagcaataaagctggtaattaaaatatttatcagcgctaaataccctggaaaataccggccgatttgtaatgccagggaaatgcccagggccccgctgatggttcctgcaatatccccaataacgtcattacaaaaattagctaccttatcggcatttctcaccaaaaggtagctttccttagctcctcgtattttcttgctggccatcgcatgaaacggggcctcttcagcagccgccaccgccgtacccactatatcaaagacaatgtttaaaagaataattaccaccaaaaaaaaggttgcaaagaaaatactctgggttcgggcaataaaatactcggataaaacggtaaaaattaacgccaacccaaaggttaaagaggctatctttatcacacgcccgaagtaatcgttttcccctttggaatgattatttttggttttacccaacgatttttcacctcaatggtagggtccaggtagccaggacggctgatagccttacgggttaattttatggcttaaggtccagtaggatttccccagaagctacctctcgtcaccgaggaggcggtttccctttaaagcttctgccgcagggttacccgctgcggaactggatcaccacttagtccatactgcaatccccgtaagaccttggccgggccaaacagcctagaggatttccccgacggctcccgcaccaatctagcctcttttgcaaaatgggtttcaattagaaggttcgaagcctaagggcccgttcggcttctccccttaacctaatatccccccatttcactcaaggcaggctacactgcacgtagcacgcccccacgtgcaggtttaatcccaagccgtagttcgtgaatactccccacgcacttgggtctccgtggaaggagggtccacgcccgcatgccattgcggctcgccctccaaccttaactcccagcaccagcccccgactgggcgtcgtaagccagcaccaggaacttcatcgatgtgcccgcgacggatttttaggcccgtcttcgaaaggtgcgggtccgactaggatactgcatcagccgtcccgtgctattttcaattgtcttacaattataacaaaaatccagcaacatagcaaaagtaattttttcctaaataatgtctaagattctctttttaggataaattcagcaagctttataaaaaagctgcttttctcaccatagggctttaaaacattctttgccgcattaatttcttcttccgccctttttttggtttcctcaataccaaaaagcgaaacataggtaagcttttgatttttttcgtcactccccaccggttttccaatcttttgaaaatcaccaactacatccaacaggtcatcaacaatttgaaaagctaggcccaaatggcgcccgtaatcatccagagctttaatttcttcttcggtagctcccgccaaaatccctccggcaattaaactatagcgtatcaggcgagcagttttgttaagatgaatatataacaaaacctcggggtcttttttggcttcactggagcttaaatccaccacctggcctgcaataagcccctcggagccggaagctaccgccagttcttgaattacccggaccacccgctccgcgggtatcccctgttccaaggtcttggcagttagttcaaaagctttggttaataaagcatctcccgctaaaatagcaatggcttccccaaaaactttgtggttagttggctttcccctgcgaaaatcatcgttatccattgccggcaggtcatcgtgaataagcgaataggtgtgcagacactccacccctaccgccgccgggagcaatttttccggagcaatcccactccattcccctgcagccagcatcaggactggtcttaaccttttcccaccagctttaaggctgtagttcatcgcttggtgaattactggcggataggtatcatccgggggcagaaaacgcccaataccttcttctaccattttccgatatcttttaaaaaggctttcaaactccatgaaactcctccgctaaaaaggtaaatcatcttccatttccacaatttcctcaaaagtaacctcgccggcttcatcttcctgaacttccactaactttaattctaactctttcaacttttcgctgcaaaaacggtgaagctttaatccttcttcaaaaagagccaagctttcttctaaccctacatttccccgttccaaacgttccacaatctcgtttaatctattcatcgcttcttcaaaggtcatcattcttatcaccttcaattatatttttgccaagggccttcgccaaggcttccccatcggaaaatttaattttaaatctttccggaagattattaacggaagttacaaccctgccttcaaaatcaaagaccaccgcataaccccgatttaaaatttttagcggatttaaaagctttaatctttcttcataagaggaaagtaccaagtttttttgtaaaacaagattttttacggaagttcttagcctcaaactttgctggataagaaccgcctgatttctttttaataattcagcacaccgtaaaaaaagtctctcttttaactcttcgagtttttctttttgctgtttgtgacgaagatatggggaaagaaggataagtttttcctttaaaaggcttagccgatttttttcttgctgaaaagttgttttaaaacttcttaaaagcctttccagcccttcggtaacttcccggcttttatcggttattaatttttcgtatgctctcaatattcttctttcctgaaattccagatttttttgttcccgctggaaataattagctaaggctttgaccattttctggcgttgctcccgtaaattattccatatttccactaaattgggggtagcttcaaccgccgctcccgttggggtcggcgcccggcggtcggcaaccatatcggcaattgaagtatcggtttcatgcccaattccggtaactacgggaatgttagaagcatagatagcatcggcaaccgtctcttcgttaaaagccgctaactcctcaaaacttccccctccccgggctaaaattattacttcacacagcttataacgatttaataaatttagcgcctttactatctgtccgggagcttcatcgccctgcaccgccacaggaactaaataaagagtagccttgggccaacgcttttttattgttgttaaaatatctctaatagctgcaccgtttttcgacgtaacgatgccaattttttccggatagcggggcagttttttcttccgctcttcggcaaaatatcctttatcccttaacttttcttttgtttgctcaaattttaaataaagagccccgatgccaaggggctcaatcatctcagcatatatttggtatatacccctttttttgtagaccgccacctggccaaaaacaatgaccttttggccatcttgaggaataaaaggcagagccgaggcccgtcctttgtacatgacgcccttgagctctgccctttcatcttttaaggtaaaatacaggtgtccctgggaaaacttgcagttagaaagttccccctctaccgcaacctgatttaaccaatcatctttttcaaatttttcggcaatataatcggttaattccgaaactgtaacaataaataaagccatttatcgtaccaacctctttaattaaagtaattaaatccggaacatctgttcttttctaaataataacataaaaatcgcttgatctacaagcttaacctattcaaggttttaaaactcgttggtaactatttagacattaaatattcatggatagccctggcagcttttttaccagcccccattgccttgattacagtagcagcaccggtaacaatatcgccgccagcccagactccttcccgggtagtttttccgttctcatcggcaataatattgcctttgcgtcccacttctaagccttttgtggtccggggaaccagggggtttggactttgcccaatagctaccaccaccgtatccacttcaataataaattccgacccgggtattggaaccggcgatctccggcccgattcatccggttcacccagttcatacttcaaacactccatagctttaacccatccattctcatcaccgattatgcgggttgggttggtaagtaacataaactttaccccttcttcttcggcgtggtgaatttcttccaagcgggcaggcatctcgtttctcgagcgccggtaaacgatgtagacttctttcgccccaagccgcaatgcggtccgggcggcatccatagccacgttaccggctcctaaaactgcaactttttcgcctacctttataggagtatcgtattcgggaaagagataagctttcattaagttggtccgggttaaaaattcattggccgaatataccccatttaaattttccccgggaatccccataaaattcggaagtcctgccccggtacccacaaataccgcatcatagccttcttcatctaaaagttcatcaacggttaaacttttaccaatcacggtgttggtttttatttccacaccaagtttctttagattgtcaatttcctgttgcactatccgtttgggtaaacggaattcgggaatcccgtacattaacacgccgccgggaacatggagagcttcaaaaatagtaactttatgacccagtttggccaaatcggcagcacaggtcagacctgccggtcccgaacctatcaccgctacttttttgccggtaggaggagcaaccgtaacattttgggtgccttttgctaattcataatccgcagcaaatcgttctaaacggccgatagccaccggttcaccctttttccctaaaacacactggccttcacactgggactcctgagggcacacccgtccgcatatcgccggtaaagcattcttttcttttattttattgatagcgctgtcaatatctcctgctttaataaaccggataaagtcaggaatatcaacttccaccggacatccctgcttgcaggcaggtttcttgcagtcaagacaccgttcagcttctttcatggcaagttccaaactgtaacccagagccacttcatcaaagttttttgccctcactttagggtcctgttcaggcatggggtacttttttgttggccgatcaaacgccatagctttagcacctcccgcagccctcttcaaattttaagagggctctcttttcttcatcctggtagatttttgcccgacgcatttgctcatcaaaatcaaccaaatgaccatcaaaatccgggccatcaacacagacaaatttagtttggccgccaaccgttacccgacaggctccacacatccccgttccatccaccataatggaatttaaactaactatggtttttatttgataaggccgggtaacctcagctaccgccttcatcatcggtagcggcccgatcgccaccaccaaatcaattttttccccgcgatcaataacctcttttaaaacatcggtgacaaaaccctttctcacatacgaaccgtcatcggtagttaccagcaactcatcggttaccgtccgcattttctcttcccagaagagatattctttcgagcgagcaccaataatcccagtaactttatttcctgcctcttttaatgcccgggttataggataaatgggggcaatacccactcctccgccaatacacaccacatttccgaagttttcaatgtgggagggaacacccaaagggcctacaaaatcgctaacagcatccccctcattaaggagtcccaactgtttggtggttttccccacttcctggaagataatggtgacaagtcctttttcccgatcataatcggctatggtgagcggtatcctttctcccttttcgtcaatttttaaaataataaactgcccagcctgagcttttcttgccaccaaaggtgcgtcaatttcaaaaagtttaattgatggtgctaagttttccttttttaagattttaaacactaagccgccctcctttgagttttatgaattttatatttatttcataattttattaatattcttcactaattttaaaaatcctgctaattcgcgagatttccgcaacaccaacagcattgtcggaagcatactggacttcagcaaagtaaagatctactgctacccttcttttctttaatttttccaataaaaaattttttatataattatttgccgcaaccccgcccattaaaactaccggaagattatctttggcatgatactggataattttaaataaagtcctggctattacttcctctactgcccgcgcaatttcaaaagccggaaagtctttaagctttctttttaaatatgcctctgccccggagaagtgccagttgccattgacaaaagtcgccggcactttgagaatccctactgccttttgggccaattcctctaaaaatttgccggaaggaaaaggaagtcccaataagaccccaatgcggtctaccagctgtccggcagaaatatcaagacttttacccagcacctttactttgtaaccttgaggttctttttcaacttctaaaatctcactggttcctccggaaaaatggatggctaaaaacctgggaaaatctttttttaaagaccaaagggccgccaccaaatgcccttcctgatgggtagttttaacaagggggacgtctaaagcaagggaaagggtactggcaatcacttctcccgccaaaaaagatggcatatacgattccggtaatggcctcggtttaaccgagacaccaataccccgcacctggtcccgggaaattctgttaaaaccttcctgcaccatttcctttaaatgccgcaggtgcaggaaaactacatccctctgccttaaccctacctcgccttcaggtaccggcagtattttccttaagtcaaaaattaaacgtccctcaccgtctacggcggcaaaggacgttgtgtagttgcttgtatcaaaccccagaaaaataccttccattaactttcctcccagaattcatcgatatgttcagccacatatcccaaaattccattgatgaattttggtgactcttcttcaccgtatactttggccaattccaccgcttcatctatagaaaccggaatgtcaatatccggtcgatataacatttcatacaaagccaggcgcaaaagagtcttgtccacctttgccagtcttttaaaatcccacccgatggcgcgccggcgaataatctcatccaatcgttcctttttctcaataaccccccgcaccaattccctggagaaatccaccaatttttccggaggtattttcccttcagcaattttttccgcccacagactttccagggtatccaaagttttttctggagcaaaatccagtccaaacagcgccttaaatgctaattcccttgccgtatgacgattcacaatcgctctcccctatgttaccgctctttaaaaattttctcccaaacccggctaaaatcttgatcctcatctaaacgttttccaataaaataaccaaggccaagacatatcgccaggaataatgctttccagaagccaaaagcaatggctaaaaaaccaaaacctccaccaataaccatccctaatatttttccccggtttttttgaaagaaaatttcccactcgtccattggctccacactcctattctacccgcggccttaattcctgggcaatatcttctacttttatcttgatcctggaaagttttatccccaagctttcctggatgtagctgtttatctcttcctgcaaccgcttggaggtttccggtatgtttaaatccggaagtactcgcaccaatacttctacccctaatccttcgggataagcttctaaaaccggccgtacttcttttactcccggaatttttcccgcaacccttttaattaaagccgttatggtatcaaaggtaacgtttatctggccaagctccccttctaaagaaattcccttatctcttttatgctgggtttttaagcttaaggcaaccactctcaggcctaaaaggaacagtaccaggagaaaagcaaaaagtgcggtccgcaattggacatcaaaaagcaaattttttatgtaaaaaattggcaaatgccagcctaaaaccaccagcataaaacaaaaaagtaagatgaccgttacaaaaccataaagaaataagatactccggtctaaaaagttcatttctacccccctttgtcaataagattggcgggttataacccgccactacttgacccgtatttcctcttccttcccttcagcgggaaagtgcactccctggacatgaacattgacttccactactgtaaggccagtcatgttttccacagcttttttcaccgcttgctgaacctcactggccacatcaggaattctcactccatactccactatgatatataaatcaatcgccgtttccctttcccctacttcaacttttacacctttggccatcgacttcatcccgagcttttcagcaatcccagccaaagtaccgctcattcccgccacaccgggaatttccgaagctgctaatccggcaattaccgcaacaacttcgtcactgatttttatactcccaatttcggtcccttcttcacggattaatttattatctctgccatccacgaaaaaaacctcctcgaatttttataaccatcttttaatcatattataacaagcggtaaatttttcaacaataataattactcttcggccaaaattcttctctgcacaaaatttgtgtaaacttcacccttacggaaaaaggcattttccaatacctttaaatgaaaaggaattgttgttttaattccttcgacacgcatttccagaagagccctctgcatccgggaaattgcttcttcccggttttgcccccaggttatcaccttggccaccagcgagtcgtaatagggtacaactttatagccggaataaagaaaactgtcgacccgcaccccattaccaccgggaggcaaatattcggttaccgttccgggactgggcataaaattcttctccggatcctcagcattaatccggcattctatagcccaaccgttgatttttaaatctttttgacttatggacagcttttctccggcggcaattttaatttgttctttaataaggtctacaccggtaataaactccgtaaccggatgttccacttgaatacgggtgttcatctccataaaataaaagtttttatttctatccactaaaaactccaccgttccggcactgtagtaatcaacggcccggcaggcctttaaagcggcctcccccattttttcccgcagaatcgggtcaacaaagggagaaggtgcctcttcaattaacttctggtgacgccgctgaatagagcaatcccgctcaaataaataaacataatttccgtgcttgtctcctaaaacttgaatctcgatgtgccgcggttcttccacgtatttttctaaataaacatcgggattgccaaaggcattttgagcttcagtacgggcggtaataaaagctttggccaaatcatcatcgttctgggcaatcctcatccctttaccaccgccccccgccgaagcctttaacattaccggatacccaatctcccgggctatagccacagcttcttccacattttcaacaacttttttggaaccgggcactaccggaactcccgctgcaatcatggtttgacgggccgtagccttatctcccattaactcgatggcccggggtggcggaccaataaaagtcaatccgcttgcttctaccgcttcggcaaaagccgcattttccgccaaaaagccgtagcccgggtgaatagcttcggctccggtgaccagagcagcactgataatcgccggtatatttaagtagcttcggtttgattctttcgggccaatgcaaatcgcctcatcggcaagctttacatgcaaactttcccggtccgcttcagaataaaccgcaacacttgaaattcccatttctcgtaatgctcgaataatccggacggcaatttctccccgattggctacaagaacttttttaaacatccaatcattcctttccaaaaaattacccaaaagtcaaaaacttttgggcaaattttttcctatacctttactttaaagagcggttgaccgtactccaccatttcaccattttcaactaaaatctctacaatctcgccacttatctcactttcaatttcattcataagtttcatagcttcaatgatacaaaggacatctccaggctttattttctgcccgacctccacaaaaggcggcgctccaggagcgggtgctcggtagaaagtacctaccataggtgaagttatcaacgaaaaattaccctcgtttttttcttctactttttctttgctctcaactccttttgcctccgttaccggggcctgcggtaacatagttaccgttccttcgctcgacccctggcctttttttatggcaattttcgtaccttcactttcaataatcagttccgaaatatttgtttcgtttaataagagtattaattcccgtacttcctttaaattcaaattttgctcctccttcctcaattccttagtcttttgctttacttccttattattcaccaccggtgttaattttccctgctcccgctcttcaaaaaacttgcgggcaatttgggggaataaagcataagacaaaagatcttcttccgaccgggctaaatcttttatctcttcttttattttttccattctcggttctaacaagtcagcaggtcggcactccaccggctttaggtccccaagtatcttggctttaatttccgggtcaataggagctggcggccttccatacaatccctgcacatacgagcgaacttctcccggaattaatttataccgctccccggttaaaacatttaacaccgcctgagtccctacaatttgactggtaggagtaaccaagggaggataaccaagctccgcccggacccgcggtatttcttccagaacttcttccaggcggtgcaacgccttttgctcttctaactggctaattaaattggtaatcatcccacccggcacctggtgttcaaaaacccgcatatcggaaatgcgggtaaccccccgttcatagcctaaccgtttacgcaaatcttcaaaataacgggcaatctcaaaaagctcgtgaatattaagtccggtatcataaggggtatccgccagggctctcaccaccgtttccaccggcggctgggaagcaccgaacgccagaggtacgctggcggtatccaccacatccacccctgcttcaatggcttttaagtaagccccaacggcaagacccccgatgtaatggctgtgaaattgcaggggtacccctaactctctctttaaagccgccaccaattcataagcttggtagggggtacataaccccgccatatcttttatgcaaatggaatcggcacccatttccaccaaacgtttggcagtttcaacataatgctccaaagtatgcaccgggctaacagtataaactaccgccgcctgcacatgagccccggcggcttttgcggctttaatcgggacttccatattgcgaatatcatttaaagcgtcaaaaattcttataatatctatgccattttccacagctttaaaaacaaaacgttctaccacatcatcgggataatgctggtaaccaactaacgattgaccccgtaaaagcatttgtaaaggggtatttttaacaatttttttaattgctcttaagcgctcccagggatcttcttttaaatagcgcaggcaaacatcaaaagtagctccgccccacacttccagggaatgataacccacccggtcaagtttttctaagatgggaagcatgtgttcggtccgcatcctggtggcccaaaggctctggtgaccatctcttaaggttgtatcggtaatttttactctgcgcctcatctctctcacccctgaatataaaaaaaagaggtactcgcacctctttttttgcttttacacggttattatataaaaacttataaattcacgaaactctttggaaataagtatacaagtatacttatttaaagattaccagcaccttaccgggaggataatttaaattttgggccacaaaatctcttatttccaggcggattttatcatcttcctcttttttcatcactactaccgcctgggtatcctgaagataggcaaccacatcggtatcataacgggcttttaaggtttcctccaaaaaactttctttttccttaaaatccaaaatttttaaaattctttcctccgccgcctggcgattggtcccaagctcctttaagctttctattaagtaagaacgatttttttcccgcattaatctgaactccccgagatttttggccgtcgttaacgagctatcaactacagtgtttggttttgtacttgttatactttcctctggccttggaacagttacaactaaagcaagaaccaacgctaaaaaaatcccaaggccaaccagccattgctttttaatgacgtacaaccccgctccccccttccagtacttcaattttatgaagcggtaccgccagggcactggcaaccgcctggacaattttttcttttagtgctggatttcctgctccctcggccactacaacaactccacccactaccggtgtttcttcggttaacaacaccgggctttcctgcccttcccggtcttttattaataccacttctttttggtcggtgttttcgttgatactccgattaattcccgatttttccgattcattggtaattttttgcccggcattacggtttaaagcatactcttttgctgaactgcgtaaaagcttaacttcaaccgctacttccccaactccggcaatttttcctaaaataccctcaagacgttcggcaagttctttctcctggcggctaatttccgattcaatctgagcactgctttttggtaactccggggttgtggttttactcttcgggctatccccccacgccagaaataccaaaccaattatcgcaaggcttacaaagaaaacaagtttgtcccgttccatctctttaaaaaattcccaaaacttcattgacccacctccaatgctttaaaatttatgtttttttctataccaaaaaatgcttttaaaacttccgcaaaacgcatttcttccccctcctccagcggcttttttaagtaaaccgtaactccctccacctgtccctctccaagcttaacctccacgtcttttactttgcccccgtttaagtttaaaagggcttttacctgagcttccagggtcttctccgcctctgacctggcattttccaacaggcttccctgactcaccgctactgttttactttgactttccggtaaaaaaaccgccaaattccagtttgcatgcaaaagctccatcagtgatgttagcatggccataattagtaaaaggccaatcattgcccgagtaaagttccgaatttgtccaagaggcaggagcagttctaaaaaagtaaaaaggagaagtaaaaaaattatttcccgggcaagtttaattaaactttccattttatcacccctatacgggtttaccggcggaaatcaacaccgcaaaaaggaaaaataaaaataagcttaaaattgctaaaacgccaaagattaaaaggagggcattacccattccggttaaagtcttaacgtagttttcttctccaaggggctctaaaacagctccggcaaatttatataaacctcctaaaaccagtattttaaccgctggagcggtaaccaccccgaacaaaatcacaatgcccaaggcatttagcgcattttttaacagataaacagttccggcaacggcttctacggcatcggttaaaacttttcccactaccggtacaaaagttccggtagcaaaccttgcggtctttaagataaaattatcggcaacccctccggcaacggtttctaaagccccaacccctaaaagtaaacttaacattagaccaactaacccgatacttaactgctgggcaaactttattaatttatccagggaaaatcggtcgcttattccggcagcaatctccactaaaatactgagataaagcaggggaaaaactaagtttttaatgacgctccccaatatcccaattaccccaaataaagtcggagaaagcaaggcagaagtagtcacggctccagctgccgcaatcaagccaagacttgccggcagtaaagatagagccaccccaaccattccttccaccgcatccctgccaatctttaacgccagggtaaaactctgcagggctaaaagcataaaagccaggtagcacgccgcttgggaaatctgcgctatgcttccggaagaaaagctattttccaactgccgtaatagggaaaggataatagctaaaataaacagctttaggagaatttttatatttccccggatttcagctaaaagggttcccttcaggttctcccatatttcggcaaacgatatttccttctctccccgaaaaattgccaatacttctcttttaagatccacttgcggaacgacttttcttaattcctgttcagcagaatttaaaattttctccgcctcaactggcaggcttacttcgttggcaaataccgggaccactccattgaggataaggaaaattaaggtaaaaacaaaaatactgagttttttcatggttttcatcctactcgggcagtagttttaataaagtttctaaaaccgccataaggatgggaattgccaaaataatgaccaaaattttggctgccagctcgattttttgagcaattgccccttctcccgcatccctacagatttgggcaccaaactccgcaagatacgatatgccaattattttaaaaataatccccaaatataaactgttaagaccagctcgctcccctaaaccggtaaacacttccacaactgccgcaattttatccattaaaagtaaaaataccactactccagcggttaagcttaataaaactgctatttccggacgctcctttttaacaatcaaggccaaagtagtagctattaaaccaaggcccaccaccgttccaatctccataaggacctcctaaaacagcttaaacacggttttaatttccgtaaaaagttccgccagtatttgaatcacccaaaatagtactatggatatccctgccaaggtggccatgtacgcttgttcttctttgcccgcatgttttaaaaccgtatgaataaccgcggttaagatgccaactcctgcaattttaaaaataatctcaatgctcgccattataaccctcctttaaaaaaacagcaaaaccaaaaacgctcccacaagcactcccaagtaattaacaagtttgacatttttctcggcttcctgccggctttcggccaaaacaagttttaactgttcgcaggtataatttaagagattttcctgctcccgcaaatccgatattccaattttttcagcaaacgctaagagtatttcctgttcacgctttaatagagccgtttgggaaaacccttccgcaagagctttttttagtccctgattaaccggcaaggtcctatccttaatctcaaaaagcttggccaccgttccttcttcggaattagccatttttgcaaaaatttccggtaaaggtgtagctttataacgaatttcggtttttaagaagtttaagaggttaattaacctttctaaattcctaaccctctgcaagtaccggttaccaaggtaaaatcccaaagcaccggttccagtaacggttagacacgctcccaaaagcttaaggtacattctaacccctcccaaagataacttttccctgaccatctaacaccgcttccaccgtccccggtccttctcgccggcttaaaattacgtatctttcaaaaatctccaatttcaaaaagggtaaaaaccggggccgcttttttaaatcatccatatcccgggcatgagccgatgtaaataccgctacaccggcattggccacttctatcagtgctcccacgtcttcttcccgcccgatttcatcggtaacaattagctttggagccatggagcgtaaaagtatgatcattccctgggctttaggacagccatctaaaacatcggcccggataccaacatccaactgcggttctcctttataacatgcggcaatttccgaacgctcgtccacaattcccaccggaatccccggaattccgatctgggcagagccgttggcaaaaattcttgctaaatccctgagcatggttgttttcccgctgcggggtggagacaaaattaaggtattgaccggctcgccgtttttgttaataagatatggtactattttttctgccactccctttatctcccgcgctatccggatattgatgctacagacgttttttatatggcgcaccttcccatcctccaataccgcctgaccggtaaaaccaatacgatgtccccctcttattgttatgtatccctgttttaattcttcttccaaggcataataagatgaggccgtaattaattgaaatagtgccaaaaactcctcctccgccagacataccccgttgtcctgttcaaaagtgtattccccacgcccattgataaatacttcttcctctccaaagattaggcttaaaggccggtttttcctgactctaatttcttccaggggaagatcaacgactccctctaaaacctttcttaaggtcggggttaaaatctcaaaaacttcccgcattcttcccctccttcctttttttgtatataaaatattagacaagttagtgttttatgctataatttagttaataaaacttgagggggatttttatggagcaagcccaattcacgcaggaagttttaaaagccctgagtaatctaaacagtcacctgcaacggattgaccaaagtctctttgacctaaatactaaagtaacaaacatcgagcaaagactggatagagttgaacaaagactggaaaatgttgaacaaagactggaaaatgttgaacaaagactggatagagtcgaacaaagactggacagcgtagaaaagagattggacaaagttgaagaaagattggacaaagttgaacaaagattggatagagttgaacaaagattggataaagttgaagaaagattggacaaagttgaactaaggcttgaccatttagaaggtgaggttattagtcttaaagttcgggtagaaactctggaaaatcgctttgattcactggaaaaaaggacaagctctttagaagaaaaccaaaacatcattgctaaaaacgttttatatcttaccgaaaaaatgccggagcttttccgtgaagttgcagggatcgccgcaaagcaacaggaaattcttgaaaaccaaagtaaatttgcagaatttgccaggacctactctctgaaaaccgactttttggcccaccgcttacaggaattagaaaaagaattttgggtacttaaaaccggctacaaacccgaggtaaatttttaaggcgggattgctcccgccttaaattacatcatcgtaattttgttgatttaaagcctgttctctcctattttcaataaactcacttaccagcaccagggccccgcagttaggacaggtaatctcataattatcgtccgcttccaaaagctccctttcaaaataaacccgttctccgcattcgggacaggtgacataggtaaactcttcgtcatcatcgtaaactgcatcttctaattcatataaatcatcgtccaccgtttctacgtactcttcaagccgttcctggtcgtctcttaagctccttacttcttccgtaaggtcagcgattaaatcaattatttccgtaattatttccccttctttacccttttcctttaaattaatgccttctgcaagtccctgcaagtagcttaccctgccgacaatgtcatccacaaaaatccctcccggaaaataatttcttttttattatttccgggagagcaaattttactccaccgtcacgctttttgctaagttgcgcggtttatcaacatcgttaccccttaaaactgccatatggtacgccaaaagctgcaaaggcaccaccgctaagatgggagctaaaagctccggtacccggggtagatatatttgctcatcggtaactttagctatttcctttttgcctgcaaaagctattccaagaatggtagcttcccgggcatttacttctttaatgttagaaagcatcttttcaaatagagcttcctgggtagccagagctattaccggtacgtctttgacaattaaagctaaagtcccgtgctttaactcaccggcagcataagcttcggcatgaatgtaagatatttcttttaactttaactgtccttccaagcttaccgcaaaatcaagacccctgccgataaagaaggcatcctctttatttaaatgctttttggcaaactcaataactttatcttctgcttcaagaacttcctgcactttctggggaatttctttaagcccgaagaccatttctttataaagtttttcgtcaatggtgccttttactcttcccagataaagagcaaaaaggtacatcacgagaagctgggtagtgtacgccttggtcgaagccaccgcaatctccggacctgcccaggtataaatcacgtcatcggcctcccgggatacggagcttcctaccacgttagttaccgctaaaacccgggctccccgcttttttgcttcccttagcgctgctaacgtatcggctgtttcccccgactggctgattaccaccaagaggtcatttcgcccaattaaaggatcccggtagcgaaactccgaagccacatccacttcaaccggaatccgcaccaatttttccaaaagatacttccctacaagtcccgcatgataagcggtcccgcaggcagaaataaaaatacggtttaagcttttataaaattcaaggttttcctcaatttccggcagctttacttctaagttttcggcatctaacctaccggctaaagtatcccttaaggctttgggctgttcaaaaatttccttttgcatgaaatgggcgtaaccgcctttttccgcttcttcggcattccaggttacttcatagatttctttggccaccggatttccacccatgtcgtagactttcactgtgttagcggttaattcagcaatttcgccatcctgaaggatataggtctttcgagtatggttcaaaatggccggaatgtctgacgcaagaaaattttcgccatcccctaaacccacaattaaagggctatcttttcttaccgccactatcctgcccggttcctctaaagccaggaaagctgccgcatatgaaccgtgtaatcttttctgaagctttattaccgcctctaaaaggtcacccgcataatacttttccaaaaggtgagctaatacttccgtatcggtttccgagcgaaaagtatgtccctcagccattaattcttcttttaaatccaggtaattttcgataatcccgttatgcaccacggcaaatttgccggtacagtccaagtgcgggtgggcattttcatccgacggtttaccgtgagttgcccagcgggtatgaccgataccggtagtggcatttaaaataaccccggaaagcttttcttctaaattggcaatttttcccacagacttggtaatcttgatatggctatcttcgataacggctatacctgccgaatcataacccctgtactccaattttttaaggccactgattaaaatcggtgctgcaggtttaggtccaatatagccaacaattccgcacatgtttgtttcccccaatcaataatagtttattattttcagtttttagttttttcaaaaggcaaaaaagcaataaaataccctccccacaataatagtggtaggtgattagcgttaggcagtcagtaaaagtatatttttaccagccttcattaccctgccaaatattgtgggtttaactcttagagtataaaatttgtaacatacaagcagattttcccattcttgaggtcggtgaaaaagagccaaaaaaattttttacagacaactgaccaccgactaccaaccactgttaatgtatggtcgacttcagtcaactaaaagatttctacagctaaaaccgccacaatttatcggtggttagtggtaagaagtcagaaagtaactaaagattttacccaccacagacgaccaaccaccgaccacttttattcgcccggcgccctttgtcccgaagattgctcttcggttttgtccgacgcctttaacggccgcgaaaagccgggaggcatccgccgatacctcgataaacctccacctcgtcaaccccaaaaggggtcccggcgctttaaggtaataaatgcctataatttttcgataaccgctataatctcatccaccacctcctcggtaagttttgcatcagctccttccgccataacccgaattagtggctcggttcccgaaggtcgaaccaaaatccttccttccccgagctttttttcaccccgggcaatggctttggcaagttcctctgatgccataatcttttctttatccaaaacccgcacgttttttaagacctgcgggaatttgggcatttcctgagcaagttccgatagctttttcccttcagccactattacctgcattagctgtaaagcggtaataattccatcaccggtggtattatggtctaaaaggataatgtgcccggactgttcgccaccgataatcgctccattttttaacatttcttctaaaacgtacctatcaccaactttcgtctctaaaacttcaataccctcccgggcaaaagcttttttcaaccccaaattgctcattaccgttaccactatccggttattttttaataaaccctttttctttaagtacttaccaataatcaccataatctgatcgccgtcaactaaattccccttttcatccaccgccagcacccggtcagcatcaccatcatgggcaagacccagatgggccccttcctccaccaccgcccgcattaaagcttccgggtgggtcgaaccgcagttagcattaatattggtaccatcgggagtgttgaaaataggaataacctccgccccaagttcttcataaattttgggagcaacgtatgaagcagctccgttggcacaatccaccactaccctaaggccgctaaagggaagttctaccgtatttttagcaaaagatttataaagtaataccgcatcggaaatttcccgtaccctgcctatttctgcaccaattggccggatgggtatttccttttctcctaaaacatacttttcaatttcttcttccacttcatcgggaagtttaaaacccgaaccgctaaagaatttaataccgttatcttccatgggattgtgcgaagcagaaattactgccccggcagtagcttttaattcccgggttaaataagcaatagccggggtaggcataaccccaactcttaaaacattaaggccaacggaaagaattccggcagccaaggctgtttccaacatgtctccggaaatgcgggtgtccttccctaccactattccctgtccattatattttttctttaacacataggctgcagctctaccgagtttataagccagttcgggagttaaatcgcggttagcaacaccccgcaccccatcggtaccaaaaagcttacccattatccttcctcctttgtcaggtattttataaccgcttccgccgctcttatcccgtctactgcagcacttactattccgccggcatagccggctccttctccggcaggaaaaagtcccaaaaaacctaaagccatccccttttcgtcccgcgtaatccgcacaggtgaagaagttcgagtttccggccccgttaatattcctttttcaataaagcccggtattttccgattaaaatccatcaggccttcttttagcatttgatttacgtattcgggaaagagatcgtttaaatcggaagctacaactcccggtttataagtagcattggctacttcttcaaaactacttattttccccgagagaaaatccacagcccgttgcgccggcgcatggtagttttcgccgccaattttataggctttttgctcaatcttcctttggaatttaactccacccaaaggcccttcgtaaaaatcctcgggatttaccgataccgccagggcgctgttggcaaatttcccgttccggcggtaatagctcattccgttagtaaccacaccgccttcctcagaggaagctccaaccaccaccccgccaggacacatacagaagctaaaagtagcccgccccatttccttgtttttatagacaagctggtactcggcagcccctaacttgggatgcccggcataccggccatattgagctttatcaattagggtttgcggatgttcaattcttagtcctatagcaaaaggcttaggctctatcataatacctgcatttaataacatggaaaaactgtcccgggccgaatggcctatggctaaaactaccgccgctgcccggcactcttcccggccgtttactacaacacctacaactttccctttttccaccaataatcccgtgactttagccgaaaagcgaaccatcccacctaattggattatttccttccttaaattaactacaacctcccgcaggcggtcggtacctatatgaggtttggcaagataaaaaatctcttcgggagctccggcagccaaaagccatttatagactaaagcaatcctccggtcgtgggtgcgggtagtaagtttgccatcggaaaaagtccccgctccgccttccccaaactgcacattggactcgggattaaggttcccgttttgccagaactcccgcacatcctctacccgttcggctacaggcttccctctttccagcagtaaaaccggaaagccagcttttgctaaagacaaagccgcaaaaaggcctgccggacctgcccccaccaccactaccggttggtttaaagctacatttagcttatgaaaatcttccacttccggttccggtagggacacatattggtcctctaagagtcttttcgccttttcctgagaaatagcaagatccaccaaaaccgtatacacaaaaaaaagccgctcttttctacgagcatcaacggcttttttaattattttcagggatattaccttatcttccctcaaaccgtattttcggcacagttcggtttttaattttgcttcatcgtcttcgattcttaaccttaaattacttattttaaaaagcattatcgtcaccttttaggttgccaatatcaatgaaattatagatattttattttttcttgtcaatttcaatgtatacttcgaccctatcagtgctataatatactccatcttcccgaataagggaaactgtaacctttttgctttttctggccccatttatattaatttcttccgtaaataccgtatcctgcaaaacccccgatggaatccagccggaaacctgtatcttggggggagttattttcgtccgtacaatttggtaccccggagccggtttgccggtaattaccggcgttactttaacttctttcttgtaaaactgaacaaaattatttttttcgtttgctacgtaaaaccataagagaaccgccaaaaataccgatgttacttttaaaattaaattttcccgcaagttttaaaacctccatttttttgcgctttcccggtaaaataaaagattttcaataagttttcgttgaagttcatcgcggcttaaataccggtaaagtttcccctccaccgccaaggagattactcccgtttcttccgatacaattaacaccactgcatcggtctcttcggaaaggcccaatccagcccggtgacgggtaccgagattttttaaagaaaaatcattatgggacaacggtaaaaaacatgcagcagcggctatccggccattacgaataatcaccgccccatcatgaagaggtgacttaggaataaagatattaattaaaagctccgccgaaagttcggcatctatcctgattcccgtttctatgtattcatttaaaccggtatttttctccaccacgataagtgccccgattttttgttcggaaagctttaacgcggcaccggttaatatttcaatattatgccttaactgcttttcatcggtttcggtaagggtagttttaaaaagagagccccggccaagctgttctaaagcccggcgcagttccggttgaaaaacaatgggcagggccaccgctaaaaaagtcattgactgtttcaaaagccagcttacagtgtttaaccccaaggcttttgctaaagcgttcgctaaaagtaaaatcacaaccccttttaacagggattcggcccgacttccccgaattaaaaccaaaagtttgtaaataacaaaggaaactatagcaatatctaacagagttgtcaaaaaataaggaataacctcttttatgcccataaaacttctccctgtattttgctactacatacgttattttaacatttttctcctaaaaaagtaagaaaaccggcataaaatttaatgccggtttaatcaagattcatttttgcgaacaagattttctgaaacggtaagattctcatttaataaccctaaataatttaaaccgtgaataattaagctcaagatcacacctactactgcagctaaagccatgccttttatttcaaccgttcctaaagttactttagctccactcactcctacaataaaaactactgccgataaaaccaaattgacattttttccataatcaaccatttgctcaattagcatccgaatacctgaaacagctataactccaaacagtaaaagacttattccgcccatcaccggccggggaatggtttggattgctgcagcaagtttaccaattaacgagaggataatagctaatactgcagcccctctaattacccataccgaataaaccctggtaatagccattaccccaatgttttcgccataggtagtgttgggaggagaaccggtaaaaccggaaattacgttagttacaccatcggcaaaaagggataaatgaagacccggttttttcaccagatcccgctccacgatatttccagtaactattaaatgaccaatatgttctgccaatactacaagagctgccggcgccatgactattatggcatttaaattaaactgaggtgtactaaaggttggtattttaaaccagggagctttagccaccagtgaaaaatctaccatcccctgagtccaggcaaaaaaatatccggctataatggcaattaaaaccggaataatctgcaaaaaaccccggaaaactactgacccaattattgcaaccaaaagggtaaacatggaaaccatgactactttaggattcattgtccaattttgtccgctgggagcaattcccgccatttgggccgctaccggtgctaactccagaccaattaccgcaactacggcccccatcaccggaggtggtaacactatatcaatccatttggtacctgctatgtaaataattccggaaaccacaatgaagaataaaccaaaaaagataaaaccagactgggcaacaggataaccccatttagacatgataagtaaggtaggagcaatgaaggcaaagctggaaccaagataagcaggaattccaccccgggtaatataggtgtaaagcaatgttccaataccgttcattaataaagcaattgctggatcaattttaaacaggagcggtactaaaaccgtcgccccaaacattgccataagatgttggaaactaagcggcaacgtttccaacagaggtagcttttcttctacctggattattcgtcttgccatcttttcaccctttccaaaaaaattaattttttttattctatcatactacttaaaattgtaacaataatcgccaaaattttcaggtttcaagttaaaagttctaaataaacctcaagacttcctccgcagatcatcccctcttctcccgctaaaaagtctgttaattggctttttaccaaagcatactttttttgcggattatcaaaaagagttagggcttccctttttacttccgcttccacgcacccgcccccgatggagccgatggtagtaccatctcgcaaaaccaacatgcgggctccgggttttcttggagttgaaccatgggttgcaattatcgtggccaacaccccgggttgttcctcaaggattttatttatttcccgtaaaaactcataattcaaggtctccatatcaaacctccgagagtttacgatgttttggagttttatggtaataaactgcctgtatttcagcaatgatagccaaggctacttcagccggttcctttcctccaagatctaagccaataggagcgtaaatcttttttaaatcttcctcagtaaagcctttttcttttaaagctttaaacacagcttttactttagtcctgctaccaatcattccaagataggccaggttataaggtaaaaactgctccacgcaggtaaggtcatgctggtgcccccgggtaactactaccactgctaaattttccgcaggtttaacatgttctaaaacccgttcaaaactatcgcatacgtactcatcggcccccggaatattttgccttgtggcaaaggttggacggtcatcgtaaagggtgatatgaaagcccagttcccgggcaaaagtaaccaaaggtcgagctacatgacctgctccaaggacaagaagctttctttgcggaataataggttcaacaaaaatttgttccttcgttaaatataccggttcgttaattcctccagtgtaatattttttaagctccaacgctttatcggaagtggcaaaaagaagttctccgttttcagctaaaagaagcttatcttcggaaaataaacgggagatcagaaaacattttttccctttagctaaattttctgctattactttaaacaacatagtaactcctcttttgtgaacttttataatttagagttctttacctaatatattaaaccatcggcacattctgaaaaagatacttttttataaacaataagtttttaaattatcaaacatttacaaagggtttattatgttttaagatgaatttatggtgacaattacggcttgtgattcactaaaagggggagaaggaaatgggtcaatcgctaattgcccttaccatctttttggggacctatgccttaattatttccgaaaagcttcaccgggccattgccgcacttttaggcggtactttattaattattcttggaattgtctctcaagaaaaagcaatccaccacatcgactggaataccctgggtctcttaattggcatgatgattattgtcggcattaccaaaaaaacaggagtctttcagtacctggcggtaaaagcggttaaatgggccaaaggggagccagtttatattttaatagctctggctaccgttaccgcctttttatcggcatttttagataacgttacaacagttttactgattgttccggtaaccttcaatataactgaccggctggggataaatcctattccctttcttatttcccaggtgttagccagtaacatcggcggtaccgccactttaatcggtgacccgcccaacattatgattggcagccaaactcacttggactttttagattttcttaagaatttaactccagtcgtagcaataatccatattgcaactatgtttcttttttatttaatttatcgtaaagattttaatgtgtcagcagaattaaaaaagaagttacttgatttaaatgaaattgacgaaattaaagattttgccctcttaaagaaaagcctttttgtcttaggcctcgtcattcttggctttattttgcacggtacacttggtttagaatcggccaccatcgccttatttggtgcagcgcttttattaaccatcacccgggacgagccggaggaagtgcttttaaccgtggaatggccttccatcttttttttcctgggtttatttatcgtggtaggaggccttgtggaaacgggagttatcgaccgggtagcccgctggagcctggaagccaccaaaggtaatttcactttaaccgggatgttaattctctggctttcggccatagcttcggcatttgtcgataacatcccctttgtggccacgatgattccgttaattcagaagatgggtgctttagccggcatgacaccacaggctttggagccgctgtggtgggccttatctttaggcgcctgcctgggcggcaacggtacgataattggcgcttcagctaacgtgattgtggcgggtttagctgagaaaaacggctatccgatttcgtttatgggttttatgaaaatagcctttcctttaatgctggtttcgatagtgatttccatgggctatcttctcctgttttatttttaaaaccatttaagccgcgcttttgcgcggcttttgtattaaatttgatacttttctttaataaatggtaagataaaaaataaaaagcccggaggtgtctaatgtttattgcaattgctgttttcttagttagttacttatttatcattaccgaaaaaataaaccgaactgccatcgcccttttaggcggaaccgtgattttaattaccggcaccttaacccaggaagaagcaatccactacatcgactggaatactttaggccttctcttaggcatgatgattatcgtcgatctgaccaagcactccggattattcgagtatttagccctaaaagcggttcatctcacccgggccaatcctatagcgcttctaattgttctgggtttaatcaccgcttttttatcggcaattttagataatgtaactacggttttactgattgtgccggtagccttaaccataacccgggcccttaatatttctccttacccgtttttaattaaccaaattttaatgagcaatatcggcggaacggcaacgttaattggggaccctcccaatattatgatcggaagccaaacccatcttggctttattgatttcttaattaaccttagcccggttgttttggtaatacttatagtaacttctactattttttactttttgtttagaaaaagttttgcggtggacgataaattaaaacaaaatcttttagctttagatcctaaagacaaaattaccgattatcttttattaaaaaagagtttaattatcattgcccttacaattttaggttttagtcttcatcaactatttcacttagaatcggctaccgtcgccctttttatggccatggtttttctggcaatttccggtaaggatattgaacacgtccttttaggggtagaatggcccactatctttttctttttagggctttttatcatggttggagctttagaagaaaccggagttatccataaaattgctgtctggggattagaattaaccaagggaaatgtttatttaaccggagtgtttatcctctgggtttcagccatagcttcagcgtttatcgataatattccttttgtcgccaccatgatacctttaatcaaaaccatgggtaatcttgcggctttttccccggaagtaatggaaagcttctggtggtctttagccttaggagcctgtcttggcggtaacggtacgattatcggtgcttcggccaacgttattgttgccggaattgccgaaaaagaaggttatcctataagttatggaaggtattttgtttacggtttccctctgatgctattatcaataataatctccatggtttatctaactttgttttattttatgtaagggagaggttttatgaaagaaaaatataccggttgtcttcttggcttttatttgggggatgccttgggagttactttagaaaatatggaagaaaaagaaattagaaacaaatacggcgtctttcaggacatagccggcggcggcccttttaacctccctcccggagaaggatccgatgaaaccacaattttaactaaaaccgccgaagcaatcttgcaagatccggaaaatccttttccttacttattggaagaactgcaaaaagaaatttccaaacgtcccgaattatacggtattgctaccagaacctccctggaagcttacggcatctttggtgctgatttggaaaaaattgaaaattatttaattagcaaactgggagaaaggctttgtggaaacggcagtttacctcgtataatacctacagcccttttttatggtgacgatgaaatttaccggcaatatgctttaatcctgtcaagacttacccatccccatcctgtgaccgattatctggcagttttttgcggcttttttctaaaagagcttttacaaactaaaaaccgtttaaaagcatatgaagaagccctaaaaaaatcagacttttatctaaaaagagaaactctggctcaagccagagcttcccgggagagattataccgtttatcatatctaaacgcctgtgacttaaaaaccgggggttttgtcacagataccgtcgaagcagcggtctacattttccttgccgaagataatcccctggacataatcgttaaatccgccaacttaggcggcgatgccgacagtcgtgccgcccttgccggtgccctggccggtatttattacggccgggcgaaactcccggaagagttattaaaaaagcttacccaaccttctcatcttgaacagttaggggaactcctttgggtaaaaaaatggtaaaggtcgtacccgcgcccggagtactatcgactaaaatactgcccccattttcctgaattaatttctggcagatggcaagtcctataccgttgccatcctttttagaggtaaagaagaggttgaaaatttgatttaagtactgaggtgggatacctattccggtatcttgcacctcaatttttattttatccccgtactccgcggctttaatttttatttcccctttatcttggatagcatcaattgcatttagtaaaaggttcataaaaacatgccttaactgcatgggatcagcataaaccgcaaaacccaagttttctttaaatactgttatttgtttggcaataaactgcggttctaataaattcaataaaggagcaattacttcttctaaaacaactatctcttttttcgagttttgcgggcgcgcgtaattaagtaaatcattaattaatttttgtacgttgtccaattcattttttaatatattaataacttcttcccggaaagcagggtcatttgccttaagcggcaacagctctaaatagctttttaccgtaaaaagaggattttttatttcgtgaacaaaacccgctaccagctgaccaacggttattaatttatcccggttgatcattaactcaaggctctttttttcttcggtcacatctctaaagttaattaataccgccctaattgaaggaatgcttataaagtttatgcttaaaaattttgtctgtccctctacaaccacccgatattcattaagggaacaggtctgtccccggtaggctcgctccaaaaaaggctcaggaaaataatctttaagcggtgtaaaagaaaaatgttttccttccagctgtttatcggtaattcctaaaatccttaaggcgctgttgtttattctttttattatacgattttcatccaaagttataataccgtttaattcatgttctaacattttgtccattaaatctttttgagcggccagctcacggtaagctaaatttaactcgtaggtagccctttctactttttgctgtaaaagacggtttaaccataaaataaacagcaggattgtggtaaaaataaatattcccacgataacataagtacgaatccggttaaaatataatcttttctcgtaaggagattccccaaaccacttggttttaagactatcaagctctccggtagtttttaatttaacgatagctccatttaacttttttaatagctcctggttttgcccttttttaacccccaaaccgtacctggtaatcgaaaggggtatacccacaactttgattttattttcgagatttagtttttgcagccagtaaagacctgtataataatttccaattacagcatcaacttcattctgtccgagggctttaagagcttgttgctggttttcaaaatactccagagtaatatccggataatcacctataaagtctaaagcgacatccgccctttggacacccaccttcaggttccgtaaatcgtcaaagctttttaccacatagttatcgcttctaacaaaaattacctgacggttttccagatacgcctcggtaaagtcatacaacttggcccgggttcgggtataatttacccccaaaaggacatcggccttaccatcttcaaccattttccgggcttcagcccagggtaaaagcttaatttctatgtcaattcctgccttgcgggcaactgcaacaattaaatcaacatcaaaccccgcaggattattgttaccatcaagatagcataaagggggataatcgttatcaccaacaacgataaccttctctcgagctaatgccgggttagctgctaatactaaaaaagatgcgataaatagtataataccaaaaatcaccctaacgccttttttcgacaaaattcccacctcaagcgagtaatattcgacaaaagttgtaacaattccttttaatcttaaataaaaaaaaataactataaaggatttttttataaaaaagcgaataacaaagtagggggaatatttcgaatttttacaactttaaggagggggtttgatgaaacctcaagacttaactaaagagcaggccttaaagcttttagaggattttgccaagagatggctagctcacgatggcctttggtttttggagatggaaaaaaattttggtctggaaaaagccatcgagctcgatgaagctgcctgggcccagtttacagtcatcgaggccaaacgaattaaagattttttaaaacttccgcaaaacggaggccttgcagctttagaagttgcccttcgttttcgtctgtatggctttttaaaccagcaggaaatctccagagaaggcaacaaattaatttacaagatgaaaacctgtcgggtccaggagcacgcaagcgtaaaaatcttccagactttccctgtaagccggtggggataaccgaatattccgggtttgctcaaaccattgattcccggattaaaacccggtgcctggcctgcccgccggacgagcatccagacgatttttactgcgcctgggaattttgggttgaagattaatttttttggcctttatttttgttgccagtaatcatttttacgtaagtttcataccagaataaaccctttaataaatcttttttcataacattatcacctccgttttaatattttaataatggaaaagattaattcaagacttcatccggtatttttacatttctctaacatacttaatataaactttacaagagatatgcaaatttcttgcaaaagaaaaccgggcctttctgtgcccggttattcttctcttattcccacttctcccaggtgtcttgccagcaccgagtaatttaaagtacctgcaaatttaaatacatcgtcaaagtacaccaggggcaaagggtattctctcattttttcctttacttcttgaggtaattctccttcaacgtctacaaactggatgcttactctgccaccgaagcggcgttccaggcttggctttaaaaactttaccaactcttcctgagttggaagcgttcctcaactgtagcactcccgtttccgtgttccgtaaacaataattttcatatttactcactccccgcaaaatcccttccaagagataagagcctaatattgaacaagcgagattacctttttcccggtaagttttttccgcccttcgagagctaaaagttcaattacaaacaaaagggcttctaccttggctcctaatcgttcacaaagctccacggtagctttcatcgtaccgccggtagctaagacgtcatcaacaattaccactcgatcccccggttttaacgcatcggtatgaatttccagagtattgtttccgtactccaaatcataggaaacactaatactttcccggggcaactttccttccttgcgcaccggtacaaaaccaagtcccagcttataagctaaaggagccccaaacataaatccccgggactcaatcgctaccacgtgggtaggccttaaatctactaccttttcggccaataattctacggttcggcgaaaagtttcgggattttgcagcaatggagtaatatcccgaaagataatccccggacttggaaaatccggaatatcataaatgtattttttcaggtccatactttacctccgtcaaagttaaattaaagtaatacctcttgtatattaggatatctttagttgttttacaagatagttttcgccttttttaaataaaaaccaatgtatacattttcacaatttttgcaaataaaaaaggattttaccatcttatgtagaaatactcaatataaagtacaagcgggaggataattatgttaaataatcctatacctgcctatattagagttaacaatcttaaaaaccctctgcaaaaggtaaccgaatttcatcagctactggcaaaatttaaagaccccgatgacatcttaagggaagtatgtttttaccttaaagatttatggcaggccttaggatgtaatattgtcatccccaaaaaccccaaatatgaatttgaactaaagtcccattattcatctgccgctaaaccacttccggaaaacatcaatgaaaaccaggggctcagtatttatgtttttaaggaaaaacaccctgttttaataaacgataccaccacttctccccttaccaacaaagaaatagttaactactacggtcacaaaagtgctattgcagctcctatggtcggaaagtctaaaactttgggtgtaattatagtatttcataaagaaaaagagttttttaccattgaagacttagaacttttgacattttttgcaaatcatacggcttacgtcatagaaaatctacagctcttataccggctggaaaaaggtatatatcaagatttcttaaccggcgtttataattaccgttacctgcaggaatgccttttaaaaatagccgaagaccaaacaaagcttccactttctgttatcatgatcgacctggacaattttaaaaagtttaatgacatgtttggccacagagccggtgaccaaatcattaaaaccaccgcaaaaatcataaaaagttccgtacgcaaaaacgaccttgtttttcgctacggtggtgatgagtttgccgttttacttccagcaactgactaccaaactgctttaaacgtagcccaaagaatatcagaaaaaatcaaacaatatacttatgttattgagaaaaatcgttttcgcggttttattagagcctcggtaggagcttcaactttagggattgctccgaccccgcaaatggttttggatcttgccgataaagccatgtaccagattaaaagaagccgctttaacattttaaaccacattgctatagaagaagaaatactttccgattttaaccaggcggaaaaaaccttatttaaaacgttaaaagttttattatccttaattgactttaaagaccactatactttagaacattcccgtcaggtaagcatcttgtcttaccatgtggccaaaaacttaaaccttgaccaggaaagcctcaaaattatttatttagcaggacttttacacgatgtgggtaaaatctggattgatgaagcaattatcaataaaccgggacctctaaaccttttagaatcaggtgcaattaaaaaacatccagttatcggcgccgaaatattaaagcccatatcttttttaaaacctttgattccaataatttaccaccaccatgaaaaatacgatggcagcggttatcccgacggtctttcgggaaaaaatatccctttacttgcgcggataattactttggccgatagctttgacgccatgacctcaacccgcccttaccgtgaacctttaaatttcaaagaagccatccttgaaataaaaaaatgcagtggcagccactttgaccccgacttgctggatgtctttataaaaaccttatgccagctaaaaagcgaaactacggagatttttagctaatcggtttttaaataccccttttttgacgtatccaaaaccaagagctacaccttcatcgcagattaaataccagccttccgaccacggtaccgaaaagctttcaccttttataaatgcttgaagcagctccccgggcaattccagagcacgagtaaattttttactcaacaaactaaaagctaaagcctgagatggtacaaagcgtcccttttttatttcgccaagttctctgccggcacaaaccacctttagaccggttatatccggcaaattttgcggcaagagaagtaatttttctcctttaaaggccacttccggctcgggtacagtaaaatattcctgccaaaacttactaaactcttccatatttatctttttcctttttggtttacctttcttgggtaaatgcgatttttttccgtcatcacacaatttaaccattcgtgcagcaaaatgtccttcccccttttgttgaaagggccagattctaaaggttttctgtaactccaggttactttcggcccactccggtacacccggcgaaacccctttgatttcaatgctttccagtgcaaagttggggttctgttttaaaaaccaagccaccactctttcgttttcttcgggattaaaggtacaggttgaataaaccattacccctccttcttttaagagttttgctgcagtggttaataactttttctggcgcacgctgcaccccagaacatgctcaatggaccattcatcgatagctttgggattttttctaaacatcccttcaccggagcacggagcatccactaaaatccgatcaaaataagcttcaaacttttcttcaagatttggcggactttcatttagaactaaaaaattttcatagccccaccgttccaaattttccgttagcactttagcccgggaagaatttacttcattggcaactaaaattccttccccttttaatttgcttaggatttgcgtcgatttacccccgggagcagcagccaaatccagtaccttatctcccggctttggatccaaaacttccaccggcagcattgccgaaggctcttgtaaataaaatgcccccgcccagtgccagggatcttttcctaaaaacatatcttcagaaagataataaccttccgggcaccagggaaccgtttctaaatatccatagcgtctgtataaatcctcttggctaattttttctggattaattcttaaaccgcgaaaaggaggagcattaattacttcttttaatttttccgctgcagttcctaaaaaagtctggtacttttcccaaaatccttccaatggccccagcctccacaaaactctgttacatattcaaaataacacaaaaatttatccttgccaaaatcttaatttaaggtataatataaacagaatgttctttctgtgggggtgcggatttggcaaaaaaaactcctgagacagagataaaacaaaaaatttacctgtcagcccgtaaactctttgttgaaaaaggttaccaccggaccagtatcccggatattgtcaaagatgccggggtaagtattggggcaatttatcaccacttctcttctaaagaggaattggcccgcgtcattcacgaagatgcggtggaaagtttcttaagccggtaccagttacaggttgaaacaaaggccaccgcaaaagaaaaagttcgtggttttgtagaaatgatgtttaactgggccgatgaagatttaattaccgttaactaccttttacacgcccgtcccaaagaaattttagattgcaactttactatttgcactgctgaaggcttggaagccgtgaaaaaaatcgttgagtttggccaaaaggaaggtacttttaaagatactgacccgatacttttagctgcttttatttccggccctgtcatgcgtataatagaattaaaaactgacggtattatcacccagcctttatccagtatcatcgataccactgtccagctaatatttgatgccttaaaaaagtaattttattttttaaatgcaacagaaagaatattcttttttatataaatattagtgaaagaatattctttcttttaaggaggtgaaacggtgtaaagggacttttgttcttataattttttgttacaagtttctcaaaataatttttgcaggaggttttaaaaatggaaaaattaaaggaaatttttcaggaacgttttcgggataattacctcgaaagaattctttacagccatgacatgggagttatcccgagtgccgttaaaaagacttttaactccctgcccgatgctgtagttcagcctgtaaacaaagatgaaattaaacagttagtaatgtatgcgcaaacggcaaaaattcctattgttccccggggcgctgctaccgctgggttcggaggagccgttcccaccaaaggtggaattgtggtagattttatcaggatgaaaaaggttatttcctttaacccggaaaagcaaaccgtcaccgttgagccagggcttgtctggcaggagttggatgagtatctaaaccgttacggttacacgttacggctctatcctaccagctatcccggttccaccgttggcggctgggttgcccagggcggcacgggtatcggtagttatatgtttggaagttttttagaaaatatcgtagaggttaaggctattctcggggatggaacggaaaaaacctttgcgggggaagagctaaaattaatttacggtttagaaggtatcaccggcttgatttacgaagttacgataaaaattatgcccaaaaaggaagaagtacccgtactggcagcttttccagagcttgaaagtttaagtgcattaatggatagtttagaaaaagaaaatcttcccctgtggtccgtaaatttaatgtccccggaatttgtaaaacttcagcaaaaagcccaaaatcactatattcttcctgaagataaatattttcttaattttgtcctgctatctccaacccagaaagatttagatagccttgcggaaaccttaaaccggtttggcggacaaataatgccctccgctatagctcaagaggaatggaacaaccgtttttacccgatgcgtttaaaacgtcttggcccgtcaattgtagcttccgaagttctattgccaaaaaatcaagcctggcgctttttaaccgaaacaaaaaataagtttaaaggcgaatttgcttttgaaggcacttttgccgccaaagaccaaattacctttttgggatttcttttagcggacgaacgaaaactcaatttccccctgctttacgctaattccttagttgtaaatgacatggccttgaagatgcagggccggatttttgcccttggcatgtattttaccgattatgcggaagagtttttaggtaaggatttagtgacaaaaattttaagttttaaacaaaaaaccgaccagagcggtattttaaaccctggtaagattcttccaccatctctggataagaactctcccttaaaagccttaaacgccgcaatgaagagtgctaatttcagtaaatcccttttaggcggtctcggtaaactattaggcggcagcaaggaagataatggcaacggtaaagccataaaggggctaccggcagaaatggtggaagaaagttatatttgcgcccagtgcggtttctgccgaaccaattgtaccgtctttatgcccgatccctgggaatcgaactctcccagaggtaaatggtatttattaaaccagtacgccaaaggggaaattgaactaagcgaagaattagttagctcgttagtactgtgtactacctgtaaaaaatgcaacgtagtatgtcaaaccaatttacctaacgccgaacgctggattggcctaagaccgatagttaacgagaagggatatattatcaccggtttggatttagttaaagataacgtagtaaataccggaaacttctggggagtaccaaaagaggctaaaaactggatgcttccggatattgaatatgtggaagaaggcgaaatcgcctactggccgggctgctgggcaagtatcataatgaaaaatatgccgcaaaacatcgctcggatcatgaataaggccggcataccttttgtgtacctgggagaagcagaaggatgctgtggtctatatcatgttctcggcggttaccaagaagagtttgccgaaaaagtccgggaaaactacaaaaactttaaagcccgtggcattaaaaagttaattctctcctgtcccggctgttttgctacctttaccgaaaactacccggagatggcccaccatctggggattaactgggatattgaaaccgaacatgtcaccgtatttttaaaccggcttatcgctgaaggaaaactcaaattcactcagcctctaaatgttaaagtaacttaccacgattcctgccatgtcggacggtggtttaacatttacgatgaaccacgaaatgttttaaaagcgttaccgggagtagagttagtggaaatgcagcacaaccgggaaaaaggcctctgctgcggactggtagcatcgtttcactccatgccgaccgttgcttattcagggcaaaagcggattcaggaggcggaagaaacccaggcagattatatcgttaccaactgtgccggctgcggttcacagatgaattatacttctaacgccttaaatgcgaaagtaaggcaaaaagatatcaccgatttagttgctatggctcttggaataaatgacatttttgaccctaccgaaccaattaaaaattacatggaagctgccgttaaactcttagctccctcctgcgtaatgcttaaaaaatagcaaaaaaaacggttctgtcagccccagaaaatggtggttgacagaaccgtccctaaaattacgctttggccaggacatagcgcggtatttttaaaagtaaagcaagcagtaccgctccgcctaaaagggcagcagaaattttataggctatcagataattccccgtcaggtctaccactttaccggctaaaagcgggcccaaaacccctccaatgccccaagcggtaaaaaccaagccataatttactccgagattttttgttccataataatctgccgtagcggaagggaaaaggcttaataaagcaccataagctaaaccggcaattgccgtaccaatagccatactgccgatggtatgataagttccaaagagaagcatattaacaccgccaaccaggaaaactaaaagcattgtgttgaccctgccaattctatcggaagccattcccgccaatattctgccggaggcattaaaaattgccagcaaagcaaccagccaaaagcctttttcccagttggcctgctctttggcaatggttgtaatatgcccgattatcatgagacccgctgatgcagaaaaagcaaacatcaaccacaaaagataaaaacggtaagtttttaacatctcctgccaggtaaaatccacattaatttttaaagtttcactggttactcctgtcgcccggtaacctgcgggagggtcggttaacaattgagccaggataacggtaattaccaaaaaaatcattcctaaataaataaaagttctctctaagccaaagtgatttaaaaaccaagtggtaaggggcgaaatatacactgaagccaagccaaatccgcttactactattccggtaattaatcctttcttctcggggccgaaccattttaccgctgccggagttgccgccgcatagccaagcccaattcccgtccctgccagaattccaaaagaaataattaaacccgttaaggacggtattaatcctcccaaaatcattccgctacctattaatattccccccaccgttgccaccttgcgcgggcctatctggtcctgaagccggccggcaaataccatgataatcgcaaaaaccgcacaagctacggtatagggaactgccgcctgggtattgctccatccctgggcaactaacgctttttttattacgctccaactgtacaaaaccccaagcatcaagttaatcccggtaccagcagccgtaaccaaaatacccttattcacctttcccacctctcttaaataagtatttttttaattcccctaccctcctttcccaattacttacacttagattataggtaccgtaacccccagcaacaataaatcttattttaaaagctacattttgaggttaagttaccaaaattttcgggtcaatcgctggaattttacaaaaacagcaattcagacatttatatgtgcagttcaagaaaaaaccccgcctctttggctttagcctaaagaggcggggccgttatcctggcagcagtatccggccctcacgcgggataccgcgccaaagttttaacccttacatttcggcaccaaggccggtattggctcgaactgccagttcggcaaatttttcttccgccactttttccactttaagatagcttcccaagattgcccctaaaaagcccagcggtacactgacaattccgggattttttaaggggaaaattgcttctttccccatcacatccgggccaatcattacaagccctaccgaggcaatcaaacctgttagaataccggtcaccactccggcagtattaaaccgcttccagaacatcgataaaacaataaccggtaagtttgcgctggaagctacggcaaaagccaaagctaccaggtgagcaacgttcatgcctttggctaaaattccaattaagatggatagtattccaaccgttagtgccgttagtcttgcaaccttcacctgctcggcttcactggcttttcctccccgcaatacgttggtataaaagtcatgggcaaaagccgaggaagcagaaatggtaaggccggcaactaccgctaaaatggttgcaaaagctactgctgcgataaaggctaagaaaaactctcctccaacagttcctggaccaccgccaatatactgggctaaaaggggagccgccatattaccgcctttatcaaagctttttaccacatcctgccctacaaaataagcagctccaaaaccgagaaaggtagtcattatataaaaagcgccaattatcaccattgcccagaccacggattttctggcttccttagcattgggcacggtgtaaaatctaaccagaatgtggggaagaccggcagtaccgaagattagggcaatccccagggatatttgatccagcggatttttgtacaaattccccggctctaaaaagctctgaccgtatttttgcgaaactgcccccataaatttaaccaggctaaagtcaaaatgggctaatacggcaatcgatagtacaatcgtaccggtcatcaaaagaacggccttaataatttgcacccaggtggttgccagcatcccgccgaacaccacgtataaaatcatcagtaaacctacaacaataattgccgtttcgtatttccaacccagcagaagctttatcaagttacccgaacccaccatctgggcaatcatataaaaaaggctaacggtaatggtgcttaatgccgctaccgaccgaacggttttgttattcatccggtaggctaaaacatccgccatggtatatttacctgaattccgtaaaggttccgctaccaccagcaaaaccgtaagatacgccaccagccaacccaccgaatacataaagccatcataaccataaagacaaattagtccggcaattcccaagaacgatgcagcactcatataatcgccagctaccgcaataccattttgccacccggtaatcgatcgcccggcagcgtaaaattccgacgtagttttagttcttttcgctgcccagtaagttatgataagggtaataagaacaataatggaaaacagggtaaacgccaaattaatcttcatccctacgtccctcctttaacttccttaataatttcctcggccagggggtcaaacactttgttagccttttgcacatatagataagctaaaatccaggccatgaagaactgggataaggcaaataaatacgccagattaatactgccaattacctgccgcttcataattccgggaaaataacccaccgaaatcggcagtaagaaatagtaaattaggaaaaagatgaccccctttacaataaaacttttcttttcggctatgagtttctggtattttgggttctcgtcgatatgggatagtttttcctttaaaagctgctgctctcttaaatgttccataaaacctcctcctttccgggcttacgcccacgtttttaatattaaagtattatttttttaattttctgacaattgtctctccttaaacggttttatttttagagccaactgcctaatttcccctctttagttaaaacgaaaaaataagaaaaacgaaaagtgcatttaaaacggcttttttggcggttcgggggaattttagtgacagtaaatccaaaaagttattatatttaaaaaaaaatcccctggaaggagggaatttatttgccacaaactctatcccatatctatcctttttctttgctaccggaaaatcttttagaagaattaagtaatagccttacctcccgtaactaccagccgggcgaatatatcttcagggaaaaagaaccggcaagaaacggcctttttcttgtctttaacggcattttagaaattgtggtaaccagcgaacgcggtcaggacctggtaatcgctctgcgccgtccgggtgagttttttggcgagacggtactttttagcggtgaaccttacccggcaggtattcgggccgcaacggaagccttaattgggtttatcccgaaaaatatttttatggagattttaaacaaaaatctcccttttaccgccgcctttaacaaaattcttaccgaccgtctgcgggatttatatttagaaatatcccgggaaagtcaaacggactcctattcccctttaaacattattaaaaaagcttcccaacttatgaatcctgaagtggtaaaggcaacccccggtgagtcgattaaaactatagctaacctcatggcccagcaccaggtaagctcggtagttatcgttgacaattacaatcgccctttgggaattatcaccgaacacgaccttgtaagaaaagttttggccgaaagtaaaactcctaccgactctttaatagccttggacattatgaacaaaaatccggcaaccataagcccggatgcttactactcccagattctattagaaatgattaaaaaacaagtacgccacctcttggtaaccgaaaatgaaacccttttaggtatcattaccttaaaagaccttttaaagagccgggaaaccggcaccattaccatcgttaattctttggagaccgccagtagcccaaaagaaattaaacagggattgaaagatgccgaaggggtattaaccgctctcgtttcggaaaaagccggaattgccgaaatttataaaattatgaccgaatttttcgaccgggcgtaccgaaaagcggtagaactcgctcttaccgaaatggaaaaagagtcgggtcctcctccagccgatttttgctttattaacatgggcagtgccggtcgggaagaacaatatttacgcaccgacctggataacggtcttatctgggataatcctcaggaggagcccaaaatagttcaggattactttttaaaacttggccaaaaaatcaataacctgttaatagaagtgggtttcagtccctgtaaaggcggggttatggccagtaatcctttttggaacggacaaatagttcactgggaacaaaaacttttggactggtttttaaacttaaccggagaaaatattcgccttttttcaatctttctcgattttcgcccggtttacggtaattttaatttagccgaaaaattaaaggagcaggttttagaacagctttcccaaactccaatagtgtttttccatttagcccgggatgagtatttaaataaagtaccgcttaacgtctggcactcgtttattacccccagatccggtccacgcaaagatatgcttgatttaaaaaggcaagggacaatccattttgtcgatgccatccgcctatttgccttacgggaaaaatactattcctccagcgccactttaacccgtttaaaatttttagaaacaaaacagattttttcccaggaagaaattgaaaatttccagtttgcctttgaaaccatttccttatttagaatcaaagaaaatttaagcaaaattaaagtaaatcttacccccacaaatcttattaacccttaccatttaccccgcaaagaccaaatgcttttaaaagaagctttaatttacgcccagaaactccagcaacttaccgccaccgccttccgggtaaccgccttttagggaggaatctcatcatgataaaatctttaaaaaaatttttagaacaaaataaaaacccgcttcgcactaaaattgaaacgataaatgccttttatccttacgacattccgcttttaaatttaacctatacggtaattgacctggaaaccaccggcttaaaaccctttcagggggacgaaattatcgcgattggtgcggtaaaaattattaacggcaacatcacccgtccagcctttcatgcttatgtcaacccccagcgggaaataccagaagtagtccaaagattaaccggaattagtccaaaaacggtgcaaaacgctcctccccttactaataccctgacaactttattagattttgccagaaactcggttatcgttgggcattcggtaaattttgacctggcttttttaaataaacatctaagttccttaaccggaaaaaaactaaccccccgtctcctggataccgtggatttaggaatatatctcttcccccgggagccaaactattctttagaaaattttgcccaaaaatttgccataagcctccagggaagacacacagccctgggagatgcggtaatttgcgctaaagtttttctgaattttttaaaaatacttgagttaaaaaatataaatacttggtggcaactttcacaagagatatataaagtcctataatatttgacacttctcgccttttctctctgaaatttttcacttttcgcctcctcccgaaccatattgacagcgaaatttttttgcagtatatttaaattagcttactaaagggaggaaggagtaatggtggcggaaaaaagaagtttttcacaagctgagcaggccgaactccagcgtaagtttggtgcgcgggtaaactttaattacaatgagcgaattttatacgatcacgatgttggtgccttaccaagcctaattaagccattggtaggtaacaccacccccgctggtatagtccagccggaaaacgaagaagagttaatctggcttttccagtgggcaagaaataagaaagttccccttacgccaagggcttccgcttcttccggttacggtggagttttaccggttttaggcggtttggttattgacttatcccgttttaataaaattatcgcccatgatgaaaaagcccaaacggtaaccgtccagggcggtgtggtgtggaaagatttagaatattatttaagtttttatggtcttgccccaagaatggttcctaccagtgctccggcttcaacagttggtggttgggtagctcaggaaggttccggtatcggcagttacaagtacggctggtttaaagaaaatgtggttagcgtcagagttgttttagccaacggcgaagtccgcaccttttccggaaaagatttagatttaatttttggtaccatgggaactctcggggttattaccgaagttactttaaaggtaaaacctcttaaagatacccatgtaattgccgcaaactttaaatcggcaaaagatttacaaaattttattattgatctaggaaaaagcggccttgacatctggcatgttggttttatcaatccaacggctgccgaattaaaaaaccagttacctcccaaggtacaccacgggcacgaagaaaaaggtccaactttgcctaaaggttttattaccatcgttgcttttgaagatagcaacatagccggtaaaatagaaagtttagctgcaaaaaatggtggagaaatattaccggcggaaataaccaagcacgaatgggaacagcgttataaccccatgaaagttaaacgaattggtccttcgttagtgccggcagaagtcgtgattcccaagaatcgcttaagtgaagtatttagtgagtttgaacgcttgatttctcttcctttagtcgtcgaaggtacggttgtaggcgatagtgaaattgtccttttaggctttatcccgcacgatgaacggaagttttctttcaactttgcctatagcctatctcttaccgtcttaaaaactgcgaaaaagtttggcggcaggagctacgccgcagggctttatttagctaatgaagctccagcggtatatggcgaaaggttacaaaaaattaaagaactaaaagctaaagtggaccccgacggtttatttaaccccttgaagcttgaaggaaaaggcatcattaatacgattatgtccctggccaatacttttgaaggggtagcccggtggtttggcaataaagcaaaacccgatttaggagaaaaattcgaagcgaaaaacggaatccccggaaacgtcgcctggtatgcttatgcctgtgcccagtgcggttactgccgcaacgtatgtactctatatgacggccggggttgggaatcagcaagcccccggggtaaatggtcgtttattcgcaaggtaattgaaggtaaagccaagtttgaccaaaaaatggttgatactttcctgctctgtactacctgcgagaagtgtgactttgtttgtcagttagatttacccattgaaccgtcctggggagtcctgcggggcgaccttgtaatggaaaaaggttatatgaccttcccggcctttgaaatgatggctgccagtttgcaaaaagacatcaacatctgggcgggctttcgggaagaccgggataaatgggttcccgaagacttaagaggcaaaattaaagacaaagctgaaatcgcttattttgccggttgcactgcaagttacgtagaaaacgacattgccattgcttctgcacggcttttagatgcggcaggcattgagtttacctaccttggcaaagatgaagcttgctgcggtatacccatgttagtttccgggcgctgggatgtattccaggaaattgttaagcacaacattactgaagctaaaaaacggggtgtaaaaacggttgtaacttcctgccccgcctgctggttatcgtggcatgacctttaccccgaatgggcgaaaaaactcggtcttgaatacgatattgaagccaagcattattcacaagtgttagaagaaaaaattaaatccggcgagcttaaattcacccatgaagtcaacgcccgggttactttccacgactcgtgccatatcggtcgggcgggaggagtttacgaaccacctcgggagcttattaaagcgatacccggtgtagagttcgtggaaatggaacataaccgggaaaatgccctctgctgcggtagcgtgttaacccggattggcgaatcccacccaacttccgataaattaggtggaaagcgggtaaacgaagccgttaaagttaacgctgatatgcttatagcactctgtccttgctgccagtttcagttaagggtagctgccgataaaaacaacatcgatatgccggtagtcgacttagctgcctttgctgccaagggtttgggaattgagttaccaaaccccactccttacgcattagagttgtgggccgtatttgaaaagatgattgctttaatgactccggaaggctttgctcaagttatgaaagctctcttcccgcaaatgtttaaagcgatgcctggctacatggtaacaatgatgaaagttatgcgggtaatccccggcgggctttccttaatgaagccaatgatgcctaagatgatgccgatgttgatgccaatggtaatgcccaaggtgcttccggatatgctaagagaggtggaaaaacggattccgatgcccgattacatgaagcggcaaatgcccaacctgatgcccgtagttatggatcggttgatgcccaaaatgctgccggatgtagcaaaacttgttaccgatgaaatgatttcgtatattaagaccagcttgtaattgccggctctggtagttaaaaagccctgcagttttcctgcagggcttttttgttaaggtgtttccacgcttctgggctttatttgagaaatttggcggtctttagtatttaggtctttttcacccacctcgtctaaataacttaataacaacgctttaaattcccttttgaatttttcgtattcctggtttaatctttcgtattcttccataattttttgcacttctaacttagcttgacttatcatttctcctttttgattttgcgccgttttaagaataatttccgcttcttttttagcgttttcgattatttctcctgcagttttttccgccacaattaaagcttgatttattctgtcttctaaaagcttaaagtttgctaattgctgttctttagcctcaagtaactcttttaaccgttgattctcggcaagaagtttttctaaatcctgggctaccatttctaaaatattatccactgcttccggctcgtacccccgaaaaacccttttaaattcttttgccctgatctccaccggcagctgcatttataaccctcccaaaatttaaaggtatcgtcttaatattaccttattgcgcccgcttttactaactcctgcaatttcaagaacttccaccctgccccgtcctcttaaagagattacatcgcccggagcaacctcatacgaaggtttaacctgcaatttccagttaacccttactttttgtccttcgatttccttcaccatctggcttcgggaaattccaaatccgctggctcctacactatcaagtcttaaggatttcacaaaagcgacaacttcccgggttttggcttcgggtaacaaaagctcttcccgaacgatttccttaacagtaacacctacccggtggactttgtctaactgttgaattaaatatggtaccaaatcccggtctaccaccacctggcaaccattgggaataagaattaaatcaccaaccttctccctttttatccccgtgcccaggatcgctcccaaaaaatcccggtgagttaccgcttgaaatttaaagttccccgttatttctataaatccaagattaagctctacatcttcaggaaaaacatagatggggtaaaaggcaaaacgcactttttccgcattgggataaccgccatctactttataatttacttcaggatagtttcttaataagtccctggtaagagaagctgcagccggatcaagaaagtcggtcaatacaatctgccctttggcagctcgggaaagcaggtcctcaatttcggcttgattaaaatccatgctatcaccccagcattaacagtaactgtaaaactgccattctcattacttcaagaacaaaaaacgccacaattggagaaaaatcaatcatacctaccggtggaataagccgccgaaaaagatttaaataagggtcggttagcgaggtaataaaattaaccactggatgataggtattaaccggaatccaggtaagtaaaacgcggataataataagccagccataaatattaaaggctaagttaacaaaatccgttaaaaaattcatgttccacctctatttaagtaagatttttggcccgttcgtaagcactttctaagcagtcagcaaacatgcctcgaatcccctgtttttccaattggtataaacccgccgccgtggtcccaccgggggttactaccgcatcccggagaattcccggatgttcctgagtttctttgagcattgctcctgcccctatcaaagtctggacaaccgcgctccttgccacatcccgtggaagacccaagcggaccgctccatcaattaatgcttccgctactaaataaatataagcaggtccacttcccgctaaggctgtaatctgatcaaaatatttctcttcgagaaacaccacttctcctaaagaatcaaaaatttccgctaataaagcatttgctttggatggcgtaatcgctataaaaccctggccaattaaagccggagtattgggcattacccttaccacctcacattcgccaggaaccccccactcggctatttttttcaaggaaaccccggccgccactgaaactaaaattttaccggaaagccccggagagatttcttttatcacactttctaccaggtacggctttaccgcaacaatgaccacatcagcttttttaaccagtagttcattggtaaccggctctgcctgctctaaaaaaggttttaaacactcctgatttttatcggacaggtaaagtttttttatcggagaaggttgttgttttaataagccccgggcaattgccccgcccatttggccaacaccaattattcctacagctggtttcatagttactcctccactttatttaaaagggttaaaaaaggttttatcccgaaactcccgcatttccccctcgattaaaacattttggggagcaaataaataaatctgggggttaattttgtgcaaatgcccacccaaagcataggtagtgcccattaggaaatcaataattctgcggcccaattccccatcaattcgctctaaattcaccaccaccggacttccggattttaaactgtccgcaataccttgcacttcatcaaaactcctgggttcaaaaaccatcatcttgagcatgctcattcccggcaaagcaactaaattagctttccctcttacttttttcgccggttctttttctacgtactcttcttcttcctcttcactaaatcccataaaatttaagactttatccaaaaaacctcctgacataaataccctcccctttaatactttctctccccaaaaagcaaggtacccaggcgaataatattggcaccttcctccaccgccactttatagtcgttagacatgcccatagaaaggtactggaatttatcgttttccgggtctttagccttaagcttcaaaaaaagctcccgcatagcccggaaaaccggtcgcacttcttcgggattttccacgtacggtgctacggtcattaaaccagatacctcaagattcttaaagttttcccgaacttcaaagtaaaaatcctctacttcttccggcattaagccaaattttgtctcctcctttgccatgttaacttctaaaagaaccggaacgttaatccccaatctataagcacgcttatttatttcctctgctaaattgtagcgatccaatgaatgaataagtacaacttttcctaaaattttattaattttgttggtttgcaggtgaccgataaaatgccactctaagttgggaagcttctcatacttttccaaaaactcctgaactttgttctcaccaaaagcctctacacccgctttacttgcctctttaatcctttccacatccaccgttttggtaactcctaatatttttaccttacttcctgggcgtattttcgcaatctcccgcttaacttcctgaagcttttgggatatttccataattgatcctccaccctgaaatattaatgaaacttgtccccgggttggacaagaaagggacggattaaatacttcttccctattaattcgtccttggactccttttctccttctaccaaaacattattttccctgctaagtactacttttacgggagttaaaacgacttcttcattcttaagcgtataaatataagtttttccggcaatttgtttcaccgccgaaaccggaacccaaaaaccgctatactctttggttttaataaataccgaaacctttctctgatttaacagctcatcagggtaaaaattaatggaaaataacgcaacttcgccatttttccggagaaaattagcctttaactcatacttttcattaatattcaggcggtactctcgcccttctactaagttatcgcgtaaagataacttaggtatcaccaagagaatcggatttaaattatcgataatttttcctaaaggctgcccttccacagcatctccttcgactttcctgggttggtagagttccagaattttactggggtttaaagtttcaatattatcggggccaataaactccaaaccatcggtattgggaacaaatattccgtttacctttgctttaaccggaataattttttgactggcattatcctttattttgacaattgtatctccttttctaacctttttccaggcaagaagaagttcaacctttccgttagcttcggcataaacgggaacttcatttttaaaaagaaacccttcggttctaaccccatcttcaaaaactttccactccaaataaccaaccgggttaaagttttgtactaaaagagtttttccaaaatttaaaagaataaacgcaacaaaactgcccattaaaaagtaaataagaacctttttgtttcttttcttttttttcctttttttctttagaaaaacaactttcgcgttattcatttaattcgccccattacaggtttaaatcgaacctttctccggtaaccaggtaaataaccgcctcaccaatattggtagcatagtcggcaatccgttccaaaaaacgggcaacaaataacagtgaagtagcctgagcaatggttttggggtcctccatcatataagtcagcaactccctgaaaacctgcgagtaaagatgatcaacttcatcatctaacgaacacatatattttgctttatccacatcggaacggacataagcatccaacccttcctttaccatttgctgggatattttggccattcgcggaatatcaactaaaggtttaataagcggctgtcctgctatcctcttagttactcgagctatatccaccgcgtggtcgcccattctttccaggttcgttatgatttttatcccggtaattatccgccttaaatcccgggctattggttgttgcgtggctattaaggtgaccaaacgatcttcaatttccgtttctaaatagttaatatcccggtccccgttaattaccctttgagctaaatccacatcttgtttggccagagattcaaccgcatcataaattgccctttccaccatgctacccatccgtaatatttcgttttccaattcatttaacgctttatcaaaattttgccgagctgtcattagctattcctccttttgtaccgtttgagcaataggtatggtaaaaccaaaagcgcttccctctcccaccttgctcttgacccaaacttttccgttgtgcagttcaattatgtgtttaacgatagcaagtccaagtccagtacctcccaattcccgggaacgggccttgtcaacccggtaaaaacgctcaaaaatccgtttttgactttcttcgggaataccaattcccgtatcctttaccacaacctctacccacgaccccttgacggcagctgtaacttctatctttcctccggcaggggtgtattttattgcattatcaataaggttaattaaaacctggctgatcatatcgccatcggccaatactaagggtaaattttccggaagggaaatgataaagcttaattctttttcttccaatcgacttttaaacaaaagcttcattttttggattaattcctgaagcattagcggtttcggagcaaaatccacctttttggcttcaatcttggaaaggcttaacaaatcatcaattaaccgggtcaacctttcggtttcactgttcattatctgaagaaaatgtttggcaatggttttatcttccaacgctccatccaataaagtttccaaaaaacccttaatggaggttagcggcgttcttaattcgtgggaaacattggcaataaattcactccgcattttctctaactttcgttcttcagtaatatcatcaaaaactgccacaagaccaaccttttggtcgtgttcatcttttaacggtgttacgtgaattaagatggtcttggaatttggcagtaaaaattctatttcccgggtcatttcttttaaattggccagagcttcctttaaaaatttttccaattcgtagtttctgattacttccaagagaggcttgggctccccggtaaagtttaacttcccgaagagattttccaaacctttatttactaaaataactctcccgtcccggtccaataccataaccccggctttaattccggctaaaattgccgtaagtcttttttctccttcgttaatagctcttttgcagttttccagctgttcaatcaagtggtttacattatcaacaattttccccagttccttatcattataatagcttaccttggaatactggccctgccgccattttgaggtaaattcttctaataacttaaatttgttattaacttctttaataaatgctccaaaaattatataccccagtgcagcaagaaaaatcccttccaaaattgaaagcaattttccttcaaccagaaaaaggactattaaattaacaagaaacagcagtaacaggccaatttccattctcatttcttttcctcaccgaaccggtaacccactccccgaacggtttcgatgtaaaccggatctgccggattatcttctatcttttgtcgtatatgacgaatatgaacatccaccgtccgggtatctcccaaaaactcgtaaccccatattttctctaaaagatattcccgggtaaatactttaccgggattactggctaaaagctttaaaagctcaaactctttgggagtaaaatccatttttttgcccttaacgtaaaccgcaaatttttcctgatctatgacaatatctttaattttgataattccctctttcttcccctctcttccttccaaacgtctgagtcttgctttaaccctggctaccagttcccggggagaaaagggcttcaccatataatcatcggcccctaactctaagcccaggattttatccacttcctccccgcgggcgcttaacatgatgattggtatttccgctgttttttcattgttcctgatatttttacatacttccaaaccactcattccgggaagcataatatcaaggataactaaatccggaagctctttttttacaatctcaagggctcttataccatcataagcttccaaaactttataaccttcccgctccaggttgaactttattagctccacaattggagcttcatcatccaccactaaaattttcataacctacctccctttttataatcccggcagccatacgcccggttacacccgcatccctgcggtaagaaaaaaataagtcaggattacaggacgtgcaaagatttaaaatctcaatgttttgctgctgaataccagctttaattaatatttcggaatttatctcccagagatttaaaaagtatttcccctctttttttatcactcccttgggatagccccggtcaagaaaactctgggcaacctcatcgcccacttcataacagcacggtccaattgccggcccgataccgcaaataatattttccggttttgcccctaaggaagttaaagtataaaccatttttgccccaatttccgttaacgtaccccgccacccggcatgggctacccctaaaagaaaaggatcaggcgaaaaaaagtacaacggcacgcagtcggcataaaacgttaaaagtccaaggtttttttccctggtaattaagccgtcggtcttttttaccgccgaatccagttgttccataccccgtccgccatcagcatggtctacaagggcaatatttgtaccatgtacctgctccgctgctacaaaattttttaaatctaaatcccaaactgcggctaaaagttcgcggttttttattacagccttttgttcatcacccacgtggagggctaaattaaaactttgataaggtcctgaactttgccccccagagcgcgtggtgaaaaaagcatcaataccaaaatcctggaattttttaaagaaaaaaagctttaagccttttctttcttttaataaaaactccatcaactttctaactccttaactaatttttccactaaatctctggctttctccgttaattgtttagctttcaataaagtaattactttatcgattaatacttcttccgattttccgggtaagtttgcaagtaaagatattgtttcctggtaacggggaaggtaacacggtatccgatatttttcttcaattaatttttttaaatttagccgggcctcgtcttccccgtgaaccaggtaaatttgcgcaggtttttggctaaaccttccgataaacgccagtaactccctctgatcggcatgggccgataaaccatcatagtggtaaacttccgccttaacggcgatctcctcacccataattttaacctcttttgctccatctaacaactttcgacccagggtatcctgagcttgatagccaaccaacaataccgccgactctggccgccataaattatgttttaaatgatggcgtatccggcccgcatcggccatacctgaagcagatataataatagcccggctaatgttattaagctttaccgaatcttcctggcttaccgaaaaatgaaggccaggaaaggcaaggggatcatctccccggttaagtttttctttgtactcttcattaaaaaacatcggatattttttgaaaagcttggtaatttccaccgccaaagggctatcgatgtatacatctattggaggtacttccttattttccactaagtcgtttaaaatataaattaaatcctgggtccgctccatagcaaaagccggaataattaaattgccgtttctcctataaactttttcaattaaagattttaaaagagtttttaaatctccttcctcggaacgaacccggtcaccatacgtactttctaaaactaaaatatcggtcaaaggaactttttgcggttctttcataaaaggcctgccatttcggcctaaatcgccggtaaacaaaatagttctggtagcgtcctgccctttatatgcaatttttatcatagccgaacctaaaatgtgtccggcatcaaaaaaagtaacttctaaaccaggtaagggagtaatgggtgtttccaaaggtattttttgaaaatatgccaaagcattaaatgcatcgtcagcggtataaatcggctgtaattccggcttacctgcccgtcttagttttctgttttttctctccacttccatttcctgcacatgtccgctatcggggagcattaccgccgctaaatccaccgtcggttccgtggcataaatggttcccttaaaacctttttttacaagcttaggaattaacccggaatggtcgatatgggcatgggttaaaagaataaactcgatttcccgtggattaaaaggaaattcgccataatttctttcctttatcgcttttgggccctgaaaaagcccgcaatccaccaaaaacttgtgcccggcaacgttaaataggtagcacgagccggtaactgtatcagcggcaccgaaaaaagttaattccattttactcccccaatcttctttttttctatattactcttgaattttgggagtgtaaagaaaaaaaaagagtaaatttcaacaatttactcccatttcacttcaactatttgcttttgtaaaaaactctttttcaagtcaattaacctctgattcgacgagcctctaaaaggtaaagtaaaagttttaagttccttgataaagggcccatctaccaggtaatcggcagcttttaacaattctaaaatttctggttgatgttgtccaatttgcattaactcctcaaaggtataaccggtataaataaccgtatttttgccaagaacagaagttttttgtaccaaatcaattaagtttttagcctgtaaaaacggctcacccccggaaatggttaaccctgctaagagaggatttttcttgatttgttcaaaaattagttcgctttccaattcatagcccccggaaacatcccaggtttccggattatgacaaccatcacaccggtgagggcaaccctgcgtataaaccaccagacgtaaccccggaccgtccgttacactttccctggtaatacctgctacctttagtttcgccattataacaccccgtggggtctgcggtcgtaaagttcggccagttttgcatcgttaaaacggtctaccgtacttaaataaccggtaatccttctaacccgcctaatctgtccctcaccgcaggctggacaaaggtcatcaatcacccctaaaaagccacagttttcgcaaaaatcaaggggatagttaattcccgcatatcccatgtcgttttttgccatatgtcttataaccgcttccaaagcttcaatgttatttaagggaggagcggaaaactctacatagctaatgtgcccaccgttgcagtacttgtgatacggtccctcaatttctatctttctaaatatttcaatgggatacgctaccggcacatgaaaagagttagtgtagtattgcttatcggtaactccgggtatcaccccaaattcttttcggtccaaagccgtaaatcgcccggataaaccttccgcgggggttgccagcaaggcaaagttaaggtccgtttcctcacaaaactcatccaccttttcccgcatagcttttactattttgaggcccagttcctgagcttcctcactttctccgtgatgtttttcggtaagtaaaattaaggtttccgcaagaccgataaagcctatcgaaaatgtcccatgcacaattgccggtaaaattgaatcttccggtcccaaattttcggaacccaaataaattttttgccccatgataaaaggtaaatcctttacctttaaattttttaaaacggaaagccggtgaaggagctgctgttttcccatttccataagccagaatagttcctgccaaaaaacttcaaggttacccctggctttaatggcaagccggggtagatttaaggtaaccgcagcaatgttcccccgccgttcggtaacctccggtcccttccggttggccataaccctggtacgacagcccatataacttacctggtcgccgtacctctgattaaagctactgtccataaaactaaaagttggatttagccttttagcggcaacccttaaagcaagttgaaaaagatcgtaattggggtcacccggctcaaagttaacgccttttttcagacgaaaaattatattgggaaaaatgggattttcgccccggccaagccctctttcgtaggccagtaaaaaatttctcgtaactttgcgacccgcctcgctggtgtcggtgcccagatttatactgctaaagactacctgatttcctgcccggctgtgcatgctgtttaaattatagataaacgcctccatcgcctggaaaatctcttcctccggcgcctgacccataaaggctgccatatcccggtcgaaaaacggaaagctctgcccgccgtacatgtcattttgagcactctgcaacacaatggccgccagggccgccgcactacccggacgctttggcggtcttatatagccatgtccattattaaagcctttttctaaaatttcctttaagggatgctggaggcagtttatggttttggcataataatctaaatcgtggatgtggtaatcgccccgcttatgtaacagcgccagttcttcgggaattagccgggaaaggtagtaatgtttggaggcagcactggctatttggtacattttggccgccggcgagtgcccgatattggcgttttcccggctggtttccaccaagatttccgccacggtatccattaattccgatttgccttcccgaatcgccgttctttttgcccggtagagaatatacgccttggccgttttcgcatgaccgttttcaattaaaattttttccaccgcatcctggacatcttccacgttaaaaagatttccgttatattttgcttttaaatagccgaggacctgtaaggtcaattttaaagccgtttcccgatcttctcctcccaccgcccgggctgctttaaaaattgcttcggttattttattagggtcaaaaggcactaccctaccgtcccgtttgataatctctttaaacatttatgaattctctcccccgtttaacagtttctttaactcttctaaaaaagaattaacatctttaaactgccggtataccgaggcaaagcgaacatacgctacttcatcaagtttctttaaccggctcatgaccatttccccaatttccaaacttgtaacctcctgctctaatctattttttagttccctctcaatctcctcagctatttctaaaagcttgctctcggcaataggccttttttcgcacgcctttaataagccagtgtaaattttgtgtttatcaaatagttgcttgctgccatcttttttaaccacaattaacggccggtcatccaaacgttcataggtggtaaatcttttgctgcagttttcacattcccggcgccttttaatggcaaaaccatcctccgctgcccgggtatctatcacccgggtattttcgttaccgcaaaaaggacacctcaaattcctcccaccaccctatattttgtgttcaatctaattatatactactatatcttgtgtggtcaaggaaataaaaggaaaaaaaataaccccagggcataccagcctgaggttttagcgggacggtatttcaacaaaattgggaaggtccaccagaattacatctattccaattttttttatcgccgaccagggaataaacacatcatcattccgcgcccaaaaattccagctccgggtagctaccggtatgattaagccattaattttacccctctctaaatccagatcaatatctttaattagcccgagccgccgtccgtccgcaacgttaattacttcacgatatttcaattccgaaagccttaacataaaaacacccccggcctggtaaattatatgccggaggccttgaaaattaccctttttttattgtttttttgaacttcttaatgaaaagggacttcaagtaataactttttacgtgcgaaggttcgattcgtccccaatcggcaaaacaaaggtggggataaagaatgcaccaccagttatgcccctcggctttgccgatttttattcttaaagcatcgtaatagccggcaggtaccagatattcaccataagagcgctcggaaaaataaaactttcccatctccacttttatcccaatatcttttccctgagttttaagataattctgggccacagcagtgatgtggggcagttcattttttataacatttaacgcatcctcgcgcctttttaccgtttttaatctgggatataaatacgttaatacttcatcccttacccttaattttagctcctggtcagcggggttatcgctggcagcaattacatgaaaacggataatatcgttctccaccactttgggcattatctcccctttataggaaaagaaaccaaaaattaaacttgcccccaaaaataaaactcctaaagcgcaaattcttttcagacctactcctccctcaaacaaactttcttaaatgatttaaggctgctttttccaaccttgagacctgggcctgggaaataccgatttcttcggccacctccatctgggttttaccttcataaaatcgcaattttaaaataagcctttccctttcatttaaccgttctaaagcttcttttaaagctatcccttgaagccagttatggtcggtatttttttcgtccttgatttgatccataacaaatatgggatcgccgccgtcctggtaaatcggttcaaaaagagaaaccggatcttgaatagcatctaaggcaaaaactacctcttcctgcggaacttttaactcctgggcaatttcacttacggtaggctcccgggaaaaacgtccgaccaaattatcccgtacctggagagctttataagcgacatcccttaaagaccggcttacccttatgggattattatcccgcaaataccggcgaatttcgccaataatcattggtactgcataggttgaaaatttaacattttgctccaaatcaaagttatcaatggctttaattagcccgatgcaccctacttgaaaaaggtcatccacatactccccgcgattggtaaatctttgaattatgcttaaaacaagtctcaagttacccgaaataagtttttgccttgcctccatatccccttctttaaccttaaggaaaagttttttcatttcctggttggttagcaccggcagtttggaagtattaactccgcaaatctcgactttgtttgattgcatcgcggtcaccccattagtcggagttttgacctaccgttatgattattgccctgggtttttccttttatactggaaaaaaataaaaaatccggcaaaacgccggaacttattccatccgaattatttcttttttaagccgttttaaaatttttttctcaagtcttgagatatatgattgggaaattcccagtaaatccgccacttccttctgggttcgttcgtaaccatcggtaagtccaaatctcaattccataatctttcgttcccgctggtttagcttggaaagggcaactttaagaagctttttctccacctcatcttccataaccttataaattatatctccttcagttcctaacacatccgaaagcaaaagttcattcccatcccaatcaacgtttaaaggttcatcaaaggaaacttccaagcgaattttgctgttccttcttaagtacattaaaatctcgttttcaatgcaccgggaagcataagtggcaagtttaatttttttttccggattaaaggtatttaccgcttttatcaaaccaatcgttcctatcgaaaccaggtcctcaatatttaccccggtattttcaaatttccgggctatgtatacaaccaagcgcaagtttctttcgatcaacgttgattttgctgcggcatctccctgcaccaaaagcgtcaaaagagtattttcttcctcgctactcaagggaggtggtagaatatcgtggctaccgatataataaacctctcccggacgctcaaaaaattttttaaataaatttttgagccaaaagaaaaatttcttaataaccattcctacccctccctgtcaagccgattttaagatttcttccgaaagaagggcctgaaattcggaatttaacgattgaaaggttatggcaaccaccgctctcttaaccctaataacttcgccttcctgccagattttgagttcgtcgggtataaagccccagaaaaacccctgccccctcccaacgcccctaaaaggtatcctgcgaatagtcttgctttgaaaaaagtcaacaggcaagattttttttacagcccgatactccaccaccaccaccggccagcccagttgcgggtcataaaggcggtttcccgtgtccaaaaaactttgtaccgtaactttttttcctgagtaaacaatctccaagctaaatccgtattttttcaatcttacaatcctctggtattgcttataagcatactctccaataaaagccagaattagtgctgcaagaaggaaaaattccgggtagtatccggtgaaaattaaggcatggtaggcaccgtttaggaaaaagaaggaagccagggttaacaaaaaaagctttcccgcactggagggagatttggttaggaggtaagtggaaaggaaaaaaacgcaaaaagctaagatttttataccaaaataaggccaggctaaataaatttcggccataaccgccccaactaaagaaaagaaaaggtttttggcaaaacttaatttcaggtttaaaacctttgcggcaaagattaaagcagcataacttaagataaaatttcccagaaagacggattccaaaaagtaaaccggcattttcccttactccttaaaaaagaaaatgcactccaccatcattatatgagttggagtgcatttttcatgtcaaataaataaactatgcttttaccttttaacgacaatctttcctttgttccccgtgattatgccaatctcggcagccaatacccctttttgttgaagttttttaaccaactcttctttcttttcctgggaaacggccattaaaagtcctccggaagtttgcggatcggcaaggaacaacttttcttcttcagcaaattcaccggcaaaatccaaatggggcagtaagtagtttaagttatttttggccccaccgggaaataccctcatgccggcaaattcccatgccccttcaatagccggtatctttgtaagataaatttccgctccgaactcttcctgaagcatttcctttaaatgccctaaaagcccaaacccggtgatatccgtagccgccgaaactcctacctctaccattacttcggcggccttatcgtttaaagtctccatgacctccattacttttttcgcggtattttcaggcactatcccccgcttcattccggtagttaataccccaattcccaggggttttgttagaattaaagaatccccgggatgaggagggtgattttttacaattttatccggatgaaccaaaccgcaaactaccataccgtatttgggctccgcatcatctaccgtatgcccgcccaataccggtattcccgcttcccgggctttatccgccccgccttttaggatggtagctaatatctccggaggaagctttttgggaaaacccaccacgtttaacgcaaaaagcggtttggcccccatggcataaatatcgcttaacgagttggccgcggcaataactccgaagtaatacgggtcatccaccaccggggtaaagtaatccacggtaagaacaatggcttgttcgtcggatatccggtaaaccgccgcatcatcggcagtattggtaccaaccaaagcattgggatcattaatctccggtaagtagcgcaaaacttgcgccagagtctcgggactcatcttggccgctcacccggcacagcttaccaactgggtcaattttaccgcttccattatctcacctccagcagtagcttattcctgtattttattcattgtatattgttattttataccttttccttttaaacggtcaagcctgataatttccaattaaaagttttaaagccggcgctgatttaaaaagttttccgccaacttgacaaacatttaaatccgaagagtacttaatttctacctctttcgtctcatccctggcatttttggttttaatttttataacatagttaaagctttccatgtaccgggatggagctgctgtcccttcccttataccttttactaataattttatttcccgctcattttttcccggcagtaacttttgctgatgcttatatttgtcagtaatgatcaccattaaaatattttcgggataaagatttaaatcagaaacctgtttttcgacctcgtttaaattttctcccgggttatggtcccggaatttagccaaagggtcttctgaaaaggttattgcactaaaagtaaaacccaagcccctcctggccaaaactgcccgctcttcatactttcgtagtcccgccacatcttttttggtaatctccaccactacctcgggatagttaaatcccttttctaaaaaggtaatttcatttatggcaaaagaaagataacggctatcatcccagctcatagcttcggtaagctttttttccaagttaaacctttccttttggttgtttttaaataaaatcctccccaccgcattaaaatctcctaaagttaaagcatcgtaatacgcgctaacggttaataagacagcaacataaaaataaaaataaaccaaaaaaacaaccgagcaaaggctaaagagggctaaaactacttttttcaaaaaactaacctcctccatagaaaaaaagccccctttcggggagcgttttatcttcttcttaaaaaggcaggtatttcaattccagtatcgctgtccagtgaagaaaattctttaaaattaagctccggtttgacttctttcctggctacaggacggtggtcaaaaccggtagcaataaccgttacccgaacctcgtcctgcatggtttcatcaattcccgcaccaaaaataatattggcatcgggatcggccgcttgagcaatgatatcggctgcttcctggacttcaaacaagcttaacgaggtgccaccggtaatgtttaataaaacaccccgggcgccttcaatggatgtttctaaaaggggactggaaatagcctgccgggcagcctccaccgcccgattatcaccggaagcaaccccgattcccattaaagccgaaccggcgtctttcatgatagttttaacatcggcaaagtctaagttaattagggcaggcacggcaattaaatccgatattccctgaacaccctgacgcaaaacgtcatcggcaatcctgaatgcctctaacataggagtatttttatcaatcacctggagcaaacggtcattgggtatggtaattaaagtatcaactttactctttaaattttcgatacccttttccgcctgcatggcccgttttttaccttcaaaagtaaagggtttggttaccactccaacggtaagggctcccaattctttagcaatttcggccacaatgggagctgctccggttccggttccaccgcccattcccgcagtgacaaagaccatatccgccccttttagtgctgcatacaaatcttcccggttttcctctgcagccttttcgccaatttccggatttgctccggcaccaagtcccttcgttaattttacacctatttggatgcgcgtgggggctttggaaagctttaaagcctgggcatcggtgttgaccgcaataaattcaaccccttttaagccggacataatcatccgattaacggcattactgcccccgccacctaccccaataacttttatcgttgcattgttttgaaactcaagatcaaactccaacatcaaataccctccttaaaaatttaaaataattcactaaaaaaggctttaattttttggaaaattccgctcaagaaatctataccactactttcttccggttcctcccgatactgcttggcggctaaaaccaaagcgccaatagccgatgcataccgcggattaattaaattcaccggtaagttacttaatccttcaggtactccaatcctcaccggcaaatcaaaaatttcctgagctacctctttaatccccggaagcatggcacctccaccggtaattatcactcccccgggaagtaagcccgtaaaaccagaactccttatttcttttaaagcaagctcaagcatttccctcactcttgcttcaataattgccgcaaccatctgtttggatactttttgtttttcggtacctccaacgttttcaacctctaagtattcatcattttgcaccaagcttgccagagctgtacccgcttcaattttaattttttccgccaccgcaataggagttctaagacctattgccaaatcgttggtaatatactggtcacctaccggaatagcgccggtaaaaaataagcttccttcgctgtaaatagctaagtccatcgttcccgcaccaatatcaattaaaaggcagcccagctctttttccgcaggatataacacaacttctgcactggctaagattgccggaataaactccaggacatttagcccggctttactggcaaccttttgcaggttggcaaaagtgctttgggccacggcaataatatgggtctcagcctctaaacgcgacccggtcatccctaccggatcaaccactcccgcaaatccgtcaacggtataaaatcttggtatggcttttataatctttttatccggcggtatgggaacaattttggtggcgtttaacacccggtttacatcttcggaagtgatttctctctcaagattggtaacagctactacgcttttattatttaaagaaattaacgaaggtgaggtaaagctaaccactgctgaagtaaggccgtaacctacaatttgttctgccttttccaaagatgtctttatggcctttacagttccatctatatccacaatcgcccctttttttattccggaacttgccgtctctccaacccctaaaagagtaacctgaccatctgccgcaatttcgccgattagtgctacaattttcgaactgcctacatccaccacggcaatcagttcttttttggccacatttgttcctcccctacacaatctaagaacatttataaaaataattcaacactaaaaccatttatcctttttagtattttttattttctaaaattttttgtttttcgctgtcacaaaactaccttttaagtaggtggcggcgaattattgctaaattttgaaagatcctcacaccaaaaacaaaaatggctgccgtataaagttcaacccccatcctttccccaatccaagcaagaattcccgccagtaaagtattgctaaaaaaacccgtgataaagattacattatcataattgttttccatattcgcccgcactccgccaaaaaccgaatccagagccgctaaaagggctaccgaaagatattttgagtaagcaattggaactcccaacgggattaataaccccaaaattattccaattattaaacccacaattgctaaccacattacttatttcgcctcctggggttttatataactaaattccagattctgctcataagggggtaaaacaagtttattttctttggtaattgtcacttccatttgccattcccgaaaagttgccacaataccgttttctaaagaggttttcaattgttccggattgcctacagctaatatttcatagggcggataaatagctttggtattaaccacaattttatttccggccatccggacttccgttaaagccgtaaccctctggccgttcaccgcaattccttcagctccggcagcttttaactcgtttaaaagattaaaaaggtcttcgtcccgtacattaaacaactccgagttattcccaaaccccggagggttatttaaaatcacccgcacccctggaccgtaagcgggagtggcacctgcccaaaaacgatttttattaatttcagaaattaaggcatcttccgcaatttttccgcccttttctaacatgtttattttttgactcaaactgtttttttcttccattaaaccttctatttcctcggttaaacttttcaaacgggaagttaattcaaaactccgttccaggggaggagcattaaccatttcccggctgacgcggatttgaactgtcagtaaaaatcccaagattaagctcaccaccagcatggtataaggaattttaatcgttttcatgttatcccctcccctcttttaaatatttatagtccggaggagttgctgccttaattttaatattctccgaagtcttgatacttattgtaataaaatctttcaattggtcataaacaccaccgggcatcattaacgaattgcgcaaagcagcggggtttcctatggcctggatgacaaagggtgctgaaattcgcttggttttgtttaaaagtatcgtcggcccaacacagcgaatttccgtcatcgcggtcacccgctccccgttaataccaagagcttccgctcccgctgcccgtaattcatttaaaactaaaagtacatcttcatcatgaataacgtaaagattgggattttcttcggcagttaaaggctttttggcatcatccagggtaacttccacccctggcccctctaccgccagggttcctgctaagatctgatatttggtaagagtatcctgataggttcgtaaatgtccctgctcttcagttaaattggcaactttctggcgcaaactttctacttctttggctaactccttatgtttcttttccgctgcttccacctgtcttgcaagcaaagctgcccgttcgctgctaaaggtagtaggcatttgccgggttagcctgaactgggtggccagcatgatacccaaaatgcaaaataccaaaaaaaggccaaacttatttttgttgagatgttcggtcagtttcttcatactttaccaccggcgctcctttaaaacttacatttatatactcaattttcttgcctttatttcccagttcctgaaaaagacctaacgcaatgataagcttctgctggatatcgcggtcatcgccaaaaatcagctttaccccgtttttggtataaccaacaaccccttcttcgctatcgtacttaaaggtagataaaagctttttttgttccgagttcatggcttgcaggtaacgttttattggctctaatttttcagcagaaactttttctcccggctttaaggagtacccttcaagccctacaaccaccggaaggtcaatactccccgggtcaatcaggtcaattacggtaaaatcatcggctaaaaccgcaaccttttggttgttttgcggtaaagctataaaaggtctacgctcgtttacaaaaataacaagtgtatccgggtactttcttttaatgcttaccgttttaaccttaggataagccaataatttatcctctatctccttatcattaatggcaaataaatttacccctttcagggaaataactgctttggcatatacccctttatcctgttcagcacatcttatatcaatatttttcaggtcaaagaaggaagagcgcaaaaataagtaccccgatgttaacagcaacaaaactatgaaaagataagaaagtaacttcctgctttttttcttccgtttcataacgtaccttccttcgccaaaaaagcttgtccttgggaatttcaaaaaaaaaactaatatttttcctcgccgtttactctttttatttgcgctccgataagttggtacttcaaatccaggttttcataaccccgatcaagattttttattccctctaaaaccgtcattccttctgccgcaagaccggcaattaccagagctgctgcagcccgtaaatcatgggcaataaccgaagctcccgtaagtttcggcactcctttgataacagcaatcctgctttccagccgaatatccgcacccatccgccttaattcctctacatgtttaaaacgattgtcaaaaactccttccgagataatactggttccctgtgctaaagttaataaagctaaaatttgcggttgcatgtcggtaggaaatcccggataaggcatggtcttgatatcaacaggcttaataatactcttgccggttactctgacccaatcgccgccagaggttatcaaagcacctgcttcttttagtttcgccattaccgcttctaagtgctcgggaataacccctgaaataattatatcactttgagttgccgctgccattaccatatgggttcctgcttctattctatcaggaattattttatgagtaactccctttaactggtttactccggtgatttttataatatcagttcccgcaccttttacttttgcgcccatgagatttaaaaaattttgcaggtctacaatctccggctcccgggccgcatttctaattatcgttgttccctgggctaaggccgcagccatcattaagttctcggtagcacccaccgaaggaaaatccaagtgaatttcggcgccttttaattttttcgcccgggcccggataaagccagacttttcttcaacctccgctcccataagtcgtagaccttttaggtgtaagtccattggtctattacctatattacaacccccgggaagcggaactaccccttcctgaaaacgggccactaacggacctaaaaatagatttgaagcgcgaatttttcgggctaactcttcgggaattataagttcgttgattcggttattttgaatggttaacagctggccaaattccactttgcttcccaatcttttgaggattgaaagcataatattaacatcttcaagtttgggaatgttttctaaaacgcatggttcccgggttagaagggtggcagcaataatcggcagggcagaattttttgctccactaacttttatttctccttttaaaccgtgactccccacaataaaaaacttttccacttaagaaggcacctccgccttccctctactcccccaacacttccacttccagcagtaatttaacggaaaactttttccaaaccagttcttgaattttattaattaaataaattacatcggcagcactggctccaccggtattaataataaaattggcatgtttctcggaaaccatcgccccccctttttttaaaccctgagcacctgcttctttaattaacttccaggcaggtattccttccgggtttttaaaaacactgcccgcattgggaaactccagaggttgagacgctaaacgtttctcccgaaactccctgatttttttcaggatttcttttttatcgcccggatttaaggaaaactcggcttttacgatccattgcttctcctctttaaaacggctggaacggtacttaaaaccacattcgttagcaaaaaattccttaagttcacctctttcattgatggtccagaccctttttaatacatcttttatttcttttccgtgggctccggcattttgtctaattgccccgccaacactaccgggaatagcacaaagctcctctaaaccgcttaagccaacttttaaggctctggctgctaaagccggtagcagaacacccgcttcggcgaaaacctgcccccctgcagttatttccaccttattaattttctttgttttgataattaccccgcgaaatcctctatccaaaaccaggatgtttgaaccgttaccgatgaccctgaagtttaccgcattttccgttaaaaaccggatgaccaaagacaactcttctatgctttgcggttcaattaaaaagtcagcaggcccgccaattttccaggtagtatgttgcgctaacggctcattttccaataccggtgagcttattcttttggttaattcttctttaagtttagctttatccatatccttacgcctttcctaaaagcttgtaacctacttgattgatattccccgcacccagtaaaagaactaaaagtcctggttttaaattttgttccaggtaattataaacctcatccaacgactccagatataatggatttttccccaattttttcatttcttcggcaatcatttctccgctaacccccggtatgggtttctctcccgccgaataaatcccggttaaaaccaccttttccgcatcaaccagtacccgggcaaattctttataaaaaaagtgggtacgggtataccggtggggttggaacaccaccaaaacatcccggtccttataaagtttggccgcccttagggtagcttccacttctgtgggatggtgggcgtaatcatccacaattaaggccccgtttctttcccccaatatttgaaatcttcttttagccccgttaaattccagtagcctttcggaaatcgctttaaaggaaagaccgatattccgcaaaaccgccgtagctgcagccgcatttaagatgttgtgttttcctggtacttttaaacgaagttcgccttccagggtatttttataatagatatttgccaccagctgattttgttcctcccggtagtctcttaacataaagtcactgccgggagaaaaaccgtaagtaaacttcctttttttatagccttttaacatttcccttacctgaagattatcccagcaaaacactccaaaaccttcaggccttatgttatccgcaaactttttaaaagcttttttgatttcctcaaagctttgatagtaatcaaggtgatccgcttcaatattggtgataaccgctgcataggggagtaatttcaaaaaggaaccatcactttcgtccgcttcggcaaccatgtattcgccctggcctgctttggcattgtaccccaggtcgacaatttctccacccaccgcaattaccggatcaaacccttccttttccaggacgtaggcaatcattgacgaagtggtagtttttccgtgggtaccggccaccgcaatcccctttttttcctgcattaatcttgccaaaagttctccccggtgcattaccggtatccccaaccttttagcttttaaaagctccggattatcctggcttaccgccgttgaaacaaccaccaaacttacatcggaagctaagttttcttccctatgtccaataaaaaccgttatcccttcggcacgaagtttttttgtaagttcagtttctttaagatctgaaccggaaacccggtatcccttagactgcaaaatgcgtgcaagcccgctcatgccaattccgcctatcgctataaaatgtactgcaagcatttttctcacctttctcttgagaacagtactataatatgccatttaagtttttttgttactctttggctttaaaagcgcctccataattccagttatttctttaagcgaatctcgacgtaacactttccctgcattttccgccattttaacaagtttttccggactatccaaaaggggcaaaattgtggcttttacccgatcctcactgcattccgcatcccgcagtaaaaccgcagctccgtgactcacaaaagcccgggcattgtgttcctggtgattttccgccgcatagggataaggaattaacaccgcaggaactttagaagctgcaatttccgctaaggttgcagctcctgcccgggtgatggccagatccgctgccggtaaaacttccggcatgttatcaatgtacggcaccatttgtaccctttcgggaagatttttgtatttttgctttaaattttcatagtttcggggaccggtagcccagaccaaccttaaattaggtcttagcataatttccggtaacaggtaaccaacaactttatttatggtaagagctccctgactcccgccaaaggctacaagtaaaagctcatctttaccaacccccattttttttcgcaattcattcctattagcggcattggtaaaaaattcccttctcaccggaaggccggtttcataaagatttttcgctttcattcttttttttgcttccccaaaggtaaggcaaaccgcgtcaactctcgcagccaaaattttattggcaattcccggataagcattttgttcatggataaccgtaggaattttaagaaccgtggcggcaaaaactaccggaaaacttgcatatccgccggtacccacaactatatccggcttttccttttttaaaaaaataaaagcattaattaagcttttaggaacaagaaaaagctttttcaacgtctcccagctaactttccggggaatgccttccaccgggagcaaatacaagggaaatccgtactttggaaccaccgtgttttctataccccttggcgtaccaacaaaaaggatttcgtcgttggggtggctttccttccagctttgagcaatagctaatgccgggtaaaggtggcctcccgtacctcccccggcaaaaaccagtttcattaaaattcactcctcccgcgtcggtagcaagatacattgacaataataccggcagcagtcatgttaataatgagtgaggaaccgctataacttataaaaggcaggggaatcccggttaccggaaatactccggtagcaaccgcaatgttaattagcgccggaatcaccatcatgcaagtaaagccggctaccaggaaaaagccaaaaacatctggcgcccaatgggcaagcttaagtccccggtagagaatcgccaaaaacaagcttacaacaaaaatcgttccaaccagcccaagttcttcgccgatgatggcgaaaataaaatcggtatgctgctcaggtaaataaaacattttttggtggctccgtcccagccccaccccaaatataccaccggaacctatggcataaagggactgctttacctgatagataacagcttcatatccttttaacttattttcatcaccgataagcaagtaccaaaacccgataagcctttttctccggtactcttccaaaaaaattgcccccaaaacacctaaaattcccaaaataccaagaccggttaagtgggaaggcttggcaccggcaatcataagcagggcaaaaaccgttccactgatggccaaggttgttcctaaatctttttgcaaaagaacgagtaaatcggccaaggccataattattactaccggtaaaaagccttttttaaaatcggtaatatactggtaatttttttggaaatgttttgctaaaaaaattattatagcaaattttaacacctcagatggagagatgtttaaccagccaaatcttaattggcgctgggcaccttttacttctactccaacaaaaacaaccaaaatacataaaataacagctattaaaataagcggtccggtgtagcgccttaatttccggtaatcataggctaaagctaacaaaaaagctattgtcccaaaaacactccataaaagctgttttttgaaataataccagaccgtatgatactgaacataactggtatactggcttgccgaaaaaatcattactaatccaaataaaaccaaagtaaaaattaacaaagtaaagattaaatcgggggtgccctttgcccgcttcattttatccctccaccatatttaaaaccaaccttttaaataactctccccgttcttcataatttttaaacatatcccagctggctgccgccggtgataaaagcactacatcccccggccgagccaactcttttgcttttttcactgcatcttcaaaactctcggcaacaacatatttatcgtaacccaccatttctaaagcttcttttagctcctcgcgacattctcctactaaaatagtaaaccggactttttctcttatttccctggcaagctctccaaacgagtttcctttgtttcttcccccggcaattagaactatcggtcgctcataagagtttagggctttgattgtagaatcggggttggtacctttagaatcgttaacatacaatacgccatttatttcagcaaccttttctaaacgatgagctaccccttgaaaattccttaaccccctttcaatatttttgcccgaaactccaaagctccagcaagcagctaccgttgctaaagcattttctaaattgtgaggcccgggaaggggcaggttttctatatcaattatttcctcctctactcccaagcttctaaccacaatcttgccctttttgacaaaaaccccttcttctaactcttccttttggctaaagtaaaacactctcccgggtgttttcctgccaaggcttcttatccgggggtcatcataatttagtacggttacatccgtcctgtcctggtttataaatattcgggctttggcttccaaataaccttccaaagttttatgccgatctaaatggtcgggagttaggttcaaaagcaccgccactttgggcttaaaactttttatcgtctctaattgaaagctgctcacttccaaagataccgcatcccattcctcttccaccgcttcaattaaaggataaccgatattcccggcaattaacgtcttaaaaccggcaattttaaggacctcaccaatccaggaagtggtagtagttttgccgttagtgccggttaccgcaataattggagcctttaattccttatacgccagttcaatttccccaagtaccggtattccttcttttaaagaataagcaataggttcttccgttaaaggtacgccggggcttactactaagagttcccagtcttttaccagcggataaccccctaaaaccagttccaccccttcttccgcaagcttctttagttcttcatccaccggcaggctcatttttttatccgttaatactacctttgccccccgttttattaaaaaagctgccgctgctctgccgcttttccccgctccaaccaccagtatccgtttattggtatataaacccatcatcgaaccttctcctttcctcacttcattttacagcccgtaaccgctgattaaaaccattattaaagttaccaaggaaaaaaccaacacaatcttgttttccgaccagccagataattcaaaatggtgatgcaacggactcatcttaaatacccttttaccggtcagctggtaaacaatcacctggattatgaccgataaagtttccacaacataaattaaacctaccaacagtaaaaatagttccgtttgggttaaaaccgcaaatcccgctactgcagctcctaaggccagcgagccggtatctcccataaaaacctttgccggatgccggttataaactaaaaaacccactaaacctcccattaaagcaagggcaaaaataaacaggcccttttcttttaacgccaaagaagtcatcgcaaaaaagctcatcacaattaaagttacgctggaacaaagtccatctacaccatcggttaaattaactgcattagcaaagccaaccataataaaaattgtagcggcaaaaaagaaaacattccccaattccaggtaccggggttcgcccaaaagcaaacgactaaagggaatataccagtcggttccccgtcctaaaaaagctaccgcgccaaaagtcaaaaccaaagaaaaaatcacctggccaaggagcttttccctggctcttaaacccaaaggtcggcgtaaaaccactttaagataatcgtctaaaaaacccagtaaaccaaacagcaaggtggttattaacaaaagaagcgtttttgcatcaaaggcctgaaaaaccaccaccgttacaactaaacttaacaggaagataattcctcccatagtgggagtcccggatttctttaaatggcgtttgggaccttccgtacggaccgtttggccgatttttaattttaaaagccagggtattaaaaccctacctccccctaaagctacgaaaaaggaaaccagcaaagccgtaactcctttagtgattaccattgctaaaccaacctctttctattgtggcaaatagttcctcaaacttcatcccgcgggaagcttttaataaaacagtatcctctggttttaaaaagtttagtaaaaaacttcccgcttcttccttggttgcaaaatgaaaaatattttgcgggctcatacctccagctaaagccccattgccaatttcccgcgcctttggcccaacggtaattaaaaagtccactccaagcttagaagccacctctcccacccttcggtgcccagtggtttcaaaatcccccagctcgtacatctctcctaaaacagcaatttttcttcccttttgcccggtacctgccaaaactttcagggcagcttccatagaggtgggactggcattgtaatagtcttttatgattttcatgcttcctatgaattgaatttccaaacgcattccggtaagctctacttccgaaagtccttttttgattaacggcacccttacccctaaagtcaacgccgtcagaattgccgctaaagcattaaccgcattgtgcactccaaataacggcagaaaaaactcttcttcaagaatacctgcggtaataaatcttagcccatcgtcttcctgagaaaatttctttatgtataaatctccggctcgatggccaaagaaatacttttttacgggaatgtttgcaacaatttccttaatatatggactttctccgttaataatcgctacaccatcaccgggtaaatttttaattaattcgcttttcgcccgggcaatattttcctggctttttaaaagctcaagatgcgcttcgccgatattggttataataccgatatcggggcgggcaacctggcagagagcatctatctctcccagcccccgcatacccatttctactattccaacctcggtgttttcgtcaaaatttaataaagttaaaggcacccctaactcgttattaaagtttttttccgtagcacatacgttatatttttgccgaagcactgcttttaccaaatccttggtcgtggttttaccgttgctaccggtaattccgatgacttttaatccctctttttgtctattgtacaacgccagttcctgtaaagcccgaaaagtatctttaaccacaatctgggttacatttatggaaaaaggtctctcaacaacaactcctgccgcacctttggccacagcatccggtacaaattcatgcccatccagcttttctccatgtaaagctacaaataaagcgtaaggcttaagcgtccgggtgtcggtacttacctcggtaaactcccggtcttcacctaacaatactcctccggttacccgggcaatggtagaagctaaaatttttctcatctccgttcccctcgcagtatttcccgggccactacccgatcatcaaaaggatatttggtcgttccaattatctgataatcttcatgcccttttccggcaatcaccacggtatcccccggcttggccagcagcagagcggtcttaatagcttttttccggtcaacctctttaaggtattttcccggcaaagcatcaaaaaatcctttttcgatttcgttgatgattgcttccgggtcttcggtccgtggattatcgctggtaatgatcgttatgtccgctaaagttgcggaaatcttacccattttaggccgtttggttttatccctatcgcccccgcaaccaaagaccgcaataactcttccgggagtaattgcccttgccgactttaaaatattttccagaccatcgggagtgtgagcataatccacaataaccgcaaaatcctgtccttcatcaattaactcaaagcgtccggggacggggtttaacaaaggtaaatttttaacaatatcgggtaaagaaaaccccaaggttaaaagggttcccaccgccgccaaaatattgtaaacattaaaaagcccgagaagttttacctttaccggatattcttcctcctgatagcaaagggtaaaagcggtaccgctattggtaagttcaacatttttagcggtaatatcggcctgttctttaattccgtaagtgacaaaagggtgggctacttcttttaatatcctttgaccgtaaaagtcatccttattgatcactccaggtagggctttttgctccgccaaaatcttaaagagttcctttttagcattaaagtaattttccatggattcgtgaaaatccaaatgatcctgggttaaattagtaaaaaccccggttttaaaatctattcctaaaacccgcttttgtactaaagcatgggacgatacttccatagctacgtgggaaacttcgctttttaccatttcggcaaaaagccgttgtaaactcaaagcatcgggggtagtattggttaccggaaggatcttatcccctatgcggttgtagatagtccctattaacccggttttataaccgaagctttctaaaagagaggttaccaaatgggtaacggtagtcttaccattggtaccggttaccccgataacactaattttttccgtaggattaccgtaaaaagtccgggctaaaagggccagagcctgccgactatctttaactaaaaggtgatttaccccaaaaattccgggtcgttcttcctcggccacaattagtgctggttttttttcgataactttttcaataaaatcgtggccatcggcggtaaaaccttttatcgccacaaaaatatttccaggttttacttgtcttgaatcctgctcgattcccgttacctcgagttctgcccagtttataccgtttttggttataatcgtttttaaaatctcaactaactcagcaattttcacatttggccacttcctttttaattatttttaccattaattgctattttaattataaacaaagagcccccaggggctgtggccttaatttttaaatttcacttccaccacagtcccgggcggcaccaccgttccagggctgatgttttgttctaccgcaaccccggaaccgatatagcgaaaaccaagtcccagccgctttaaaattccactaacctcatcaaaggtaaggcctgtaagctcgggaactataactttatcggtatctcccttcccctgaccaagggtcaaggtaatttcggtaccttcgggaacgataactcccggctccggcgattgctttactacttttggcccatgcccttccacattaaagattagcccgttttcgataatctttttctgggcttcccagagggttaacccctctaaagcaggtacccttacctcttcggggaaaacttcaattggtccttcgtttttcgccggttccggatcttcctggggctttacgcccatgtatcttaaaatatcctcccctaaacttttaaaaaccggagcagctatctggccgccgtaataaactcctgtacttggttcgacaattaccactaaagcagcaaacttgggatcgttggccggagcaaagccaacaaatgaagccacatattttcccggggcataaccaccggtaggggaaaccacttgagcggttcccgttttaccggccacccgaaagcctttaatgtaggctttggtgcccgttccctttaaaacaacccgctccaaaagctctcttagggtcctggcggtttcttcggaaatcacccgttttaaataacggggcttattttcaagaactatatttcccgcttggtcaactattttttttactacgtgaggttcgacaagcttaccgccgttggcgacagcacaaaccgcccggataagctggattggcgttactgcgattgactgcccaatggaaattgtggcaaggttaacattggttactttgtcttcggggatgataagacctttttgctccccgggaagttcaatccccgttttttcaccaaaaccaaagcttctaatgtatttgtaaaaccgctctttacccaaacttaaaccaaccttgacaaacccagggttgcaagagttttggataacctccgcaaacgactgagcaccgtgcggagtcttactccagcatcttatcttgcgaccgttaacaacaatataacccggatcataaaaacggtcttggggatgaaccactccttcttccaaagccgcagcggaagtaataattttaaaggtcgaacccggctcataattataccatattgcaaagtttttttcccgaacctccgccggatatttggcaaattcgttgggattaaagttaggccgagaacccatccccaaaatttcccccgtttttggatccatgacgataatcatcgctaaagcaggctttaactgactttcaatattgttcaattctctttccacaaaatactggatagtttcatcaatggtgagataaacattgtttccgggccgtgcaggaatgtataaggatgaagattcaggaatctctaaaccccgggcgtctctttcggtgaccaggcggccagggataccttttagatacttatctaaactaagttcaagaccggcaagcccctgattatcggtaccagcataacctaagaggtgtgcggcaaaatcattatgggggtagtaccgttgggtttcttccactaattcaagaccgaaagtataaacctcatcttccttatccgctaagagctttttcaaagctttggcttcatcgtaggaaagtttccgtttaatccaaataaaactactccgggtgttggaaagtttttggcgtaaattttccttggctttttcatctaaatttaaaatcttgcttaacttatctaccagtaaacctaaaggcttgggctttaggcttttcccatccttttccttatcttctggaggagcttccttggtttcatcgtaataatatttcatcaactgtttgggatttgctactaatgattccacactgatggactgggctaataaatttccgttgcgatcataaatatttcccctttgcggcggtaaaattatttcactttgccggtctgctaaagcttcacttcttaaagtctcggcttttatcacctgcaaataaaaaagcctcacaatgattatggaggcaaaagcagctaaaagcaagaataatgcaccggttctttttttataaatggttttataattttgcaaactaacggcctccttcggctttcttcctaacggttaaatacgcgggttaataaagcgattaaccgattcccacttttttctgttttaggagtttccttcttttcttccggcaggttgatcgcaacatacatgacattatcggttgctttttccattccccgggatagggctattttttcaatttccttactgttatcaattgaggctatctccatttttaaagcatcgttttggatttttaaggcattgatttcttttttaagccgggcaatctcgtaacccagcgaagctctataggcaaaaacggtggcaaaagaaaccccggacaaaaagagaaaaagagttcctactgcccaaatttttaaccccaaaattaaatcctttctgggttttttctttattttaggttgttctgaaatcaccggtttttcttttgccaataccaacttattcacgctccttttattttatgcaaaagataatttttcggcagctctaagcttggcactatgagcgcggcgattcttttcaatttcctcctcgcttggaaccaacggttttttcgtaataactttaagccttggttttttgccgcaaacgcacatgggaaagtcctttggacaaatacacggattttcttcccgtcggaaaaaattttttaccagccggtcctccagggaatgaaaagttatgaccacaatccgccctccgggctttaaaacttccaccgcacccactaagccctcttccaaactgctcaattcatcattaacttcaattcttatggcctgaaagacccttttggcgggatgtttttcccttcgggctttggcaggtacagcccgaattatttcctcggcaagttctaaggtagaggtaaaaggctttttttcccggcgttttacaatagcccgggcaatttgcggggcatacctttcttccccgtattcgtaaaaaattcttattagttctttttcgggataagtatttaccacatccgctgccgtctttgggttttggggatccatccgcatatccagcgggccatcatgctgaaaactaaagccttttagaggattatccagctgaaaagacgaaacccccagatccattagtaccccatctaccgcatcaagacccagacggtaaaccacttttcttatgttgcgaaaattgcttttaaccggaataaatctatcgccaaaaggtgccaatcgtttggcggcatggtttaaagcatcttcatcctggtccaatcccactacccggcagtcagccctttttaatatttcttcactgtggcccccaccacccaaagtggcatccacatatactccgccagctttaaggtttaaatgttcaattgtttcattaagcaacaccggcacatgggaaaactccatattaaatccctctataataaaaagtcaaccattttttcggcaatttcttcataagctgcctgagccccgttgcagtaattgttccagagttcctgactccaaatttccacccgggtaccaactcccactataactacctctttatcaagtttggcgtattcccttaaatggttgggcagcaataccctgccctgtttgtcctgctcacactcggcggctccggcaaaaaataaccggacaaaggcccgggcatcttgattggtaaagggaagcgcttttattttttcttctataactttccattccttctgggggaatacaaaaaggcaatgatccagccctttggtgacaataaacttttctcccagctcctcgcggaaacgagccggaataaaaacccgacccttggcatccatggtatgggaatactcccccataaacatcggcttccccaccttaaccaaattcgcaccactttaaaccacttttctccactattcaattctacaaaggtaaaaaaaatcctgcttaaatgtgtgacttttatcacagaaattttgaaggcaaaaaaaaccgcccaattacgggcggcgttcggaaaaaggtgagttatttagtatcgggtaaaaatttataagttttaagcataaatgtcaggatgataattaccagggcaaaaggaagaagagctactgctatttccaccggagaaggggcataatgccaaaagctggcaaacaccgcggcccctttcttatataccccaatagcaatcgggtaattgaccatttctgcctccgtatccggtaaggtaaaattaagcggaaatacattatacgaagctggcattaaaaggaaacgatgggcaaacaccccgataaataaaaggatgcttccagtaattaggccgttgtaggactccctgccctttggggtaaggaaataaatcataacaaaagctggtaacgctacttctaaaaggtgaattaaaccatactttttaaataccagtgccagagggttcagctcttcaggcactccccaccaccagcgcactaaaaaatcaatatacatgaagaaaaagtgaacaattaaggaaccggcaataataaaggcaaagcttttaaacgctcctttatactgcacaaaccgttcttttcctgcaactaacaaagagataagcatcaccagggctgttccggaagcggtagccaccgcgataaaatccggcggcagcacggcagtatgccaccaatcccgggaagcttgcgtcgcaaagataagagcagttacggtatgaatcaagaccgcaaagggaagaccaattaatgaaacccttttagcccagagccgggaaatatcttctacctgttcctgacttaaatttttggtccagccgtttaaaaagccccggttttcctttttccattccggcaaaagctgaaaatagacacttaaaaaggttaggattaagtaacacgaaattacgataacatcccacaccaggggtgaacgaaaattgggatgtaagagcatgttataaattcgctccggtcgaccaatatcgggtaagattattgcaccagcgcctacaatactggcaaaagccgaaagggaagcaatccgggtgaaaggctttaactgttcgataccaaaaagataaattgacgatgacacaattaaacccccggcagcaatacccacaaaaaaagcaaaggtagcgatataaagtccccagctaaaggggttacgcaggttggttaccaccaggccctggcttaactgatagccccaggcaataatgctaattacaaacagcagtatgccaatcaataataattgatttaactttttcattgtattgcctccttttaccgtcttcccttagttggcgccagataatagactttgggtttagttcctaaatgttcttttaattgaacgacctgtctttcatggactaatttactaatttcggaatctttgtcgtcaaggtcaccaaatattctggcatgggccgggcaagcctgaacacaagccggaagttctcctttatcggtatactggacgcaaaaagtgcatttctctactacgccttttggacggttttgggtataaaccagtcggtcatccttgtcccggtggtcaaagggataaccgtagctgtaccccttcatgtatccaacccggtctttagcttttttcgggtcttcccagttaaactggcgaacaccatagggacaagcagtcatacagtagcgacagcctatgcaacgctcataatctaccagtacccgccccttatcgtcggtataagtggcccctacaggacaaactttgacacagggagcattttcacacatctggcaggctaccggcaaaaaatacatctgcaaatgcccgtctttttccaccgccgtttggtgttcttcgctccccggggtaaaaacccggttccaccaggtccccggaggctgggaattatgttctttacaaatcaccgcacaggtccggcagccaatgcatttatcaaggtctatgaccataccgtaacgcattaactttcacccacctttctcacatcacacaggcattcattccaggccgtattcgggctccacacaccgggtacaaaatacacctcgtgcgtcggtttaataaacggataggttaaggagttgtaggaggtttcctttaaataacggctccaccagccctgttcaaaaactatgactttttcgcctataccgggatccaaaacggcgtaacctttaactttaccccggctgttatatacctctaccaggtccccttctttgataccttttgtttcggcatctttagggttaagaaaaaccttgggcttattgttgtgcaactcttccatccaaatattgttggaatgggtggagtgaacccgatacagcgagttcctggtgataaaggcaaactggtatttacctttgctacttgggtccaaagcatactcgctttcttcaaaaggtggtttgtacaccggcagctgctcgccaagttttaagaaaatatcttcgtctttgtaaaactcaatccgcccgcttttaacaaattgcgcggttttttcaaggggtaccggtaaactctccggcgggaatggctttttctcaacgatctgttcgtaaaacattatttgcctgtttccaggagtccccagttttaatcttactggccccttcttcagttgttctaaggtaatccctgctaccgttggaccaccggtagccaacatcagttcaatggccttttccgccgctttatccggatcaaggccggggaagaagtgcttttcaaattccggattgattcttttggccagttctctaaatatccagagttccggcttacaattatatagtggttttattgccggttgctgaagttgcagatatggatgcaccggcgttgcggtaagttcggttttttcataccaggtaacacccggcaataccacatcgctccactgacagctggtggaattttgaaaatctatagctaccacaaactctaactcacccttttccaccatttctcgcaggcgattggccatattgtgctggtcaaaggggttgtgccagccaaaaattaaagcctttattccatttttgggcttaggggccaccatgttttccgtaggtccgtgtaggatataaagccagggataccactttgctttctttccttccggaaaccaccatttgtttacttttaacctgatccggtactgtcctgcgtaagtagaaatccccgctcctggtttcccaaggttgccggtaagtaccactatcaacgctaacgcccggccttttaaatcgccgtgataccactgataattgctcgccccataaataatgtgaagcggttttatcgtagccatttcccgggctatttttactacatcctctgcctttacgccggtttcccgctctacaaattccggcgtgtaaactttgaggctttcctttaaaagctgaaatatgggctttaccttgacggtttggccattttttaaagtaacggtatattctccctccagcgctacatctaagggcatttccagtttttccggatttaccgctaaaaacttgccgttataggctacaaaaacatcccggtaaggagacacacctgccggcagggcaagtccggccacatcagcagctttcaaacgtttgccgttatctaagcgaactaaaagcggtaagtcggtataagttttaataaacggttcatcataaagtttttcttctacaattatccgggcaattcccagagccagggcagcatcactggaaacttttatccggtaaaattcatcggctttagctgccgttggcgagtagttggggtcaaaaactacaaccttaccgccccgctttttcgattccaaaagtaaatccgagtcaataagccgggtcaccataacgttggaaccaaatatagcagtatagcgcgagtttacccattctaaaggttccaactcttccgtttgcactccaaaagtctggggccaaaacattggtaaatccccgtttaaatcgtaagcgtgatgtaaggtccagccagcaagggtagctaatgctaccatagctcccttatggacgtagccggtaccccctacttggaaactaacacctattgattcaggcccatatttttccgcaatttctttaagccttcgagcagtataatctaaagcttcctcccaggatacatctctaaatttcccttttaatccccggccaccttccttaattctgggccctttgagccggtctggaccgtatatcaagttaataaaagatatcccccgtaaacaacccctggggttgtattccgggtcaggatagtcattagtggggaataatgctttaatttgcccatccactaccattgctttaataccacaagcgctggtgcagttgggcgaacaggtagtacgaacaaatttaacttcccgagcacggttatcggctaaagcttttttaaccagtacccttccgcctccggctcccagcagaacaccggcagcagccgtacctttcaaaaactgacgccgggtaagctttactttgtacttcacctaaaccacctcgttttaacattctttatattcttgagtaagtttacccctgaattcttacaaatttctttcacgtccaaatacttttttaaaaaaaccgtaattaatagccccaattgccaaagtaactccaagtgcaatactccaccagttactacctgctaaatgggcaataaacactccaacggtagccgaaattatatgcccacccaaaacgctttttggtctggcaaaaggactttcataggcgctaaaaaggattaccgcggtggctcccaacgagggcaaaagcagtggtatcttgtaaataaacgctaaaaaagaaatagccccaataccgaaaaaacttcctattatcgtccaaaacattttttttaatttatcttttctttctctcattgctttataacagtacaccccctttgtattgcagtttaaattattaaaaacaaaatttctgtgttttaaatcacaaaaaaaaaccgcccaattacggacggtttaaaggaatttcccgggctttttgatttgcaaaagttgtaaggttttttacgccaattccctctaacatctggtaaatttccggaaatttataggcaaggtgctccggcttatgggcgtcggaaccggtagtaagagggattttttcccttaccgcttcctcaatgataattttacttggatattgctccttagccggatagcgtaagcctgcggtgttaatttccagcaccatcccggaattttttaattccaggaaaatttccggtaaatggggctcaataagtgcaaagctaaccaggccaaatttctttattaaatccaagtggccgataacattaaaaatccctaatctaatcacttttttaactaaatcaaaatattttgctgtcagctcttttaaatctttacctcgatagctttcaatttccgcgggatcgtcaaaaggccagttgtctataaaatgaaccgagccaataagataatccaccggtaaatcttttaaagctcttttgatttccccttcactttcaggaaaataatccacttccagcccaatttttaaaaaagggtacgtttcctttaacttaaaaagctttcttaagtattggggccaatcgttaaccttcatggaataccccggaaagtcttttccatataatgccatgggaaaatgttcactaaagccaagttccgtaactcctttttcccgggctttttggatataatcctcaaactccccttccccgtgcccggaataaacggtgtgtacgtgtaaatcaatcattggtgatttcctttccaaaatcccgcaaaaggccgtatatcttttccgcatgctccggaagtaaaagccccgtgccacaggccggagtcagcatgatattcgaattatccgaaactactcccatttcccttaacaaattaacttttcgttcataatccttgtagaggtcttctaaactataattctctatttccgggccggtaggaataatccccagggctaaaattcccccggtatttaataaacttttaatttcttctttatacggaaacagggaatcaagatagttaaaagcatctaccgatacaacctgtgctccagcttccgttactattgaccagtcgataccggcacaggagtggactccgggtatacctccttcttctaaaatcccgtcaatgatttcttttaaaactcctactacctcttcccgttttaaagtaagatgggtgaaactgccgtaattggcaattgccggatcatccacaaacaaataaaccttccttccagtattttttaaaaaatttacctgccagcgggccgacataactaaagtcttaaccactgcttcccgaatctccggatcgtaaaaggccggtatcttgttttcatcggtaagggtaagtaagatgctcaaagggccggccatttgcccttttaccgccagggccctgggaaaatactcattaaatttttccaccaaaagataaagcccttctccactttcccggggcatggcaaaaaaagcataatcccttttttcaagagcttcaaaatacttttcataaaagaatgttaatttttcgggaaaggtttcatctttcttaaaaattcctttatttccttctacctgcagtaaccccacttccgttaacggccgtaaaaactgaaaaacaaaatgctccgccacaccccgctggggcatctggggccagtggggtatttgcggtaacgcttccttgataatttccaggttttttgtggcatctaccagtggcatgctcccaataccggtttttaaaatttccttcatcgtccttgcctcctcatcaattactttttttatttcgaaaatatttgaaccagtggtttataggaaatagcctctaaaaaatttgcatactcttcattggtaattcccccgggatttttcttaaaataagcacaagccatagcttctaaaagattggcccccggactaattccctgaaaatccccacccgaacccactaccgccaaggcccctttgctttttaaaaaagctatatcttccttccgcaaggtagtggtaataattacttttcccgttaaatcaggacaataccgccgtaaaaagtggaaatccccggccaccacctgacagcggctaaaaactttattgtagcgtggggtatttttttcctgctttgtccctaaaggataaaggtattttattggtattgttcttagtaccggtaaagttaaaatacctgctatcgtaaaaagtttttcccccgggaaaaaaaggggtaactttagggcaaaagccgcatccccaattaaaactttcttagcccccgccttccttaatccagcatataaccagggcctgtccaaataagatgttagaagtgcgttaaaattttgggggagcaattgaagtttttgggcaagttctactgcctttaaatccaatagaggtttaataaagcttccatccgccaaaggtttggaagttgcctttttaatttgttgtgcctctaaaagcggataccttttcttacccaggtaataataaaaatttattcctccaattcccgccgcatcatattcctcgtcttttaataacttaattgcccgggctatatccccgttggtaccggttcttttcgcaaaaaaagtggtatgtcccactttaaaagtaaaggcaaaatcccggcgcgagcttccaaggctaaccccaaggatttttttagtaattataaaactacctccatttcccggtcaaagtaaactccttttaagtctaactttaaacggtaagctttaatatacacccccgccattgccgctttttttaacgctgaagcaaagtacgggtcacatttatcatttggtttaaatacttctgcatcctcccggcaaattaaaaaaaccaccgctgttaaatattgagaagataaagctcttaattcctccaaatgccttactccccgtggagttggggcatcgggaaaaagagcatacttcccttccaccaaggttacggacttcacctcaataaaaccagtcttatcccgaagctgaactttgaaatcaaagcgggactgccccttggtctgctccgctgctacttggtctatctcccgagaaaaaggctttataatacctttctctaacagcccctgcgcaattttattgggaagaaggctatcaactaaaaccaaagattccggcatttgcgctaaaaccaggtcatattgatactttcggccaggatttttgccttcccgtaaatacaccagccgaccttcggttaaaatttccgccagtcggccggaattgggaatatggaccaacaccttttctccctgtaaaaccacttcacctacaaaacggtttaattttttgcaaaaaactgcaggaattggagtaaaattgaattccatttaagacctctttctaagaaacaatttcagcaattctgtcaagattattataagcctcttcttctccccgccgaatggcccagggtattaaagcaaaatcattccaatccatccccgaaactcggggtcttaatactaaatcggcgaatcgttccacatctttttcggtattggaagtcataattatctccattgaacttcccagcacatcaataatgtttttaatatggtacttattttcctcggggtttgtcaaggcaactccaataattttttcgtaacctaaattagctaaaattctgaccggcacattttccacaactcccccatcggttaacaagtagtcataaaattttaccggagtaaaaattccgggaactgccgaagtcgcctccaaagcagtcaccaataaagcgtcccggacagcaatataatcgtttattccccgtagaaactcccctggaaaattgccaaagaccacccttttgccggaatagaggtctacacttatcaccgcaacctgttcttttaattgatttatattaagcgttcctaattcccttacaatttttcgctgtaaaccaatgggtctaaagattcctaaaggaagctttaatttattattttgatagccaaaaagctttaataaattataacttatgataaaaatacctactcccgcggtaaataaacagttatagaggtctttgggtttaatttgaagagcaagctcctccatatccttaggcgacaaccccgctccatataaaagggctataatcccaccgacactggtgccggatactatcgaaggttttaacccctctttttccagaactttcagtactccaatgtgagcagcccctcttaaaaagcctcccccaagggcaagaccccactccttcattactctccccccagttttttaaaaatctttagcgtaaaagccgcatgggcgcttagcacggtatatatctcccggtcgttttttatttcccctcttccccctccaaaacctattgtccagtacgggcctccgggaatgatcaagccgtggtaaaaataaaactgcagtaactgggctaataccatattgtgacccgctcttcttcccgtgacaattcccacacctattttcccgcctaattctcgacccctgctggaagataacatgccaagacggcttaaaaacgccgaaagcaaaggagacattccgctgtagtaaaccggtgttcccaaaaccaggattttgcttttaacaacaatcggatagattccctggaaatcatcccggatttggcactcccccgtcgcctgacatcttctacaacccctgcaagcagcaatttttctttccgccaggggaattatttccgttgacagctctttggtaagttgttttaaataatacctgaccaaatactcggtatttccccggcgcctcggactcccaacaacacctacggcctccatcctacccctccaaaagctctaatttataaaaatttatgcgaaaaaaaggtttttttgcctaaaaaatagaatcttttttccgggtgagaacatgaacttcaaaaagattatttttgcattctttggacttaccttaatttttttaatcgccgcctggtttttcccgttaaattactatcttgccttacccttaacaattaaggaaaatcctcaaccagccgatgccgtcgtggttttaagcgggggccttaccaagaagggagatttaggcgagagtaccagggaaaggttaaatttaggtattaacctctggaaaaacgattacggacgctatcttttgctgtcaggaggcagttttaccagagagccaaaagacgccagcctcatggccaaagaagcgctaaaaaaaggtgttcccgctccggctcttttactggagagcagtagcgaaaacacctacgaaaacgttttattaaccgcaaatatttattatcagaaccgctggaaaagaattttagtggtcacctctgcctatcatactttgcgggttaaaaaaatgtataacgaccggggggttaacgccaccgttgtctaccccgccggtgaactgccaaacgcccgcggattgttaagattaaggcaaactatagtagttgttgaagaatatttaaagttactctactactttattggtaagctttagtttttttattttattgcgcaaggtagtatgggttacccccaaacttctggctgcctgcctgatggaaggatactgttttaaagccctttcaataagttccttctccacctggttaaccgcttcttctaaagtccgggcaacaaaataggtattttgggggttatctaaaataatatctttggcttcgataactccatcatccgctaaggttaaagcccgttcaatgacgttttgcagttcccggacattgcctggccagctatacgctttaagcttatttaaggcattttccgttatttcaaagtactgtattccccgccttttggcaaaagtatttaaaaaatggtaggtcaacacttcaatatcttccacccgctcccttaaaggcggaatttgtagtggaaaaacatttaagcgaaaatacaggtcttcccggaactttccttcccggaccatcccctctaagttgcggttagttgcagcaattattctaatatccaccggtatctcttcttgaccgccaatccggcgcaccttcccttcctgcaggacgcgtaaaagtttggcctgcaggtgggtaggaagttcggcaatttcatctaaaaacaacgtcccctcatgggcaaactctaaaagcccctgttttcctcccttttttgctccggtaaaagccccttccacataaccaaaaagttccgattccaacaaactctccggaaccgccgcacagtttaagggaacaaaaggcttggttctcctcgggctctccaagtgaatagcccgggcaaacagctccttgccagtccccgattctccccggattaacacagtggtatcggttcttgctacttttttggccatttctaccacaaagcgcattttttcagaggtatagatgatatcgttaaagctatttaacgacggtttggttaaagcataaaccagttcccggacttccgacattggttttaagactgcaaccacccctacaatattgcccaaacggtccttaatcggtcgtccggaagtaagataatgaagtcttctaccttcaacattaataattatttcctggttattgtaactttcaccggtttttaaagtttttagcatgggaatatcgtttgctaaaagcttacccacattctgcccgattaccctctctactgggataccaaagatctcggcacagctttgattgcatatagaaatggtaccgtgactatcgatagcaattataccctcattaaccgtatcaagaacagctctaagctgctgctccttttgctcatagggcattatttcaatgggatgaacctttaacaccttgggaatattttttaagtcatcgataatttgctttaaagtttttttatccgttttctctatctccaaaaacattcttccgggaagcacttgaaaagtaataatatttaaatttctggcagaaataaccctggaaacatccaagactaaccctacccggtcttcaaaatccagggataacttaatggtacccatccccccgtcacctcacctcttttttcattatcctttttttcaagaaatcttgcaacaaaaaatgccgggttaatccccggcattacctcttaaaagttcggttatcggtaaccttaaaatttgccctaatttataataattcacccccaccgcaattaaaaaagaagacaaaaacgcaatgtttataccacttaacagtatcctataaggaatggctaacttttgcaaaattaccttggtaaccatcaatcccagcggccaggcggccagaactcctaacaaaaccgccagcaagtcttccattaagattattttcacaataacttttgttttaaagcctaaagccgcaaaaattcctatctcctggcttcttcccaaaaggtcattttccaaaaacgactttaccaataaaaagcccattattaaaagaacaaccgctaagacactcccaaatacctggtaccttaaaagtaagttaaagcgctgttcttcaggtcccgtaataaagtcaatatttaaatccggaaaaagctcataagctttagattttaccgtatcatccccgggttttaaaattgcttgaaggagaaaatagtccggaggagcagagctttctttaaggcttgcaaagaaaaacccatcttcgtttttaccggtaggctttaaaatcccgacaaccttccctttgaaagccccaaaatcaattaaatccccaaccttaagcttatattcccgggcaaggtcggatcctgccagtatttcacctgctctttcaggatatttacccaaaacctcccagtaaggccggtatttcttttcttctgaaaaatcaagataaattacagccgttttttgtccattaaccgtaaaaaaccgaactttctttggagcataaacggtaatttgctgtttaaaagtattgtaaaactttacagcttcactttctggaataaagtttaactcgtaatttcctgaaactaacgtgatattttggtaagtaaaactaaactgctcggtggcagcagtcacggcaatacgctgcccccgtttttctttttccgtttgtaaataagtatttaaattgcttatagttaagccgatggtaaggaaaagagcaaaaaccaataaaaccaaaagggtttttgtagctaaccgaccccgccggcttaaaaagaagcttttaacgttcaaacccctcatattaaaccctcggctgccaggcatctacaatatttttatctaccaaaattttgccatctttcacttcgtacggtatttcatcgggcgggtaagcggtacagcccccatcaattccctttaagttatctaacaaagaccagcgcgtaccgcaggtcatgcaaaccagggcattatcctgaattttaaagcgaaagccccggcacggttcacaaatgctcaccgctactgccaatcttccgtcgtttaagaaaaacgcagtcagcggtttggtcgggctgtaaggcacgtagactattccgtatttttgaacatcttctaaaggtatttcaatttttccttccttattgaccaccgctggaatatcggtcatttgaatctcctgcccggagtaattaatttcagcggcgtaataggccccctcttttttcttcttggcaggtacaaacatcatgaccgttaatcctatagcaatgattcccaaaaccgcaatgataattttcagagctttgtgcatgctatttttttgttttaaaaattcttcctttttagtcatttaattcgcctcctttaaagtttttgtttccaaaacctcaccatcttttaaaaataaagcatgtgtagcataatgaagatggtcaaggttatgagttaccatgataatcgtcttaccccggcgatttaattcggcaaaaatcttcataacttcctctccggtcttgctatccaagttacccgttggttcatcggctaacaatatttccggctccatgataagtgcccgggctatagctacccgctcctgttctcctccggaaagctctttgggatatttttcttcttttccctcaagcccaagcatttttaaaagctcccgcgcctctttttccttactgattttccggggataagcaagggtaggtaacagaacattttctacagcagttaagtaaggtaaaagatgaaaattttgaaagataaagccaagataatttaagcgaaaaagtgcccgttcatcgtgacttaagctaaagagatccaaatcatctaccagcaccctaccactatccggctcattcaagcttccaaggatacttaataaggttgattttccggagcccgaaggacccgctataatccagaactctcctttacccacttgaaagctcacatctttcaatactctggtctccacattgcctttaacatacttcttgctaatgctttccacttgaatgtaggccatttttctcctcctaatactcccttaaaatttcctgatggtccaaccgggaaacctttaccaccggtagcagtgaaaccactaaccataaaatcagtccaccaattaaggcaaaacttatatactgccaggaaaacagttgggcgctggcaattcccaacatcctggctaagaccacagctaagccaaccattaataaactacctaaaacttcactaaccaaaagcacaattaaaatttccaggccatacaaattaaatatctttaacttgctaaagccgagagttctgaaaatcaacaactccttttccctttctttaaaaagactaaaggttaaaatcaaaaagtttccaacacctaataccaaaagaccgtaagccatttgcttgctgaaactcccaaaattttcaaccaaaagtttacgatcaaaaattgcatccgccattgccgaaacctttatcgtaggatccagcgctctgatttgtttaactatttccggtatcgggcaggttgaacacagagcacttacctcaataaacgtataagaatttatcttaaacagggaaagaacggttttaagatctaaaaataaactgttatcctcaaaactccctgtccttttaatcactccggttatgataaactcttcaccattaacctttactttgccaggtttcccaagtttttcgtaaagattttccccaattagcccttctctcgcggtttgcggtttacgtccggttatttgccaccacttttttgctcttaactcctccgcaaagattactcctaaaaccaccccttcccggttgtttacttttgccttcaccactaccttaggggaaattatgctgatactttctttatttttaatggttttaattttgtcgggaagtgtcaaatcaattcccattagtttttgctcggcaaaaggtactccatcaaaggccttccccttggaaagtttatcaggtacaattaagatatttgcaccaattttgtcataataatcggccacttccttttgcaaattaaaagttgtaagtaaaactcctccgattcccccaatggtgatggcaatacttagaatcattaaaaataccttggtctttttttcctgcatttgtcgtaaaactacatgcccgatcttcattgcctcacccgctaatttgtagtttcaacttaattataaattaatttcctacatcttgtagttacaaaaatgttacaaaaaaattaaaacctccaaagcggaggttttaacgccgtttaacaaataaagtataaaaagattaagcttaaacttacaatcaaagtcatcaccgcaaaataggtaaaattcctccggggaattttcaaatcgctctctattatggcctgcattcgttttatttcaaaatcccctcccagatccaaagcaaaaccaatccatgacgcattcgccccaaatttgtaagttttaaccagagcactggctaagggttcttttttacctaaatagccgagagcaactttatcggctcttagctccctaaacaacaaaatcttttcaaaatattttttaagcccgggaacgaaaaagtagaggtaggtggcaaactggcaaagactaattattaggctatcattagctttaatatgagcaagttcatgggcaaggaccgccttaagttcttcaaaatccagtcttttagcatactcttccccgacaattaccaccggtttatcaaatttaaaggtaaaaatggtgatattaccgggagcaagataacaaaaaacttctttttttatccccattttttctttaagttcagcaagaataccgtttaactgctcatctttctttagccggtgagctttcaaaaagcgattaaaagtgaaatagggccggataatctcgtgcaaaccgtaaaaagctgcaaatataaagacaggggtaaaatatttggctgcaccatcccctaaaaagcacaaaaaaccccctataaactttaaaggagggttggcaagggttaaaagagggcagggctttccccagtaaattattaccgccaagaccggaattaaaagcggtatggttaaaatctcactccaaaaataactgttattttttaaaagccttttaccaattaataataacaaagtatagccaaaaagaggtccaaacaaagcatacagaaaaaaagtatggactactttaaagctcatactacccctgctgttcttttatttttaataacattttttccaactccgcaagtttctgcggatcattctctacctttttcaagaaatgggtaaaagcaggctcggcaaactcttcaaaaaggccatccactaccgtttcggcaaccttattataaaattcctcccggcttaccgccggcgtataggaatgggcaagcccaatactttttttgattaaaagccctttatcggcaagcctgcccatgatggtcagaatcgtggtataggcaagctttttctcctgattaataatctggtggacatcctttaccgttgcttctcctaaatcccagataatttccataactcttgcttctaattcacctaaaaccttggccacacccttattttggggtttaaattcgccctctaaccagctcatttaaatctccccttccttttttggcgcacaatttctacaaaagccataaatttttaactggtgattggttacgacaaaacctttatttttatatacttccctttccagttcctccaataaatcttcctcaatctcttcaatttttccacaatttaaacatattaaatgatgatgctggtgcgatttactttcaagaagctcaaattcatatcttttacgaccatcaccaaaatccatacaatgtaccaagcctaaagaatataaaatttcaagggtgcggtagacggtggctaagccaatttccggagatttttctttaacaagccctaaaatttcttccgcacttaaatgcttatcctggttttcaattaatacccgcaaaatttcttcccgctgcggagtaagcttataatcactttcacgaagtttcttacccacttgacttaagatattctccataaaacccgtccttttcccttaaaatcattattttatttttcaattatttttgctcgttggttatactttcatcaaatccgataaataacccccaaaagtcaataataaaatataaaataacccaaaaaagcacggcaccgcttagcatatgccataaagaataattcctgtaaaggtagtacattaaaaagctataaccaacaattaaaagtagcccaaccccccagcttatgaaagcaatagccattctttttaaaacaaccttaaagatgtcaaacatcaattaccctccaaaaataaaagccaaagacttaatactttggctttattctaccatattttttaagaaattgaaaagttaaaaataatcccgctaaaaaaaggactcccgggtaaattaactttctgctgctgtaaataagggttggctccacggaattaaaagcaactaattttacttccccaacaacattttcgttttcctttacaacaatcttccctaccctttgaccagcttttaccggagcttggagcttttctatctttttttgataatcaaactggggttcctgcctccggtttacagtatcatacaggtcttctgccgctataagttttactggctctttgcctccagccacctctactttcccaaattcctgccctttagaaacgagctttactgttttaaaattgttaaaagcgtaatccaaaagctttgtagcatcatcataaacatttcgtccttcactccctaaaacaaccgcaataaattcctcgccatcccgggcagccgaagctaccaggcattgccgggcttttacggtatacccggtcttaataccattggccccctcataccgccataaaagtttattatggttttgtaaaaaccgcaagtatttagggtctcgatttattacctttgtttttgtcgctgcaatttcccgaaacttggggttttgcatagcagcccgggcaattaaagctaaatccctggctgtggtataatggtcatcgttgggaaggccattgggatttacaaaatgggtattttttgcccctaattccctggccttatcattcatttcctgcacaaaagttgccacatctccaccgatgtatttggccaccgcaatcgccgaatcgttggcagagttgagcataatagaatataataaatcttccaagcttaattgttccccgggattcaaccagatggccgagccctcaacataacacgcttctttatcgatataaaccctatcggataaatttcccttttccagagcaattaaggtagtcattattttggtagtgcttgcaggatacattttttggtcggcattttttaaataaacaaattttccggagttaacattgataaccgctgcggctcggccaataatttggggctcttctgccagtgctatagttttcaggcataaaattaggataaataaagcaaaaaatcttaccggtttcatttcgtccctcgtcaaaaaattctcttttttaatataactgccaacattagttcaagtcaaggaaagaaaaaaccatttactttgctttagtaccataaaaatgcacgtctacatccagggtaaaacataaacctttgggtaaaacctctaatactttgggaagcactttttgaatattttcctcgctatcgaccacatcaattatcaacggtaaatctgcagacagctccagtaatttcgtcccatgaattatgccatcggctccataacccattattccacggctcaccgtaaccccggctattttattttcttttaaaatttttattatttgctgaaccacatttttcccatcatgtttggtagcttcacccacataaattttgagtaattttgccttactcatttaaacgcctcccttaaaaaaatttgctaaccacatccccgcagcaaagaaaactaccccagtaaagatcgatgtaagtaaataattcacatttttccaaaacaacccttcttccataagaaaaattgcctcataaatataagtagaaaaagtcgtaaatcccccaaaaaaaccggtaccaagtaaaagccagattacttgatttaatttaaacccgtataataaaccaagaccaaaggaaccaattatatttattaaaaacgtcgccagcggccaatccccctggtagcgttctcctatttttttagttaaggtatatcttaaaatagccccaatacttccaccaagaccaatcaacaataagtccaccattaaccctcatcctttgccccgttttttctaaaatttaaattaaccagataaagagctaaggctcgaccaagtatgcccgacaaaaacccaccacttaaggataaaaaaaggtaggcaaacccaattaaaagtttactctgaaaaagcaagagataaatttccttggtcattgttgaaaaagtggtatacgctcctaaaaatccagaagtcaatcctaaacgtactggatcgcttacatttattctttctaagaacaaggtcataaaaaataaaagtaaaaaactaccgctaagattaattgctaaagtaccaacaggaaaaatgcttgtacctaaggcacggccagtaatttcccgcgcaattgccccaaaaaatcctcccagagctacagcaaagtaattcattgtatccccctctttttgtccagaaaaactaagcccctacctttaacacaaaaggtaggaaccattatctaaaaaacattttcgtaactgtaaaaacactttttattttaaattttttaataattaatttcaactaacttaacaaaagctccatttttatttcataaaaaagcgttttcaatagcgcgctgaatatgacccaccacctccttcaatttattttaagaaaatttaagacattgcctggaatttttccttaatttcttttaattggtccacaaaggtttgaatccttataatctcctgggctatattctgagaatgctccaaacgtttttcccttgccgcctgaatagctcctcgagtagctaaaatagtttcttggagacgttcttctaaactaagcccaaactggcgaaaagcttgatcaagattttgcagtgttgcccagcgtaaattttctacattggttaaaaccaaatcatttacttgtttttgcagtcgctgcgcaatttttgcccggcgcatagcaggaggcatgaatttaacaatggtattttccgaaaaaatgttaaaagtagcttccagtttctgggttacccagtaaggctggcgtttcatctcaaatgcttcagcgctgctgggagcatgatagggaatgtcaaaaagctcggctgcagttttccgccctgtctcaataagctcttccactttctgctgataaggtcttaaaacttcggttactctctgttcaaaaatccttgccatttctccaagctctttttcaaaaaactcaggtatcgccttagccagggctttttgaatttcagtttcatttacattatcgcccatctgctctaaattggaccggacaatttccagtaagtaagcgcgggctttctgccgtaaactttcggcttgttgttcgagaaactccagcattcgtttccggtcaccaaccaaaagatcgcctaagaaaattcgttgccggtttgcttcctgaattttttgctcaaagatattaaggcgctcatctaattccgccagaggcatttccagcgaacgaagagtaagttgcaaacgcattaaaacatcggcaattacatcggtagctttctttgccagtgctgtttgcaagacattctttttctccctggcaagaaaatcaatcaggtaatgccaaacctcatctaaaccactctgctcccaaagctctggatcatctctttttcttgcttctaaccccagacgagctgatacacaaaaaagaggtggttccccttctatccccacttgttctcgcaaaacatttttaataaatgttacaagggcagcaatttcctcttttttaagataatctaccttatttaaaatgaaaaaaagatgggctactttagtcctgacagcttttaaaaattctacctccacctccgtaatcggcggatctgccgaaactaaaaataaagccgcatcacattggggcaaaaaatttagagtagtttcggtattatgccggaaagttgaaccaatacccggggtatcaattaagactactcctttttggagaaggagcgatggataaaaaacttccacctgagatactttcttataatttttaggatttcccgcttccgtaacaaattgggcaagaaaagcacttatctcttctttatcttggcctgtaaattcttctttttgcaagccttcctgcagaaatacccgtacccgggcctcgggcccccagagaagaaaaatcggaacagcagttaatggtaagacggcagtaggcagcaaatcatctcccagaagggcatttataaaagtacttttaccccgtttaaactgtccaagaactgccagatgaaagcgctcgtttaaaaaccgctcctgtaacccccggattttctgtaagttctcgctgaattctggtcctaaactttgcaaaatttccaaagtttttaaaaaaagaatattcatctctgtatcatcagatattgtttgtgtagcccaatctcgtttttcttgaatcatactgaccccctctctatggtaaacacaaatacttattttttgctcttaactatcaataccgggcagtgggcaagacgaactaccgcctccgaaacgctgcccaaaagatagcgcttaataccgcttaaaccccgtgctcctaaaacaattagatcataaccctcctcttcagcaagattaaccaaagcctctgccggatgcccaggtactacggtactaactttgcctcaagtttttcttcccgcgttaccgcttcacggtcaggccggaaaaaggcctgggcaataatcgtcggtactacagcacttaaaataaccaccgttactaatatcgtatactgcacctggttaatataaccgtggtttaagccaaacaaagcagatattgtaccaaaagttagcccggtggacatcaataaagtggtatacattccctcccgggggccaaatttaaaaaaccgggtagttggccaaacaccaagaaatttagccaaaattttgacgataagaccaacagttataatcccggcaccggtaactaccgcgggcagtgaaacatataaaccagcttttaagaaataaaaaggagtcagtagggaaaaagttatgatacgcaggcgagcggtcaatgtcttttcctgcaaaaagaaacccgcaacagctaaacctaaaaggtaggccggtaaaaccgcttcactattggccatagttgccagtccaccgagaaagaaaagcaggaagaaaatatattttatttccaattgactcacgcggttgccataacgattgaggaaaaacggcgtaaaacgggaaacaaaagctaaaatcaggctagttgcaacaataaaaagaaacatccagctattaaaattggcaaaaagcacacctaaagcaactaccgtccccagatcagtaataaaacatgcagcaaggataattttgcctatttcggtttcattaagaccggtttccaccattacagcgtaaaccactgcaactgaggtagtggaaagggcaatccctgcaatttcagaagcttccagggtccagtggaggacgtaataagcatagagaaaagccccgataaagggtaagagaaaggaaagaaatccaatacttacactttctctaaactttgtccgtaataccaccggatcaacttcagcaccggccaggaaggttaaaacaatacttcctactccagctaagaaattaacccattggttagggtgtaagcctaaaaagttacctgccaccacccctaccgcaatctccactaaagaaatagagattccggtccaaccagcaattaaaccgcttactaacgcaagccctatccaaagagcggccaccagccaggtattttccataattttaccccccttatggagctaagaaaataaaaaactcctaccgaaaactttactttcggtaggagctattagctcagatgagcgttaggcgagccccatcgccattaaatttttctttcattttacaatttttaatacacaattgtcaagtaaactgccaaaaatagttaacaggaggtggttaaattttacctaaaaacagtaccaaaagctgcttgaagttacttaccggttgtcaaacgaacataaatggtcttagcaatatcttgatctattgcggccctggtccggcctacctttattataaaactgggaaatctctgttccaggacaatgggaagaccgggaattactcccattgccattaattttttgatgatggcctcatctttggtattgaaataagctacaattcctttttcgcccggtctcatattataaagacttatggccaggggtttagcagatgcctccattaaaagttcacccccagtaccgtcagtaagaaattaaggagataacccatgaaaaaggcaaaaggcaagataaaggcagttattgccaaagtaactttagtccctcgctcctttaacatcatggaaaattgagcaatgcagggaataaacaaagttaaagttacagcagcaaccactaactgcttgccggccagaattccattctgatataaatcaaacatacctgctgccccgtaatcacggcggaagaaaccaaacagaaacacctgggctgccttgggtggaagtccaatccagagcattactggctctaagcctttaataataaggtcaaagagcccggtcaatttccctatccagattaataccgaagccaaaataaacaggggtaggatctcaataaaataccatttcatccgcacaaaagtcttggtaaggatattttttaatttggggattcttagaggcggaatttccatataaaatcctgcctttttgccgggaagcagctgagaagacaagtaccctatcagaagaaaaactaaaatcataactccagcccagattagcagggcttcagggttattggacaaaagccctaagataacccctaactgggccgagcacggaatagcaagagctaataaaagcgtcgcaattatcctttcccggttggtttctaaagttctggtcaccatggtcgccatcgtatcgcagccaaaccccaaaaccattggaataaccgcccgaccggataaacctattaccttaaaagcccggtcaattaaaagcgataatcgcggcagatagccactatcttctaaaattgaaaacattaaaaagtataaagtcaccaccggtaacacaattgccacagcatacctaatccccagagtaattattccgtagtcattagcaattaaatcctgcaaaaccttccacggtattacctgggcggtaacctgattaactactggattaatattattttcaaaataagtttcaattaaatcaaccaaagttccggccccaaaaacccccacaaacttataaatgccgaaataaagtattaaaaacatgatcggtatacccgtaataggatttaccgtgagcttgtgcaaaaattcggtaatactcgctttttccgtttccttttcttttaaagcttccttttctacatttaacgcaaattcctgccgggccgaagcaatcacaaagcttaatggttctttaaattgcttttgagtatcgtcaattattttaaggatttcttgataatggggttctttctttgcgatttcagctaaaagagcttcatctttctgcagcagcaaaagggccaggcttcgtttcgaaagtttatattccacggttaaaagcttttcaatttcagcaatagctttttcaatcggttccgggtattttattctatttattaacatactcggccaccctttcttttaattcgcgaattcccacattttgcgctgccgccattgtaactaccggtattcccagctctctttcaattttttcccggtcaataacaagtcccagttgttccgcctcatccatcatattaatagccaaaagcaccggcaatcctgcttcaattaactggtaggttaagggtaacattctcccgagatttttggcatcaacaacatggaccacaatatcgggcttttcttctaaaagaaggtctcgagccactttttcctcttcggttatcggtaaaagggaatacatccccggggtatctataacttcatactcctgaccatgaattacagtccttccccgggcaacttctaccgttgtccccgggtaattggacacagttacataagctccggttaaggcattaaaaagcatgcttttgccaacgttgggcgaaccaaccagggctatttttaagagcttttcttcacacatttccttccgggctttttgccagaagagaccaaaacgtctcctgtgtcttccaccggcatgatgacagcttctgttgcagttatggcaatccatattaacaacctccgctattgattttcattctcatttactcgttaaaaaaaatatttcctacttttacattatatcaaactgttcgtaattgacaagtattctcaattaaattttaccaatcgggaaacaaaaaatgtaactgtcaaagctaagattaacctgtaaattatcaataccgttccctttgccccaatagcaacaaataaaagggtatcttcaattaaggaatgacagataacaagaaaaatacttattaacactaaatctttatgttttaaaatcccttcccgggcactatcaataattaagccggcaccataggccagaccaaaaactaatcccgccaaaagcggaaaagctgcttccttttgcattcccaaaaaccccataaggggctctaacggttttgcccatttttccagaacccttaattcttttgccacttctaaaactaccataagaggaattacaatcatagctatttttattagcatattaaaactaccgctcaaagcttctataaatattttctccaccatatcccactcacctaaagtatgatatttaaaagatagccgctcaatattgccaggacaatccttagtaatattaaataccagaccgcaattccggtttttctgctaacggcagtttccacaaaaagattatgggaaagcaatagcatcacggcaataatagtcacctgtttgaccgtcatctttaaagcggcaatagcagcaatggtaggataaagatttagcacattaccaattacaaaaattagcgacgcctctcccggaagtcctacagaccgcattaccggctcgaagattttggcaattatcgctaatattccagaatactttaaaattgtaattaaaaaatataccggaattactgtcctggcaagctcacaggttatattaaaacccttttgtattccccgaagtgcagcgatttttaaattataaaaatttgtaccttccatcctaatcccccaaaacattttcttcttattttaagcttaatccaccaccttgacaacctggtaacgttatactacctttcgtattctcgctatataaaataatcaaaaaaattacccctaacattttgcaaaatttattgcaaaatgttaggggttttaaagtacgttggaacaaagaaacagagcctcatcctttccattaaacaatattttatctgtactcattttccaaatcgtttatcaattccctgtaggtttcctcactgatcttcccttccaacaaaagcttacgaatccgctttttctccgcaaccaaatgagctggagcatcgctccggctgtttcccttacctttgcgaacatggtgagaactgctctgagttttaaacgcataaaaaattaccactcctaaaaacactataaacaaaataacaagtagtaagataacccaatccgtggaggaagtcgaattagcttgtgcacttgaagtagccggtggagcttgggtattagcagtctgactgtcgtccttcggcttttcaaatgaaggattaggatcttccttggtataggaaattttgatactaataggcttgttcggattggaaaaggtatatccaaaggtatttaagttgtaaccctgtcccgtaaaattagaaggaggatttagcttaaaatttgtggcttttagaggctgtcccacatttatagttaaattctggataggtaaaaccggtataaacctataattaattgttttatttttttgtccttcaataccataatagtagaactccagataaaccttatattctttgcccggttgaattatctttgatattttccaaaccagttcctggtaatctcctttatcgattattcgaaaaggctgacattcatgaccacctgcttcattaatttcacacgccattccgaccttgatattttcatcttttctcggcaccataaagcgaatttctccattatatggctctgaagaaatgatagttccttcataaattacaagaatattatcgggttcgtcatattctggtaaaactgaaattgtaaagtccttaaactgaatattactttgagcatatgcttttaccggactgccaaaaaataaaaatactccaagaataagtaaaacccataatttgccgggtagatgaaaccattttagcatttattagcctcctttaataataaagacctactacttattgtagtattagttttattatattgtcttgctatctcgcgaacaaatcctgttatattatctgatgaaccaaataatcaaattaggtttaaataacaccgttttttttattcctagccgagatatctcaatacttctccataacatttaaccgctccagggacggttctgagaaccaccattttcatgaggaaaaaaagtaaaaagggataggcagattgcctatcccttttagagttttttccggcagcgacctactctcccaggacctatcgtcccagtaccattggcgctggagggcttaactgccgtgttcggaatgggaacgggtgtttcccctccgctatggccaccggaaacttattctggaagttggatgttggagattggaggttggattttataattaaacctcttctcctcacctattccttgaaaactgcacagaggcttattttggaatttatggttttaggtcttcggttttcggtttttccaacctcaaacctccaacctctaacctctagtttgaaggtcaagtcctcgacctattagtaccggtccgctcaaccgattgctcggcttacacgcccagcctatctaccggatcttctctccggggtcttactctggattgctccagatgggaaacctcatctcggggctggcttcgcgcttagatgctttcagcgcttatccattccgcacttggctacccagcggtgcccctggcgagacaactggttcaccagcggtgcgtccatcccggtcctctcgtactaaggacagcacccctcaagtttcctacgcccgcgatggatagggaccgaactgtctcacgacgttctgaacccagctcacgtaccgctttaatgggcgaacagcccaacccttgggacctacttcagccccaggatgcgatgagccgacatcgaggtgccaaaccccgccgtcgatgtggactcttgggcgggatcagcctgttatccccggggtagcttttatccgttgagcgatggcccttccactcggtaccaccggatcactaagcccgtgtttccacccagctcgacccgtcggtctcgctgtcaagcacccttatgcctttgcactcgccgcgcgatttccatccgcgctgagggtacctttgggcgcctccgttaccctttaggaggcgaccgccccagtcaaactgcccacctgacactgtccccccacccgctacagggcagcaggttagaacttcagtgacgtaagggtggtatcccaccgccggctccacctgagctggcgcccaggtctctcagcctcccacctatcctgtacatacgccaccaaaattcaatgccaggctacagtaaagctccacggggtctttctgtcctatcgcgggtaacctgcatcttcacaggtactacaatttcaccgagcccctcgtcgagacagcgcccaagtcgttacgcctttcgtgcgggtcggaacttacccgacaaggaatttcgctaccttaggaccgttatagttacggccgccgtttactggggcttcggttcagagcttcgcctttcggctaacccttccccttaaccttccagcaccgggcaggcgtcagcccctatacttcagcttttcgctttagcagagacctgtgtttttggtaaacagtcgcttgggcctcttctctgcgaccccctcgggctccagatgttcatccttcaccctaccggggcaccccttctcccgaagttacagggtcattttgccgagttccttaacgagggttctctcgcgcgcctgtggattctctcctcgcctacctgtgtcggtttgcggtacgggcaccctcgccctcggtagaggcttttctcggcagcttggattcggttgcttcggtactctatcttccctccccgtcacctctcgggctttccgtgggacggatttccctatcccacaccctaccggcttggacgcgcttttccagccgcgcgctcaacctatccttctgcgtcaccccttccctcaagcgggctcgggtggcaggggattctcaaccccttccccatcacctacgcctctcggcctcggcttaggtcccggcttaccctgggcggacgagccttccccaggaacccttaggcttccggcgggcaggattctcacctgccttctcgcttacttatgccggcattctcacttcctacctgtccacgtaacctcccggttacgcttcccccaggtaagaacgctcccctacccatactggaagtcggtacctccaactcccagcatgccgaagtttcggtggcgtgcttgagccccgctacattttcggcgcagagtcactcgactagtgagctattacgcactctttaaatgatggctgcttctaagccaacatcctagttgtcttcgcaactccacatccttccccacttagcacgccctttgggaccttaactgtcggtctgggctgttcccctctcgaccatgaagcttttcccccatggtctgactccctgcctctaagctacaggtattcggagtttaactgggttcggtaacccgtgaaggcccctagcccaatcagtgctctaccccctgtagccaccagcagaggctaggcctatacctatttcggggagaaccagctatctccgggttcgattggcatttcacccctacccacagctcatccgccgccttttcaacgacggtcggttcgggcctccagctggtcttacccagctttcaccctggccatgggtagatcacccggtttcgggtctgctgcacgcaacttccgccctcttcggactcgctttcgcttcggctccggcctccccagccttaacctcgctgcgtacagcaactcgccggcccgttctacaaaaagtacgccgtcaggctttcatcgccctccgactgcttgtaggcatacggtttcaggtcctatttcactcccctcccggggtgcttttcacctttccctcacggtactcgtcctctatcggtcgccagcgggtatttagccttggagggtggtcccccctgcttcccatagggttcctcgtgccccatggtactcaggctcgtacgctgcagctacgcgtaatttcggatacagggctttcaccttctatggcggagtttcccaactccttctcctattacgcttcactgccgggtacatggcagtgtacccacccgtacggcctcctaccccgcatacgcaacggctgccaccttctacacgtatgcggtttgggctcctcccctttcgctcgccgctactcagggaatctcttcttgatttcttctcctccgggtactaagatgtttcagttccccgggttccccccgtacacctatgtgttcagtgtacggtgaccggccattacgccggccgggttcccccattcggaaatccgcggatcccagctcgcttgcagctccccgcggcttttcgcagcttgccacgtccttcttcggcctctggcgccaaggcatccaccgtatgcccttactaacttgaccttctcctttttacccccaacctctgtgcagttttcaaagaacagttattggtgataagtgtgtcgtcagtggtaggtttttcttttgtacctacctttaccgacggttgtggtttatggttttccccgaccacttaacactaaccaccgaccacgttaattgtggtaagtggtgagtcgttggtggtaagtttttcttttgtacctggctttgccggcggccttggtaaatggtttctgaccaccgaccacagaccaccgactactgttaataacggcaagcggctcttctttctccttagaaaggaggtgatccagccgcaccttccgatacggctaccttgttacgacttcaccccaatcaccggtcccaccttcggcagctccctccctttccgggttaggccactgacttcgggtgttaccggctttcgtggtgtgacgggcggtgtgtacaaggcccgggaacgtattcaccgcggcatgctgatccgcgattactagcaattccgacttcatgcaggcgagttgcagcctgcaatccgaactgagagcggctttttgggatttgctccaggtcgccccttcgcttccctttgtaccgcccattgtagcacgtgtgtagcccagggcataaaggccatgatgatttgacgtcatccccaccttcctccatcttatcgatggcagtccccttagagtgcccgtctttacgctggcaactaagggtaggggttgcgctcgttgcgggacttaacccaacatctcacgacacgagctgacgacaaccatgcagcacctgtctcgcggttcctaccttccggcaggcaccccggtgtttccaccaggttccgcggatgtcaagccctggtaaggttcttcgggttgcgtcgaattaaaccacatgctccactgcttgtgcgggcccccgtcaattcctttgagtttcaaccttgcggccgtactccccaggcggggtgcttattgggttacctccggcacggaacctttccggccccacacctagcacccatcgtttacggccaggactacccgggtatctaatccggttcgctcccctggctttcgctcctcagcgtcaggttcagtccagagagccgccttcgccactggtgttcctcccgatatctacgcatttcaccgctacaccgggaattccactctcctctcctgccctcaagtccagcagtatcaggtgctcccccacggttgagccgtggccttttacacctgacttaccagaccgcctacgagctctttacgcccagtaattccggacaacgctcgccccctacgttttaccgcggctgctggcacgtagttagccggggcttcctcctccggtaccgtcatccactcacccttttcgaatgagtgaacttcgtcccggaagacaggggtttacaacccgaaggccttcttcccccacgcggcgtcgctccgtcaggctttcgcccattgcggaatatcccccactgctgcctcccgtaggagtctgggccgtgtctcagtcccagtgtggccggtcaccctctcaggccggctacccatcgtcgccttggtaggccattaccccaccaactagctaataggacgcgggcccatctgtaagcggtagcttgctacgcctcagccaccctttcctatcaggcctctactcccgatagcgtatccggtattagccccggtttcccagggttatcccggtcttacaggtaggtcacccacgcgttactcacccgtccgccgctaaggaaacagttgagcaagctcaaccgcttcccccgctcgacttgcatgtgttaggcacgccgccagcgttcgtcctgagccaggatcaaaccctccataaattcaccccacaaaaagcttcgctttttgcggggaccccgaagttttaccccaaaaaatcttgcgattttttggggaccccggtataaaaacctgtttacacaggttaggtcctatgaaagggtcaatccaagctttatttgctctcgtactcttaccgagtacgggccgcttgccgttattcccttgccaaggtacctgtcgctttcggcgtttcccgccgtcggcgacgtctcttaatttatcatatctctgcgtcccttgtcaagcggttttttacctgcttttttgcttccggtccttatcgctgacgccgtgacgcttttttaatatatcaaattcctttaccttttttcaatggttattttcccgtaatttccctccctaaaagggtgtgaaaaaccaaaaaacgccggtaaactcttttaccagcgtttttcgacatttttttagccaaagcgaccggtaatataatcttctgttcggcgatcccggggcttagtaaagataacctcggtcctatccatttcaattaattcaccatttaggaaaaaggcggttctgtcggaaattctcgcagcctgctgcatgttgtgggtaacaattactatcgtgtattttttctttaattcctgaataagttcttcaattcgcatagtagaaatcggatccaaggctgaagttggttcatccattaaaagcacttccggttcaatagctaatgcccgggcaatacaaagtctttgctgctggcccccggataaaccggtagcaggtttatgaagcctatctttcacctcatcccacaaagctgctccgcgaaggctcttttcaacgatttcatctaattttctcttatcttttaacccgtgaattttgggtgcataagctacgttttcgtaaactgacttgggaaaaggatttggagattgaaaaaccattcccactcttttcctaagttctacaacatcaaaattttccttataaatatcaacaccatcaaataaaattgagccttcaattcttacccctggaattaagtcattcatgcggtttaaagttcgtaaaaaagtcgattttccgcatccagaaggaccaattagggctgtaacctcatttttataaatatccaaacttatgttttttaacgcttgaaagttaccgtaatataaatttaaatcccgaactttaattttaacatcagacagcatctcttatcctccaatgctgcattaatctcaacatgatttagacttctcacaactcctctaacttttagcttcagctcacttactttttcatatgatttattatattaattttttattgagtttatattatggcagaattaaatttttcttaacataaactgttcaattattaagttcccgcctttaactttcccagcactaacaaatattacctgatttttaaagtttagtacataaaaaaatttaaaaaaggcattgcatgtttactaaattagtggtataaaaatacaataagcacacaaccttcaccttttgcccccggagtcttctccggttatttttttatgtatacaaaaaagcctgcctgaagcaggcctgaacaattttcttaaaattcccctctaaactcaaacacctttttcccggataccgccctgtcttcaatataattagcaatttcttctaacatgtacaaaaaataataattgtaaagtcgtgtaaacttctcaacaatttcatgatacccttctaccggccaccgctcccctttctcatccatttccgtattttctaaataaagccggttaaactcatcctttagtttggcaaactctttttgctccaggtactgccgaatgagcggaacatcttcaacctttagccgcagtatttcataaccacctttattttcgtactcaccaatcccgagcttcttcggaacccggtaaagttccggatcctgaagcccagctacatacttccagaccgtctcatcttcacagtaaacgaatttacccaccggcagccctcccgcaaaattaagttcattatattatttctccttctcctgtttttttcctgctaatcaggtataaacaaaagaaggattttgtcaaattttgttcaataatatatttagcaatattttcttcttctaccattaatgtttaagcaggaggttcacctttgctatacgaccttgatatcaccgattttttaaaaaaactttcctatcttcagagctatgaaaaacaacttttggaacgtttttgcagttacgctcgccagttaaaacaaaatttaaagccaattagaccctacaccacttcggccatttccatcgttgcctccgatggtggagataaccggatatatttcaaccctgcggtctatgagtttgtccgggttgcctgctccatctgggataaaccttactttgatgttttttcctccagtgccggagttgagcaatttattgcccgaaccaaacccggagagtacgaatttggtccgttaagaagattgtgtcaggatttaggactggaagttactgaactttcccatctttttacaaagttcaacaacccccggcaatttacccttttaatgcgtgcctatcgcgaaataatcgaatgggccgtactttatgatcttttaaatattgaaaaaccttttcctttaaagcaagtaattttcattcgtgatggcctcttacgttcttttgtttttaagtgggaagtctttgctaaactcgatgatttatttagaaagaaaatttccaaattaaaaaacctggggatcgaggcttctattgtaggcattgccaaacgaagtgcagttctaagccggttagcagtagccctggccctggaggaaacttttttccgtgaaggttcctggtacgtagaagtaccccgggaaatagaaaaagcctgttacgagggaattgaaagttacataaccaccagagaagacctgatagccatttctaatactactgcctaccaggcaatgggtaaactttttttagtaaaatttggtccagaaaaatattcgccggtctggccagtagacattgccgtctggcaaaaggacgcagccgataaaatattaggaaagttaatttacgatgcccgtcagggttttcccattcccgactacccgcggtcagtacaggaagctcatgaaaaagccaaaatttccaaaattgaaatgatcgttttacaggacgaaattacaaggcattacgccagtgcatttaataaaggtaacggagaaaaattagagcggtttaaataccttggtgaaaagttaaataccttctttaagggggaataaaatgctttttgaaccaaacaaagtaatcggtattttcaaaggttttaccgaaaaaggtcttgaatttgccgcagaattagttttaccttacaacgcttccatgattgaacgcccgcaattaggtcagtttatcttaattgaactgggctcggaaatagaagctgccctggggcgcattaccaaatttatccccaccgggctcttaactactcccgaaggggaagaatattttaacgctttaggccgacggtccgaacccattcccgaagatttaaaagaacaaaaacttcgctaccgggtatatgtaaagcttttaggtgcagtaaaaattgatgataacggaaaaatcgtttatgtcccatcccagcgcagacttccccatttaggctcaaaagtagcctggcccagtgatgaagtgttgagggaaatttgcagtttaaaccagggcaacaccgaaatcggtcactatgttctgggagagtttgtttattgcggcagtaaagaagaaccagataatcctatcttccgctctttggaccccaagcttcctataagctttgatataaagaaccttattgcccgcaggactttagtctttgcccgggccggctatggaaaatcaaatcttatgaaacttttactttctgaactttaccgcaaaacccctaccaccgaaaaaggtttaaaagttggtactctggtttttgatgccgatggtgagtatttctggccagaccaggttaaaaataggccggggctttgtaacgttccccatctggtagaaaaaatagttatcttcaccaaccggcctgctcccaatgaatattaccaaaaattcattgccggaccggttacccttaatgtagctgaatttcgtccacaggatgtaatccacctttgtattccaccggaaaagcaaaccaatcaaaacgtggtaaaacttcgttctttaagccagagttcctgggaacaaatggtagaattaattcataaagccagtttgcaggcccccgacgaaaaaattgccgaacttttaggatacagtcctgaacaggcaaacgtctaccaagccgaaatatccgccgctaaaagtaacatgtttaatatcataaaaactctgcaccatgaccccgacagtaatttaaccgaaggggttaaaaaagctctatccgaaggcgccctggtaatagtggacataagccttttaagttcctcggccagtgaaaaactggcagggcttttactcaaaaaaatcttcgaccacaaccaggagaacttcaccagcggccagcccatcatcccggccatagtagtattggaagaagcccaatcggtcctgggaaagaatctcgacgatagcagtccctttgtagaatgggttaaagaaggccggaaatacgaccttggtgcgatcttaattacccagcagcccggctccatagctccggaaatcctaagtcaggcagacaactggtttgtcttccacctactatcggaaaacgatgctcaaactttaaaccgttttaattcccatttcagtgatgatattttggcccatttaattggcgaacccattcagggcaactgctatatgtggagtgctccccggcagccttttgtgctcccggtcagggttaaaaactttgaaaagctctactccgcctcctgccagactccctttgataatactttagttgaaacagttattaaagccacacaggaaaaaacgcggaaaaagttaatcgctatttataacattcttttacaaaacaaaaccagatatcgttatgaccagaataccgtttccttgagggccgatattttttatcaccaaattgtcgaagcctttaaaaatcgtggtattaacgaaatcccttcatacgataaaattttagattatttaaggcggatttttggtaattctgaagtttaccgggataaaaacagcgacaatcaggatatctttaaaataaaccttaacgcctggaataaaaaaatagaaaaaaagcagtaaaaaagccccagattaatattagggccgaagacttttttaacctcattttaataaaaaaaataacattggttatcggcttttcaataaaacttttgctgttttaaaactatttttttccaatttcaatacctaaaactttacacccttttttaactatccaaatcctctcaggtcttttttcatttctaatttcatagcttaagtcggatccaaaaaatactcaaatgtcattaaagttaaagcgccaaaaattcggtacttcttcaggagagcctattttaaagttttatcatcaacaccagaattaagtaaatttctaatataacagaaaattccaatttagaaattcaaaaaattagcaccaaaaatcctcaacgttatattaaatattaagttataccattttttgttttggtaagttggatccattctgcattttttacattagtttcatccttatttttccagtacatctcatagtgattcttagtaaaactcattttgggagccttagaaacaaggcttccagaaatatgcaaaaaccatagcaacttctaatttccatttaccctgaatattcgcaaggaaattcaaacttccttttttaataataaaattcatccaggttagaatttaaatattcaacagcagcttctttctgtctttcactttttgcgttagtatctaccacaaaactaaccgtccagccttgtcgtgaaataattcccacaatttctcctctttttaaaataaagccttctcttttaggtaagtctggatttaaatagttggttcggcaggtgcgaacaaatggaactttttttatgattttgttcattattcttataaccagctcccggtcaggccagttatggtcctgcagtttttccacaaaaactttggacttttcgggaataatcggcggcagatactcttgccggatagtttgccagcgagatttcagggtttcatgaaatatttggcctgccgttgaaagttctatataagttttgccctcgattacttctctattaattaatggctcaattttttcatcaagttcctcatattttacctcttccagttctattaaatcctttgccccgttatccaaaaccgtaaataaataattgtatttcagccacaaatcctgatccagagaaaaaggcagtggcggaaaacttatgatttctgaaaattgctcatgtttgtagtaaacatttacccccagcgcttggccaagcattaccgccacagcaatctgcgctttataaccacctgtggcattgataaggcaattttcgctgccatactcccttagtactctggccatctgtttaattaaatttcttaacccttctcttctaaaacgtttgggttccttgtccagtaagccctctatcactactaaatttacctggatacccttcccatggtaaaatctttccaggattttaccgaccttttcgccatcgggtgtatcggaaatcagaaaatggagccggaaattttccccaattatacctctatatctcaattcaaagatagaatttatctctgccccgcaatttcggtcgctttccggaaagctggccaagatatcggcaaccctggcataatcatttttctcaagagcgtccaaagcaacttcgcgtaaaaccgcattttcaaagcgattaaaatttcccagaaggcttgttccaactgtacaaaggacgtttttcattctctttcctgccttccttttattttttgtagctatttaatttgtttttttgataaaaatttacaaactcttttaaatgctcgcttaaacgatttttaaacttttcagcacttatatcttttccggtatattgacagtgagccaattcatttctaaaaatactaactttatttaagagtttatatgctttcactaaagcttcctcagataagattttataaacaaaatccctgtattgttttacttcatcattccacttgtcctcaggtatttcaagtgcaatcgtagttgcaattttcccctgcaattcacgactattttgatctttttcatcaaagccatttaataaacaaagtgcagttataatattttctcttaaaaaagtatatccctgcataaccaaatcatgttctaaacaccaagcagttatatgattaatattctcaaccacatcctctgtaaagtttttaaaattctccttgattttatttatgatgggataaaacggctttaattctggtatttcatcataagccgcattttccagcatttcttttaaactttccactattccaggtttgtggttcaatattaccctttgcccatttgcttctatggttcttgtttctcccgctaagtctaatgctctacaagttgcaatacttaatgaaaatttattaatttctcttgcaattttctgcagcaaattattgtttctttttacttcaggactttcaattgacttaaaacctttttgagctaaagcagcaattcgaccagcattcccagaattaagaaagctatctgcagccaaaacccaatcagaaatttcaagaaaataatttaaacttattacaggagctactctgtcatttacatcaggatatttttcttctacttcacgaaccgggcccagtacttcaaaggctccataataaacacctaaaatattaacgttttttaaaagtctcgtataatttaaaattatccctgttaaaaaaggtaaacttctaaagctgtgggtcaaatcaaaaaccaagttatcattttcttcaacttcattgtatattttagaaaaaatttttattatctcattttcaaataacccagaaggtaccataacattccgaaatttaaattttggatttctttgctggtattcattaaacacttcaactaacccaggataaccttctccttttaaccaatttttttcaaaagcttcatcggtagtaaaaattactgcttcaatttcataagaaaattttttcgtcaataattcgactaaagccatttgaataaaataactcggacttgaaatctcctcttcaaatttataacgacaaggaatatatttatttgtcccaagaaaggaaattaattttactctcatcaagcaccctactcccctaaatctgaatctgaaatttatcctcttaacataaatacaaaagttatacaagaactatttaacctcataaactttcataagcctttttatactttccaccatctcccgccgtaattctcgcggttcaattacctccaccgacgaaccaaaggaacgaagccaaaaaagtaaatcgcttacccccgtaactttatcttcccaaagtaagcttccatcttccagaaattttaaccccctaaagccccgggcttttaattctctttgggctttctcaatgacgttagcttccggtaaaaaacgaatttttaccttgacttcttcgccagcatccatcccccagcgatttttgaaaaaactttctatttgaaaaccttccggaatttctgctttcttttgctcgaataacacaccggttatgcggtcaattctaataatttctggcttgtaaaatttttgttcttcaaatccaaccaggtaccagaagccatcgtgcttgtaatatacaagcccagcaggattaaacaccacagtattgtttttactttcttcagaaatcgcataggtaatcttaatttttaatttctcataaactgcagtttcaatcttttgcattatctcctgttgttcctgagatatcgtcaccccaggaatccttttgtgcgtataagtttttgccgttttagttacccaatctttttcttccttgcgtattttccgggcaaaaatttttaaaagtttttctcccgtttccccggcctcctgaacaatcagcgtcttttcttccgaactaagctgcaataccggaatttttaaaccatacccttcacaaattacaacctcattttctccatcttcatcaataaatatcccggaaaactcatttaaaaattcatgggcagaaacttcattaagaaaactcctaagcgaatcttcagtaacaccaagaagcagagcagcatcctctaaacttatctcctccattgctgcatgaaagtttattacttttataagttctttaaactcccggctattcatccgcctgcacctccgggtagagctccgccaatttttttaatgtttccctgtatttttcaatcaaggaagctggttcaaaaattagggcgtcagctccaaactgtcttagccagcttaaaaattcttcaataccacttatgtaatcttcaaaaataagattcccggccgaatcaaaataataattgcaggtgggatgaactatttttctcacctctaaaataggctttactctatcaatagtatttgcccggttataaaaaagaacttttaccttctcttttcgacctgtgccaattccccaaccgggggctaccatggctttaacacaagtttctacctctttaggaatcggctcttctaaaacttcaagttgttcaatccgatcaacgcgaagttttttggctgcctctctttttcttataggcttggcaattaaataccatgcctgattgttttggttatacacaaggccaaggggatagaaaaattgttcttttcctttataagtaacttttattttcttttcttcaaaaagagcacgactaatttcgtttttaatcattattaaagtttcatctacaagctcccggggaccatggtagtacctgatttttcttctctcttcaaaatattcttcaatatgagtatcaatcgtatagataaaagtattgcggtaagcttttaatttatttaaaacctcgcttaaaagaggattatattgcatataacgatattttctttctaactcccttattacttcatttaactccttcttaatgcggtggcgatagataggtaaaaattttttcccaagttgataaacttcatcttttttaagcaaaaatccatgagctgcaagctctttaaaatcattttgcaatgtttcatagctaaagcctatttcctgctcaaattctttaaactttttctcaagttccttataaagttccggaactttgacttcccttttctcagccactatcgccagaagccaaagctgccttatatcatcactgccaaagcgcaaatcttttcttagataagatgtttttcttcctctaaagagatacttccctcggcggagaatttctataggaaatccctgtttaattaattctttaatatcattgcgaattgttcgctccgctgataaagggaaatttaaaagctcggtaatttgcttagaagttaattcctggcctgtatgttgcaaaaaaagttctcgaatacgtgcctggcgcatttgaatctctatgtgttttgccacatttcatccctccggtttttttctttaccggagaaatttgacaaattattagaaaatcctgcttgcttcctcttattttatcgccatataattaagcttttaccaattcactaaaacgttcatctctgaaaatttctaccaataaaacaaatgccccgggaaaagaaggcgaaacccggggctatgagaatttttaaggtttacaaataaacaatttcccctggtatgtaaggattgttttcctgctcgctgcgacttcttcggtcaattagagcaattgtttttaccaaaaatccttggttctccagacgttcggcagttttttgcacaaggtattgaagggctgtcgtacctccggtgatattaactactatttcagcatcgaaatcaagcaaatcttttaagcttttccagaccatttcggtctcgtgaaaagatgtaaaagggtcgtcaactataaatacagaatatcctcccatataccctgccttttccatgatatcaagaagcctttcttttcctttctcagaggttaaacaaaataaaaaatccggctttacatgataaagcgccgaataaagtaatcccggagacatgcccaagggtgagattagcattttcatttttctttctcctttcttcaagcttttcagattctgaatgcaaaaaacagtatgctttaaaaaagagtcggctccgcttctcccccgtcatacttcccgattaacaggggggagtttgggtcatgtttttcgtaattttttttccccgcttcatagcttcccgcataacagtatttacacccgtgcaggcaggtatcgtaaacgcctacatctttactgaccacacaaccgcattcctgccgctggcttttatcctttaagtggagtttttcgggtaaagtaagagaaaatactttttcaatataatccgcatcaatgcatttgcctggcatgatgcctgccgcaggaagataggctatattttcagcgcagctctggatttctaagcccaatttttttgcttcttcagccataaaataggcaaaactctttattatcacttccgggggctgataaatctctattccttcttctttcagcttcttaaagtttatggtagctttacggtactcatccacaaaacttatcactacacgggtggtaaaatcttttaattcatttaaaatatacgaaaacttctcccggtgatagtcactgctgtgaacattgctgaaaattaccgggtcataccgccagatgactttttctttgccgattttttctgaaagctttttaaaagtttttattcgcttttctacggacggtaaaaagggctccatttccgggccgtagccatttaaagtatattgaaaataaaagcgatagcctctatcctgcagctcatcaaggtatttcataaaaggagcagggtttttggtccagaaaacaatagctgtaacatcttcggggcgaagagaaattttgctcatttgtttagcattataaggatttttaaaaataaaatacccttcccttattctattcataaaccattcgccgtaaaaagccggaatatcagtccggcggctggcgctgataatctgcattagaatcatactccttttttaatagtttatcatcgaacttttgttctggtcaattagagattttgcttaaccatttttccgcaaaactaaactgcagtattcacattttatcgcggaattaagcgattacttccatctaaaacttttagtacttcaattccatccagcacaacttagaaaaccatcaagaacccataaaaaatgccctggaaaacttttaaatccagagcattgatttcccgcaccgttaccgttataatttcccagcaatccggtcagcgggttgacacctttggccatttccagccggattctggtcatagtatcaaggagagtctggaccgatacaatccctttaaacagctggtttctggtaacaataatataatcgtaaagcttgagtctattccggttcacggcaatctgggagactatttcaatgggagtatcttcctcgaccaccagaggagaagtatccattatcgctgttatcgggcgctcgaaatacagaggtaccccatactgcctccccaggtagcgatcaagacggtagcgcatcaacaatcccaccggtttttccacttcaaccaccattttttttacttcccgcaccaaacagtctttgcggacaatttcggcgttttccgtaatttctccaaccgtaaaggcatgcttccagccattgtggcgtcggctggaaacatgccgcagtaccttctgctccaaacttttatccaggttggctttcggatagacaaacagtactaataaatgcctcagtactgtcgaactccggtacgaaaatgacagccgaggaccaagaaaaagagaacgccgcttaacaaaagaccctatatcttacggaactttcttcgtcaatatatttatactccggtgggcattgatttctaatagtcagttcgtttcaactatttacgttttctcatctttttccatatatcttgaaagttttctacgaactttataccaaaagcatttattatattcataataatttttataatcatcacatttattaatataatgattatccattttaaggtgtaaaccattccattattcatcattattcatcctttaattttttatggaatataagatgtgccaaacttaatatagccttttacattgactgagttaatcagaatgccacctatgcccttaataccaaaataacatccaacaatataatcatagtccatttgtaaatatgaattgctctttgaaggattaacacaagtatttgttaatttgcttattttatctatttgccaccagtaaagagaaggggggacgctacttcgatattcgccccgtatgcagctgtccaatattttgttgtaccactcttataatatttcccggtggcagaatacttcataattaatgagaaggtgatttgggcattatagcttacagttgcagtaccggtagtagcggtagtagcctgagtagtgatatcattagtattattgctattttttacattagtaccattatcagcacatacaattattgtcttaggcagttttttagcctcttgaataaccatttcaaggtttcgcactgttacatctctaataactggtatatctgtttttttgacagcacttggatctaaaccgtatttttcaaaaatatcattcatattatcttttgtgattacagtatctggattaaatgttatttattgttgaacggaatctgtagtagtagtggttgacgcaaaggaaatattagttcaattttcagcttcacccccaatatcggttggtgtgatattttgtgatttttaaagatatcgggggcagtcgctcacgacgattcatcgtcgcctctttcgtcaaaaattttgatttacacctttcaatcccagaaaaaagcacgaatagcaggttgattaataatgagccccggtcattccaagttgtggctgttgttcttgggtctattttttatcaatacgcatttgctccaaaagcaatatttataaaaaataaaaccaaaccccggtttttcccggggttattaaaatttcattggtggaatatgttctggtcgttcaactacataatatggcccgctaaatcctttccctgctacatcaattacaatatattttccaacactaatttttctataattttttgaaactctcatgtcatccattaattcatgatttggttgaaggttatttatttctaattttacatattccagttgtcctctcattgcagttaataaaactattgtatgtttacttccttctactttataatcacgaacataaccataataatcgtcagggttatttaatcctcttggtcctgcaaatgcatcaatagttaattgttcttgcggggtaagatttttctctttaccttttattaattttatcaattcctgttcattgtttactttaacaatttttatgtttggtaacggatatggtggattttttaagaatgcaacttttacatcaggtttatcaacaactatttcttcgtttttattttgttcttgcccgtttccgttattttgcacattattttgtttaatttgattttgcacattattaacgacttgacccacattatctttcaccgcatttttaattttttccgcctggcaaccgcacccgctggcggttaaggttaaaactaacactcccactaaaagtaaaactaattttagattacccataactaccgaactcctaaaattttgttaaaactgttactcaatttgccaaaccgctgaagatacttgagtttcaccagcataaaagatggcttattctccccaatcctttgttttcctgctttactttttaatccattaagaatttaatccattaagaattttttacctccacacacccaaagcccttgtaaatactttttatcaaaaaagaaaaacaagcggtcatcggccggaagacggccgaaacctaaatcggttctcctaatttttcagcttttaaacgctttttcaacctccccttaatctcctttcgaagcgggtagatacgggataagccttgctgccagattttctatgggcagggattgcagccataccttgcccggccccttcaacgtagcaagaaacaatccttcaccgccaaacagaacattggtaaacccttttaccatttcaatctcaaaggtaacagtaggctcaaacatcgctacatggccctggtccacctttaaaatatcattacttcccagttcatattcgactactgctccatcgatttcaacaaagcaaagacccgggcctgttactttctccagaataaaaccttctccgccaaaaagaccgctcccaattttctttctaaagaaaatttccaatttaacactgctttctccgcataaaaaagcttttttttggcagatgatcgactggcctgcctttagctccaacggaataatttttccgggaaatgacgaagcaaaagcaatttccccgctatccctagtgcaggtataagtggtcataaaaagcgtttctcccgccagcttacgggcaatccctttcagtaagcccccttccatattggtttgcatttcaaaaccctcagacatccacgccatgccaccagcctgcgtaaaaaccttttctccctttcccagggttaaaattacgaccggcaaagtctcccccacaattttaaaattcatagatacaccacccttatattatttaaaatctcccgtataattttttaaaattattttcctctaaacttaccaaagggctcggtcaagttcgtaaattacataacggcgagtaaacatacggcatttgacaaccatcgtttcaccatctttttcgtaaaatattccagaccccagtcgatccttaaatttccaaccatactttgaaagtcgttcattgagaagagattcattatattcacttttagcgatatattttgagccgtcagacgaaataagggctattctttccccaaaaaattcaaggcgtgctacgccaaataagactggaattgggtttccttcctggaataagtagaagattttaatatttagagtaacaattaacaaaattagcaaggtaactaaaatcaaaattatctttcttttagcttttattcggttagaccgcactgataacatttccccttcttacccctatgtaattattaatggctatggcttttgcttaacatctgtaataagccatttcgttccacgcctttcaatcgtaagagttatccccatccgcaattcttctccaggcacactcgttatctcaacaacatccccttcaaagataaacttatttttatttacccttttcatatttttatattcaattcggtccggccagggactggaaacttttcttcctaaagttaattaatttcaaattcacaggttactacagctgtaatttctttttctattgaagatgtatcaaatatccccatatcagaaacatcagtggaatatggtgctgttatttgaaaaacccccattttcgatgacctcaattttccaacttttactcctgtaaactttgcaatctgttccgccctttgcatagcatcctttgtggcaagccctaacatccccgcaaagatctcatctcattatccttaatttgactaaaataacaccactttttgttaataattcattttgccacttataacctatttttcataaacattaaccatgttggacgggttgaagttgtcattaatatttaaattcttcatcccccgtatcgttaggcagaacaatataatacacaacaccataatcccacttccccaccctcaccgaaaggtcgtcagcgccaggtagtacactttacaccttaagcggtacgcatgtactctgtgaaccgtacacctttaccgcattagtagccttgcaatctcaaagccatcttaaaaagcggtcgacttcacccttcgacctaaggggacgctctcaacgactcttccggctacgcctaaaaaacattataattcttccaccaattcgttagcccagttagctaactggatagaagcatctaattcgcgatatcttttggcatattcatcagcacgactacgccatacagcaacgtctatcgtcggtataaattttatttccgactttgttattcgccattcacgtgcgccaactgccgcatcagctacttctttagccgtctcatgcaatagtttaagcatatcacgttctacaattgcttccatcaacgttcttccatcaggtagccttacggctatatttgttttgttaatggcagtagttattttctgcaatttttctacaagcatcagtattttttccatcaactgttccggattttctgcaggtgcatcgccttcttgaactcttgcatcgtgacacgcacgcgcacgtaaagcagcaatttcttcttttatccgttttcgttctaataatgcttccgcaagtttcattttatctcccaacttgggcaatcatctcccaaatcgggaatattccctcctttctaacccggatttgtttttaccttgcgaagataatatcaccgccgacacacagcgccaatccaaatctaagtttcattttctccatccctcggattgtgtgcacttcaaagccaaaagaaacgtctaatcggttgttcactcgttctacgctggtactttttttgtcaacagcggatttaaattgacccattttcaaagtttttaaattgacctaacctggctttttttaaattagctttgatatgtgagttactgtagagaccggtttttaacctgtcctttttcatcgatactaggctggaaggtaaggttaaattgggttagagtctttttatacggaagtcgggcgagttgtaacctttttaggtatggggctttctttcaggaatgccctctgctctgaggtattttctaaccgtatttctggaatgacctgtttctcgtgcgattgcacaaatactcttgcctcttgcttttaattcatgtaacatgataatagatccactcccgagcatttatttccctccgatcctttgctgtggtctcagagggatatttcgccagggggtgggtcatttccttttcgttgctcccggggcaattatacaccggcggtgacataaggtgtttttgcttgcatttagtcccccaaacactacgccgaataataataattttctgcatttgttttacaattccttgttatttgcgacaaatactttttgacataattcgcatatttcgacacttaatccccttttacccctttttaacagcaaaacttctcaattccgctatccgcaaaataaagtacccccaatatctctccttttataatctaacatgagctgccagaaaaactttttccataaaaaagaccccaaagattttctctttgaggccgcaactttaacacctaaaactcttcgctattttttattttacctccgcacacccaaagcccatgctgtttttctccccaaagcccacatcgtagccaaaagcaataagctctgctgaaccttccaccgtaaaaggagctaaatagcctaagattttttgatcccggtagtggataagctttgttcctttatttttttgtaaatattcctcgtcaaaaaagaaaaacaggcggtcatcaaccggcaaacgaccataataggttgcaaatttacgcaaaagattttgccggattttttccgaaaaaagctccggctcctcggtatacctaatgtaatatggtttcgtatagccttctttaagagtgctaaccactattggagacaaacaaacaaaagtctggccaggctttatttcgggattttctctaataaaagcaccttttaccgtaaactcttcccggccaattataaatttatggtctttaaataagccatttaaaagatgaagcaaaaactcataaaggggggaactaatctttaaagaacattccccaattatccagaaaccatccggtgctaactttttcctcttggctaatatctgggaaaaagtaaaaaatttaaaacgcctctccccaaaaccttcgtcatgaagctttcgggcaaattccggtgatgatttggcaatagtttcataaattgctgaggtaatttggtactggtaattaaacggtaaaaagaccgctttctcccgcggttttaaaagtacctctatgcgcataattttcctcccatccaaaaattgttcgattaaagggctcgaaggttaattcttcgagccctaatctaaaatccttaatttaatccatcccgtgggatataaaggcttccctttctccaccactatttttcgggttttagggaaaggaaagttttcccggtattttatcttggcccagttaattacttcctttaactcctcttccggaagggcttcttttaaagtcttactgttaaagccagttccccagcctaactgcaaaattattccgtcattgctatcctgaataagtttctggtaaaactttttaagctcttcaagaccaatttcctcataaaattttagttcattttgtaaaaattgccgctgaacctctttggccctctcctgccagttattaaaaaatgctttattcaccagaggaaagttatcatcgttaagatacttttcctctaccttaaaacttccctgaagcttaactcccggtttaaaaccaatgaaaaagctgctggtagcctgctccaaatctgctgtagattgctctccaggtagaactttccaccggtaaccactggtcgtaaggcttaacacctttacctgataaagccctaaactttcctcccccaggggcaggctgtcacctaccttaagagcacggaaaagagagtaattaggggttccggttaaagccatttccgctgcttcgcttagtttctctttcttgatccttggattttgcagcctttctttaattttttggttaaaagtttcttttatttcgggtaaatttattttatagattaacgtcctaagagaacctttcaaagaacttccgggtaaataaaaaccctgcccttcagctacaggggctaaaacttccgctttgcgaattttcaggtccattaaagttttccttgaactggaaaatttaaaacgtggaaattctctggcccagggatatgactctcccagaaaaaatcccggtcttttaaccttatccaaaaaatcgtttaacacaaaccttggcgaggtaaatacccgctccatatcggcaaccacaaatttttcttcttctaacgaaattaaatattccaggggaggatatttttgaccggaaccaacaaagagcggagataaaacctcaatttcgtatgttgccacttatatcccccctttccaaggaagggtaaaggcataaccgtaccggtataccggatgctcggtaaagtatttgggagtaacatctaccaaacgtcccactggcttaaagccaaagactgaacccggtccaaagaaacgtaccgatttttttcttaccccccggtcaaaactgctaaacacatatccccctgactcaactagggtgtaggcttttaccccatctgcaatcttaagtaattcatcttccttaggataataatttgaaagtaaaaacctatattctccttgaagcggccaagaaaaatcttcccgaaactctatggaaaactggccaaagccgtaggtcctctctcctcccagtccttcatccgccagaactcttaaagctgtttcaaattttgttttccactccggtgctatttcatagaggaaatatagataaatattttccgcaaaggttatacccgtgcagtaataaatgttggaactggaagtaatccggtctaaggctacccgaggaatctcccggctttggtgccagtactcctgctttaccggaagatatgctttctgaacaacatacccttctcccggcccttcgcctttagcaattttttctaagctttctacgggtaagtattctattttttttgcagtttttacatccgtaaaataaggagttaaatccaaagtcaaaggcttaggaacaaaataatatactttttccccggtaacttgagctggaaagagagaagaaagttctaaaaccggtttttccaataaagcttcgaaaaaggccttcgtctccccagccccataataaagggaataagcatttaagagagccgaaaacagctggtcgcttcccggcaagattttactattagttagatcccctgttctcctacccagatttagagggcctttaggcttaattagagctattttgtaggccattggcttctcccctttacttcaacaattgcggaatattcttctgcataagctcctctaaagaccccattactatcggttgagcgctaaagtttccggtctcatattcctcgcgagacttccagtaaactgctaaatctttaaacataatctttccgtaacctcggctgccggaacctccgagatagtcatcttctaaaagcttcattgcagttaatactttagaaaacagctctttatcttcttcccgcaaaacgttataaaccagttcaaagcaaaactccgctccccgcggtactctttcggtctgccggggattagccgccgaagtaatccggtcaatggagttttcaaatttaacctcggtccattccaaatcaagattgggcttaatgtctttaatgctttcttcatccaagcaggcatccctgaaatagaggcgggtgggggtagcgttggaaatcaccagctcagtctgattatcagcaagagtgtatttcccgtggtttctaccaaagataatacataccggacattccggttcattgcaaatatgaatgcgaattggttcagcaccttttttctgtaataccagtttggttgcactcaaatagccttcgtgattttccagtaagctccgaagttttccttttaaactggatcctggaatatacggttttccttcctcatctttaataacgctattgtcaaccccaccaatttcagtattcccctgggctccacctatatgaaggccggttaaagctttgattttacctttaattacaatttttcctaaaagttttaactcttccatccctcatccctcctattctttaccgccataagcccggtgataggcaactacagcttcaaaaaaatcaataaaccgtttaaatttctcatagctatcaatctgggccaaagctttatcggcaattttttgcaaatctctcacctgactgtaccgcccagcaatatacgcaaacttagcccggagtaaattaacccggtaaggaccgtcggaatctttataattaatagattttgcttccgtataaagatttctaatctgggaagtagtcattttagccacccgggctaaaaaactaccaagcttctccgcacttgaaattaaaagctcccctttggggtcttctattggatttaaaaacttatccactgcttgcagtacttcctggacagggttttcctggttttgctgtcttccaggattggctctattattttttccattcatcattaatcccccctcgctcttagttctaattctgcccaccgtgccgccggtgaagctaaaggattgatttcggtagtattgaataccaccacatccataatcttttcgcggaaataagtttgtaactccttcttaagactatcccggtaacggcttaactgatataccaggcgccacaccttgggataggatgcctcccgttcgccagcatttagaagattttttataccgtatagatgctggataattgccctggaacctccgccttgaactactttcttaatgtggtcttttaatccttgtaaccggctaaactcatcccaggtataagccctgtctaaaaaggcaatcttatctttgctcccagttttagctttctcctccaaaagctcataagcctcttgggcaactttaaagagaggatgcttaaagtttggggcaagcttgatggccgctgaaaaagttaaatcgcggttgcctgcacagtaaagggtaaattgccgccttaatttcaaggccaccttgggcagtaccgaccagctgcccaccacaaagaaatcatctcctccagcataaacggtataaaccgtatctccaaattcttttaacaaatcattaaagtatacgccaaaaaattcacccatcgccctggataaagctgctatcgaggtaatggttattttatcagcaaatccctcacggaataattttcccaggttatccacatctccccgaagaactccccaggtatctattccttcactctttttagccaaaacctcaaactcgtacgcagcagttttaggtgcaaaataaaaaccctgacaattcttaactacaaaatcataactatttaaaagtaaattaaagtagtcctgctcaggtttatcagaaaatctaacctgacgtccaagggccaggaaaagctcatttatattgcttatttcgttaatactgcttttttcaactacttttttctcctgtaaaatctcagtcctgggaagttcagctcccatttccacaatactctgacagaaagaacaaagccctgtttcgccagttacttccctgccacaaatgggacaaatattatccggtgtatcaaaaggaccaaatattaaatctggtgtctcttttattagagttaaaaacggtttcattttttcccggtttaattcctgccccaaatcatcccagcgtttggtgatatttccctcagccaggtcgtttatcgtaagcggaatacttcccaggataaacttaagtttaccgttaaaagcctgataaattattttttcaactcgcccttttatttcctgaagtttttctaaatcagaataaggaaggagtaatgtgaagcggcccccgccaattagaagaatgcttggttctaaaaggcctaactcttcaaccagatagagagctatcagccggtttaaatagcctactaaaaaagaacggcccctgaggtttttagctgcattatccaagggaatatcgtacaagaagtcctgaatcccggcgatatcgccacctaccagtaagaaatagggcttttgtaactcggaagcctgataatttttatttttcaaatgctggtggattttttgcaaagtcggttcgggtatatcttccttatagagagcagcagcaatagcagcagtagttctggcatggtcatagagggagatggtagcccgggagtagaacgccgcagaaggaataagggttaagtatttttggaggagatacaatgttgcattgagattatttttaacttttgaaaattcctgattaaaactatcccagagctgtttatagccattgccatttagggttgcttttcttttatcggcaacgggaaaaggtggttcatcaggttcatagagctttaaaggaatgtactgttctccttccgctccccggcttaatttaatgcgggaaaacagcgaaatcagcggttcgtcggcaacatttcctcccggagattgatcctccctttctccggcggatagtttatcggcaattgctaagatgtaatcatcttttgtttcagggtcatggtggtttgcaaccagggccaccagctcttcgctggcaaagttatggtggacaaaagtgccggatagttcctggtgttttatttgtttattttctgcccgctgccagaacttcccgatatcgtgcaaaagccccgcccagtagatattttcaatcattttccccctcctttcgtcagaaattgtgaatttaatacatttttataattctttataaaatttgtttttcctcttttggcattatttaaaacttttggtttataatattttttcaattcttcattttccggtaaatcttccatactgcaattattcagaatttctttgattttcttcatttttgcgtaatgatcccggtaagctaaaaatttacttgctgtaaaattcattttatgggggtaataatgaacatgttttttgttggcaattaaaacctgctgttcaggctttatatacactatctcggccaccagcaaaaactttctaatctcgttttttcatccaaaggaattttctgtaaattgttacatctataataacatatcttgccgggttacattcgtcatccctttgttgtttaaaaattttcatgattattttacaaagataagtcggaaaaattttttccaaaaataaaaacgacccgaaggcaacactgcctccgggcaacttcctttttaaatgctttgattaaaacgttccaaagcaggtcgttctcctcggccatatttcaatcccagattggttcgattaagactttgtatttttttccttacttgtatattcgctttttaggcataagatatattaagcatgcattcatgatagttctttatatcatagtcactttcactaaaattgatccatggcttattagaaaccttttctgccatttgatacttacctcccataaaaaggcataaaaataccacctcaacctgttcggctgggtggttaatggaatattactttaattttcgtagctaattccttaattggtatcccgtcaattttgaactcatttaagaattcctcaattgtatcatattccttgtgtgtctcaggcttatcgtattcagcaatgtgaactttttcaaaataagatagcgaatagtccttcccgttatattcaaattcaatttctcgaatagtttctaagtcttcgataaactcttctaaactcctataaacatcatacatcatttttcatcactccaaatgtcattcaccttttcctttttccctggttgagtgtttaattattcgccaaaccacttcgctaattttatcttcctcgattgtttctaactcaccatcaccaaattctacttcataagctttaggcaaatcttttacatcaaaaacatgaacaacagttccctcacgcccatccttagttctgacaacatcaagctcgtcaatcttctttattcctccctccaattattcatccacatagttttttactaaccaaaacttacctgtttatttaccttaatccacggttacctctattgttcccaacattagttttttccctttaatactgcagtaaattacttaagttttctatagcatttttttatattatcctgacccatacccagccttatgatgcccccagtaaggggaaaattgagcggttctttggtacggttaaaactcgtttctttcctttattgaaagaaaagccggttacttctttagagaaacagaccaaagctccttttactaaggaaatcaaaaccgctgactctttcccttctgcttcttattccgaagcttcggcccgacttcttcatctttcaggccttcctcatcttttagataaacttaccttaaatcagaaaaggcctcttgcccaaagaatcgccatgagttataaggttaagcctttaacccgggaagaggttgcaggctacacccagcatcatatggagcttgcaggagctaaccataatattttttccgagcctgccatcgaagctattgcctctttatcccgggggtggccccggcttatcaataaactcgccactcattgcttgctttatggtttccaggctaaaaaggaaatcattgatgctgaggtagttaggttagctgctcaggatactggtttctaattttgcccggtcgcacttatgcggccggttttctttttatttttctctgctaaaataccgtgatattttgcaaaaggttatactgacctaccaaaataatttgcaatttttgcaaattacagcctacttctatgctattttattttgaaatattggtgcccaaataatttgcaagttcacacgtattaaaaaagctgtagggccatacgtttcaatcccaaattggttccattaaaacaggaggatgataatcatgttattaagcgaattgcttgtttcaatcccaaattggttcgattaaaacctgaagcaatccagaagttggcggaggactttgaaagtttcaatcccagaatggttcgattaaaacttggttttcccatactggtcggtcatgtcagtttgaggtttcaatcccagaatggttcgattaaaaccaaaatcacctccggaccgcaaagcaaggtcggtgaagtttcaatcccagaatggttcgattaaaacgtaagagtctatttagagcaggaaaatgggtatttaggtttcaatcccagaatggttcgattaaaacggaatttaggtatatcgcttattatatttctttcttgtttcaatcccagaatggttcgattaaaacattgaaggactggttttcttcattaaatttagaagagtttcaatcccagaatggttcgattaaaacgcatttgccaataaatcagtaaagttaacaccttggtttcaatcccagaatggttcgattaaaaccatatggactgcttaaacaagactatcagcatgcaagtttcaatcccagaatggttcgattaaaacgtggtagctgtcgccatagtccgcgtttttcctggcgtttcaatcccagaatggttcgattaaaactttttgaactgaccagcaggagagtggattattcaaggtttcaatcccagaatggttcgattaaaacaattgattaaacaacacgatttattgccagttaaatgtttcaatcccagaatggttcgattaaaaccaaaatctgcgtttcagggctggaaataattttcaggtttcaatcccagaatggttcgattaaaacaaagtcggtggaccacggccgtataaacgtgggagggtttcaatcccagaatggttcgattaaaacattccacccggaggtgctgagagttgatattcttgagtttcaatcccagaatggttcgattaaaacagagctggcgaaaacaagaccgaattgattggcagaagtttcaatcccagaatggttcgattaaaaccctaccgtatttatctcgttcttggacgtctttctggtttcaatcccagaatggttcgattaaaaccatgccggcaggatacagctcccgatgccgggtgtggtttcaatcccagaatggttcgattaaaacaaagttgggtatgtattggacggtattcggccgtagtttcaatcccagaatggttcgattaaaacataaagactttcacaaaccgacaaggtgaaattatagtgtttcaatcccagaatggttcgattaaaacttcgccagcggctttcttggttttcttttcttttacctcgtttcaattccagaatggttcgattaaaacctgatatgtttaagcagtttttagggaaggtttggcgtttcaatcccagaatggttcgattaaaaccagaatatagtaaatgaattagaagctaataagcaagtttcaatcccagaatggttcgattaaaacttctacattataaccataatcctcaaataatttttgtttcaatcccagaatggttcgattaaaaccaggttgtggtctaaatccatgtctgcgactatatgtttcaatcccagaatggttcgattaaaacatgggagtttgaggtaagcaggcaggcggtaaggatgtttcaatcccagaatggttcgattaaaacttaggtggctttaatccttcggcctgccatagtttgtttcaatcccagaatggttcgattaaaacccaagtacaatcagcggctttttgaacacctcgcctttgtttcaatcccagaatggttcgattaaaactacggtagactgtaaagtttccaattgaaatatcattgtttcaatcccagaatggttcgattaaaactctggtgatgatatgatttgtctttttgttactgagtttcaatcccagaatggttcgattaaaaccttaatgctaactgcaccttgttaacccccttttaggtttcaatcccagaatggttcgattaaaacctcgccccaatcgtgcaaggtcaattggtaaacgttcgtttcaatcccagaatggttcgattaaaacttttgtggaaatgttgcaaacagtgaagggtgtcaagtttcaatcccagaatggttcgattaaaactccaatcgtaatctttcatatattcacttcttggagtgtttcaatcccaaaatggttcgattaaaacccagtttagcataatattattatcttctactgttccgcgtttcaatcccagaatggttcgattaaaacaagaagaagccagggagtactgggcaaagtttatgcgtttcaatcccagaatggttcgattaaaacttctttctggtgctgggtatctcattgcacttttgggtttcaatcccagaatggttcgattaaaacagtaaaatagctatttgtacatacaatagccccattggtttcaatcccagaatggttcgattaaaactacatgtttgcttcttcatcttcgaccatcttaatggtttcaatcccagaatggttcgattaaaacgaatcattcaaaagtaaacaacttgcagaaattgcttgtttcaatcccagaatggttcgattaaaacggtttatgtaagtattaataatttgctggtaacgtagtttcaatcccagaatggttcgattaaaactgccattttttataaagaattttattcatctcttttgtttcaatcccagaatggttcgattaaaacaggcaggtaatgggtaatgcagcttgaggaaaaagtatgtttcaatcccagaatggttcgattaaaactgagaaaatttcttacgatgaaatagcaagaaatagtttcaatcccagaatggttcgattaaaacgaaaaccgcatgacgcaaaaagaactggccatgcgtctgtttcaatcccagaatggttcgattaaaacaacacttttgagattactacttctgtatattggaaaatgcaatcccagaatggttcgattaaaacaacttggcttgaatagcgttactaaaacagttttcaggcgcaatcccagaatggttcgattaaaacaacgggttcaagggaagtattaagccatttgaaaataaggcaatcccagaatggttcgattaaaacaacttagatgaaaaaaacaagtagtgaaaagtgagtgaagcaatcccagaatggttcgattaaaacaaccatactggccgaattgtagaggtaattaaaaaaatgcaatcccagaatggttcgattaaaacaacgggttcaagggaagtattaagccatttgaaaataaggcaatcccagaatggttcgattaaaacaacacctcacaaaaaccatccggtttgtttacttccgaagcgcaatcccagaatggttcgattaaaacaacgataatcgggttaaacaagctgtctataattctctggcaatcccagaatggttcgattaaaacaacttaacgggactaacaaatacacggggacagcttacatgcaatcccagaatggttcgattaaaacaacgttgtgtattctgtcgctcctacaccaattcttacttgcaatcccagaatggttcgattaaaacaacgtatatgtccatcgtgatttgaacgcttgaatgaccgcaatcccagaatggttcgattaaaacaacgtgccagcagcgccagcatcaccagtggccacatcagcaatcccagaatggttcgattaaaacaactgggactgcttttttatgtattgcgtgagaacgcagattgcaatcccagaatggttcgattaaaacaacccataattaattataaaagaaaaagatttttaaagaaagaagaagtttacatttttcaatgttaatattggtgcatagtggtaaatttccactaaacgcttaattctcaaggcttaaaggctatttttgccctttcgtcgaccttcctggattttgggggtaaccgcaggtcgacgaaaaaatttgtatattttttagtttatttgcataatttttcgttttaccggtgaaattttggccttattaaggcatttattcatagtatatgcacttttttcgtcgacctcactaagctaagttcaatatttcacataaaaggcataattaaagcatattggtttcacctcctttttgaatacccaaaagctcccgggaagaatatttcatggaaccaaaaatataaaacagcactgaatcctcatcttgattaattatcctcgaaagctctccttttaaccggcgaaaatttgcttcggtaatttctccttccaaaaccgagttctgcacccagtaaagatattttcgagccgtttttaagactttggcaactcgtttttgatttacgtcataaaccagaatgacaaacaagctaccacctcgaaacaaaaggttcaaagggcttttctcccagcaaatgcttttccagtttatacagttctaagcgaattaaaaagcggtacgacacatccctctttaattccggatgtttaatagtggttttcaatttttcttcaaattcggtaataaaaagttttttcccttcagttgtcagagcaaagccttctaatcctttttcaaaatgctcttttttaatttcttttcgtccaattaaactaaaaattgtcctatcaacaattatgggcttaaatatttcggcaatatctaaatttaaggtaaagcttcgaaaattggtagcatgtaaaaagccaatccgcggatccaaatgggttttataaatttcactaaggacagcagaataaagtaaagaattgccaaaacttattaaagtatttaaataattttggggaggccgacgggttcttttttcatataaaaaagttttatcctgcaaaattacgtcaaaagcttgataataggtttcccggatattaccttccaggcctaaaagctcatttggctctttcgcctccgttaccttatttagatagttctcaactaactcaacgttactttctacctcttttccccgctgggcataatactttaatacctgcaaaatattgcgagcactcccttttactattgcccgtcctaagaatattctcttactttgatcggaaaaatgctccgcctgctttaaaatcatgtagcccgaattataatgctcccggggataaaaagttcccatgtagtagccgtaatgattaaaataatggaggattatttcgttctgggataaaaattccaccagtttccgattaaattccacttcaccgaaaacaaaaatttctcccacatcttccaccggcaggtactttttgagtccttcactttcaaaataaagggtatttccttttcgctgcagttttccatccgaaaaaaggtagatagccttacgcatttctcccctcctatgctacacaaaactcaagataagcacattttttacaaaagggagttttttggtacggcgggggcgtctcttgatagataatccgcaaaatgtctttctccgctgcaacaagctttgcttcatcttcaggagttaatcttaccttttcgcgcttcttttcttcagggtacgataactccccggcaatttcgacgccccgcctcttaaattccagtaagtaatataaaagctgcatcttcgatgcttctttaaactttgagcttttctttatttcataaaccaaaagctccccgtcttcccgggtaataaggtcaattttacttcctccaagaaccatttccctgacccccggcttcttactctgggcatgaattaccctgcctaaatccaaaagttcattgtcttcgtcgggagtaatcttccgccccataaaccagacctgccggggacaaatgtagtaataccagattaaagttccgccaatgctaatttcactcatgtacccttcccctacaatattttttaaatcgcgggcagaagccagccctccaatttaattagccggctgaaacctgccctacctttataaaatttcaaattcttcccgccccagggttacccgtttaaacccggtttccaaagagtaataatcttcaaggtattctaatggtagccggaaaaacgaacctgcctgttccaatccccggatgttgctttgatttttttccaaacccgggacggaaataatatactgagcaagttttgattttagttttaaatagtttgtccgccgtttttggtcatcactttcctggattacaccttttttgtactcttcccagatcaatttagcttcctcatcaagctccacaaagacatccacataaaaagggatttccgtaattagtttaaaatcacttatcaccggactgccgtcaggggcatcggcaaaagaaagatttaaaattgcttccaatgttttctttccctgactgtcggataaaagcttttctgcggtaatctttaaaaaatacccaccaattaaattcccaaaagccttttcctcgatttcccgggcttcttccagtaactcccgggtttgctttaaaagcaccggaccgtaaatccgggtagcaaaatcttttccctcatcggtaatcaggttcataagtataacttctcccagctctttctggccactacggttacatctccctgctacttgaataaccgaatccaaaggcccggcgtctcggataacacagcttgcatctaaatccactcccgcttccactacctgggtggatactaaaacaaaaggtttattttgctggtttaattgctttattgctaaaagtcgttgacttctttctttgggagtaatgttggttgaaagataaaataagggaatccctaaatccagttcttttattttccggtaaagctcaatggaagattttatggtatttactacaataagataagatttatctttgctatatttttccttaaaacttcggacaaattcagcgatggtcattttttccggcaaataagaaagctttacccgatttaatgccccaaacatttcggcaatttcttcttccgtccctgccagctcaatgcattcttccggcgaaaaaattaaaggtttcgttgcggtcattaaaattactttacagtcaagcaatttcaccgcctgcaaaaatatctcccgcaccgccccccagtattcaaaaggaatattttgtacctcatccagtaaaattatgcttccggaaagtttatgaaattttttaagaagccgatttttaaaaccaaaaaaagtatgaaagagctggacaaaagttgtcacaataatttcactttcccagctttcggtaaataaaagagctttttccacttcaatttcttccttttccacccgaaaagaaagatccgctaaatgatggtgctttataaggtacaggctttcattttctggaaaatccgtaaccttagtttctaaaatccttttaattacctcataattctggtcaataattgaggtaaaaggcagagcatagataatccttggcgtataccctttttcccgggcgataagctctcgaagcttaaaagcagcccctaaacctgccaaagtctttccacttccggttggtgcagttaaggaaaatatctccccttcaaaatgcttttctacattacttataactttcgcaaataaattttgccttaatgtatttacatagcttttttccgccttttgggaaagttctttttgatattccgccattacagaaaacggaagttctttccttgcaaattctttgagagcttgagcggcgctttttttatccgagtctattaataatgaatataagtacagcgttgcaaagtaaaaaagaaatctaatttcttcctcctcctcggtcaaatcctgatataaggtataaagccggccaagataatcctgataatttcgggtaaattccccaaggggcaaatatttaaatccgtgtttttgccagagctcttgattttcccggtctatttcagggttcaataaaaggtcctctaactgcatctttaaaatttccagtttattttttaaactttcgttgtagacagcattttcccgcaaagctcttttggaagcaagattatttaaaggatgatcaagatctccgtgatgccttaaaacagccaaaaaaattaataaggcaaggtactggtgagacccttcaatgttttcattaagaaactgagccgaagcccacaccgccgataaaaaagcatggtgagacagaggccccaccgcttttttatttaccagatggtcctgaaagtacgaggtatatttgccaaaatcatggccaagccctgccgctttaaggctttttaaaaaagcctcccggtctaaacccggaaggccttgaaacttttttaccatgctggcagttacttcctgcagatggtcttttaagagcttttctgcaccggtatcaaagtgggaataatagaccatcaaatcacccctggctctaaaaataaaatcacatcacccaaagaatcaatcttaattgccggtacgctaaatttaccgcctacctttttcccgccgatttcataaaccaccgaagccgtagaggctatggaccggtcgggattaaaggaaaagggcattttttcctttaaataccttaaatcttcaccatgaagcgtagaaaataaaagctcttcgtcctttaaaagctcaagattcacgacggtatcaacaaaatttgtttctaaagctgtccccgggaagacacccagaaaatcaatttttgctaaaaattcgcttcgccctaaataaacgggaaactttggccccagagcaagttgttttgccaattcctcctgaaaactcgggtcatcatggtaaaagtatacccgataaataagttctcttccccgcaccggcagaattatttcagtgggtatcatcgttggcccgccggagccgttaacttctttaagcgttttggtccggacaaattttaccgtttgcataattttccggaccggtgtcattaatcttaaggcatagtgggctttatttccagttaaaaggctataataactatctttcggtagccccagcacagccgcaataattcccgccagcgtagttcttgcgggaaaagcatagcttaaggaagaagagttggtataaaacttgcggaagtgggctgcaggaccgcgaatttcaaaaactattactttccgcattgccttcagccctttcttaataatttagaatacttaccttagaatcccccagcttttccgcaagtaatcgggcaaaattctttgcttccccgtgataggtggtttttagattatggtcaaaatacagtagaatcttagtaatcttcggattattttcggccaacaaatcaacaagtttccccgcttccagggaataatcggttatatccctcaaaccttctttcggattaacttcaagaaagcttctaaaatcccccagataggtagtatcgtctacatactccactcgaagatacagccttggatactggccgattttactccgggtggctaaaaggggaatggctttaacaagtgcctcatctaataaagataaggtttccatatctaattgcgtaaactttgcccggtgcgccgcgacaattccgtgaaaagcaattaaagagtaataaaggcggtagtctttgcccatagtcccctgttcattaccgcttgtactgctaaagcgagaagttatagtgtttgattccactaactctactttgtttaaagaataaccccagttaaactgaaccggtccggtaaaggttaatgaacttccgccgtcttcgcttttaatgggcatggttgcaccaaaaaggcgaacatcgacaagtttttctaataacacaggcacatcgtctttacttatgtttttacttgttttaccaagcaatttttccagtctctcggtggcgtttaccgtttctccttcaactttggccacaaatatttcttttcccttttcctgtaagtaatcccgaacatatcgctttagacggacatcggagacgagattggttttagtttcataatccatccgcggccgattttcatcatcgggatcgccattgggattggtaagcttggcatcgtaaataaataaaatttcactattgttctttattaattcacccatttacatcccctccacttcagctttttcaactttggcccgggataagattttcccggtaagatagctgtagccggataaaagataaaacacattttcctgttccgataaactccaccggggaatttcccggtctaaaagctttttcatactgttgtagattttctcggtaccgggatttaattttttgtactggaataatttctggtgtacttcattggcaaaagaaataatccggcgtaagctcatcccctgataagttagtttatttaaaatggctttattgagattactctgatgctgggcagaagctatttcccctaccagcacccccagaagaaacagagcagcctgctgtggtgtatagcccatatcccggatgtactctaagtcttcagcttttaagtccaactctaattccaccgcctccacctcctttggcagaatttcaagttcctgtaaaaataaatttaaaaggttggcccgaaggcaagctttggccagttcaatttccttatacttttcacttcccggattgacattaaaaccttcctttgtaaaggcaaaaattttaaaaagttcaatatgctgacggatgataaagcttttttccaccgggtgtccggtaaaaatggactcaagtaagtctaaaaatttccggtattcaacactgtttttgcctttttgctgaggaatctggtagtaaatgcggtttaggtttaaagaaagttccggcagaagctggttaaagtgtttcttgtaaacttcatttactttctgaaaaagctgcaggattttaagaatacgactggggggtatgtctttaataagttttagcactttaaattccgctttatttttttggtaaaacaagaaattaaaaattagctgattatagattttccggttttcaaaataatcgctaaccatttcttcgtacccggcaatctcactataacctttaaggttgttaaaactattattggtaaattccatccatttttgaaactgctgcttttttaaatttaccggaaaaaggaaacccggaatgatgaacaggtttaaattcccaaggcggttattgaacttattttgaataaagctttcagcaatcaatagttttttataacattcgggacacagtgagtagtttttatagaagttcttcttatcgtgattgctggcataacctattttatcggtgatatagtacttaaattttaacttagtagtatcggaggttattggaccaaaatttccacaagcgtggcataccccctcttccccggcaaaaatatcaaaaacttttgctgcttctactttttcctggtactccctgtaatctacccctttttgcccatcaaaataaatggtatatagtgctacttctttttcacttaggccagtctgatctttaatccatttactaaattctttagctaccgcctgggctaaatttttacctttaggattttctttgattaagtcaagtaatttgctgcctttgtatcctggcagcatctccaggttcaaaatgtagcgatagcggttctcggccccctcctttacgccggtatcaaaaaagtaaaggtctaaaactttttgcacattctgggctaacttcgacccctcgggtaaaacctccagtaaattgggaagcgtttgggatactaaaaatgatagattgtttgtcgatagataccactggggactactgctgccgtcggcatttcctacccagagatattctctttccgtaactccgggagtaatttccttgggagtgattttcaaagagttattagcagtggcaaaatcaattattactacgtgctgttttttgccaccctggtcttcatcaatttctaagcaaaggttttccaaaaatccccccgaagcgtgttctgtggcaagtctccccacttcccgcactgcttctaacacctgatcacctccctgtaaaatttttaattttaattataaaaataggtaccaaaaaaatttttccagtaaatttactccacaaaaccaaagcccatactgttcttttccccaaagcctgcataatagcccaggcttattaactcgggatttgttttaattttaaaaggagcacaaagtccacggattttctggtctttataagttattaagcgggtaggaagtttagtttgaaaatgcctttcatcgaaggcaaagtcgaaataatctatccggggttcgcagccgtagtaaaccaggtatttgtttttaaggttgtttaagagcttttccttgtataaggctttatcttcaacgtaggacagataggtaggagtggccttctcctgactttttatcgctaaaaccaatggtgactttaaagtaaataactcttcatcggtaaagtttctaagaggaattgccgcgatttctatgatacttaccggtaaagtaatgattttgaagtttcgaagagcccaaagaccagatgttaaatagtcaataaactccggcaggggagaagatacggtaaaacttgccgtaccggggaaaacgataattccttcttttgtagttttataattggtaaaagaaagcggggaaaaagtaaaaaacttaaatgttttcttgcccttgcgaaaaccaatatcatggagaaaagtagcaagttttgccgactctactcctaaaccccggtagattagggctgtcaaagcgtgttgatagttgtaaggtagtaaggccttacttctaacctcgaattttatcagcgctcgcaattaccccaaccctttcccttttattccatcccgtaagatttaggcaaattttttacctttctcgctaaaatctggcaatatgctacattaattattttctttgtattttttggttttcctgctttatcgtttattattttactaaaggcctgcaaaaaaatttttccaaaagaaaactccgaggaagtcttttttgatattccttcctcggagtaaaaggtttaaatttctttttcaggcaaaaacatccctttttaatagtataattttggctggggagggattatcatgaaggttttcgctttaatttctgatatcatctattacatttcaacaattttgtttattttgtttcttgctggagttgttttagctttttcgagtatttttggagctatattgggagctattctgcaaactattggcggcaagtgggctttttggcctggctttgttcttggagcaataatttttatcatttatttatacgaaaatatctttggtgatgataaaacgaaaaaatcaccttctttgtttgtagcaaaacgccgtataaaattggtaaaacattattttagaaaaaatgatcaagtaaacattatgtcataaccttttccttgtttgcccgattttccttttcttcttccaatctgctgtctaaaatgtaaagccgatttttttggctttcatggtattgtttgaatgcatcttgaaaaggtttactttcctctatggagacattgttataaatttcctctataatgttcaacagaacttgctccgtaattttttgttcatcaccgaaccatgccagctagcataatgcaaaatgcttttcgttaatatatttaaactccttacttttgacaaatttacttcttttttgtataaacgcggcaataagtcaatatttcctgaagcctttccatccctttatcgtaggtcaggcaaaataaaaaatcctgttttatatggtaaagagcggaaaataacagtcccagcaccattccaagaagcaataaatagaatttttactattcctccgtttcctttttaatcttagtaaacctcgatttcccaaaaaaataaattcctaacaagattaaatccatcttccaaaacatttttatcaacatacagcttatactttaaaaaattttttcacaaaactttccgtaactcagcaaaagctccgggaagtaaaatattaaaaagtaaaaaaagtaattttagattatgaattggcagctttgttttttgattgagcaactttgttaatatgagtttttaatatttcttgaacatcagatttatgatttaagatcatgtcagttaacgtcgaatcagctattgtttttatttctgctaccgaaaaaccttcagtactatttgccagatattctaaaagttctgcatctatacctttttcaattttttgacctaaaaacaaatcaaaatattttttccgtgcctctttatcgggattcggaattagtattttttgatcaaaacgtcccggccttaatattgcctcatctaaaatatctatccggttagttgccgctattaataaaacatcatcaaccttttcaaacccatccatttgcgttaaaagaatgtttattaaaatatcagaagcagaattaagggtttctgccctcctcttcttagctatagcatctatctcatcaaaaaagataatcgccggacgtaatgctttagcattggcaaaaagctcaagtaacgtcttctccgctgccccaaccagttgccctgaacttataatagcactggcattaactacaaaaaacggtaacccgtaagcctgagctactgtcctggcaaagttcgtttttccattgcctggcggcccatacaaaataatgttcttcggtacacttaatcccattgcccgaaattttttgcttgtttcaggatctaaaacaatctttaagctcttctcaatactctccactgcttcttccagtccgtataagctctttaatatattcttatctccttttaaataatgatatagttcatattcatttcccatcgatacatattttactacctcatcagtccgtgacaccaaccgcatcggcgctacaaaattccattctttattattaaagttagtgggcttaacttctgaaatcccattaaatccttttattttttgacctccactaagattaattattacagtagttaaagcgtcatttaaaatattatagataatacttaaaacaaattgctgtaaaccccaaattaaagcaaatacaatcatgaaaaaaacaatttttaccgctccataacccagaagagagctgtacaaggaataataaggcaaatctgaaggagaatatatttgaaagatcctgtatgtattccaaaaagtataagcaaacgacaaattataaataaattttaaaagcgtctgaacaaaaataaatatcctcagtaccatcccttacaactccttgtgatttgtacctatcaggtatttaagatttaggaagaaaatctaccattgccatattccaattttattttttcttgcaacatcttgcatttctaaaaaaagctttgtataggggcttaagttttgattctttccataacttaaatattgagcatacccattaagcagtaattttacatttaacatatgttccttagcttcgcgcggtttgccagaagtcggttgaatatcccatatatataccagagggtagcccttttggttttttaaaatgtgtccatcgctagtatattcaaattctacccagacaggcttttttagccaattctcccgtaaatattttttaatatcttgctgatttttggtagtttgagtggatagttttattccaaataataccaccttaaacttcataccggaaatcttaattgtaattacttcaccttgtacatcagtaataattgccggtcttgttcttttcagcattttttcttcaatttttgctacatcctttgccacccataaaatccctaacaaacttaatattacaaaaattgcaactaacccatcgtgatgtttagttttgcttgctacggacaatacccaataccccctctttttttaaactactaaagattattgctatttcaaatagcaattattttgaaacattttttattcattttttctccatttataaaaaatttcctgctttttcaccactataatacaataatcgacacaaaaaaaccccagccttttaactggagtcctaatcttttaaaaccacttcttgctaaaatcataaaaactgcttcttccattattttcaattcctcgctatttagtgtgggtaagcaaaattaaaaatcaagatttagtttgccaccgaccaaataaattatagttgcaaaattatttaatgatctatatccccgggctttccttttaactgcttgaattacactatttaggccttcgagaattccattatttaaatttgaggaaaaccaatttgaaacgccattccagtgattttttataatttttgcagcttcaataattggttcatgacggctatgggtagcccaaaagtaccactttttccaaaactgttctgcttcgacccgtgataactgccaaagttcttgaaaacttaactttatgttataggcttttgcggtttttatattccgattttttaaggataacagcttttctttttgattttttgttaaatttctaatgcttttcaaccaaagatatttagtaccttttagttctggacgttccttttgttctgcccggcgaactttgtctactgcttcattgatgatcttcattacatgaaatttatcaaaggttaaattagcttttgggaaaaataaacgagctcctttaataaaagcaggggacatatcaatgcagatttcttttattttttctggattaccattatgcaatagtaactcatttctgaatttctctatagtctcaaagtcttttccaggggttacaaaaagtattttagaacgttctaaatcagcaaatatagttacataatcatgtccccgcttaaatgatgtctcatctacccctatttttgtaatatttgaataatcttctttttgccgtgcttttgcaacataataagaaagaattcgccataacctggtatcgtgttcattaaccattcgggcaatagcttttactggcatttctttagctaaggtcataatataaacttcaaaaagtaaggtaaaaccagaaccgggccaatacctttattgaaaaatatcgatatctctcgttctcatcacttctaatgtgataataccacatcagaagcttttacccatactatttagcgaaaagcctttttaaattattaaaaatacctattgttttaaacttaaaaacaattggcttgttaatttctatggctcaagctatacagcacctaccgttccaaccgcatatatcggtaactgcaccaatgtctccacccacatttattttacgagtatataatacataaattttcctgctatttctcctatttttattccgcttaatactacaagagcaactattataactaacaaagaaaccttaattacaggataattattcaatttttttatcaaaaaattgacaccatccactcatttcacccccataaattcaatatatatagtcttttgtaatgggttcttcccaaaggcctctcgcacccgctctttccagctttttgccttactttgtttcggcttctttatttaatccggctgctgcttgtttcaatcccagattggttcgattaaaacaagcttttatagccatactaaacaccgcctacagaagtttcaatcccagattggttcgattaaaacgcagccgcatcaaaagacttgctcgcgggaatgtagaagtttcaatcccagattggttcgattaaaacagtcctcggtatacttcaaagataagctttttgccattgtttcaatcccagattggttcgattaaaacagccgaggactttgcagagtacttcagttctttcattagtttcaatcccagattggttcgattaaaacctccccggagaaaatttcgccgctattcccatggccgtttcaatcccagattggttcgattaaaacaaaagccatccttcgggttcttctgtatttcacgtttcaatcccagattggttcgattaaaacaatttaaaagctatgcttaacttttttgacgattttggtttcaatcccagattggttcgattaaaactaagctgtaagtacccaaacaaaaaacatcattatgtttcaatcccagattggttcgattaaaacaatttaaaagctatgcttaacttttttgacgattttggtttcaatcccagattggttcgattaaaactaagctgtaagtacccaaacaaaaaacatcattatgtttcaatcccagattggttcgattaaaacccacagctaaaaatggtttatgtaagcaaatataatcgtttcaatcccagattggttcgattaaaacccagttccgtcggtggaggccatttctggccaattgcgagtttcaatcccagattggttcgattaaaacgggggtatatatataatgactttaaaagaattaattgtttcaatcccagattggttcgattaaaacttgctaagatagtcttttcccggttaatcaatcctggtttcaatcccacagattggttcgattaaaacttttctccgcttgtaccactcttgcaccacgtgaaaagtttcaatcccagattggttcgattaaaaccagtgtgaaggaagcagccaagatgctttcactgggagtttcaatcccagattggttcgattaaaactggggtgttctacttcctgcgttgttggagtaggccagtttcaatcccagattggttcgattaaaacataatgcccacctcgatcgtaccgctggaggagatactgtttcaatcccagattggttcgattaaaacccaccgccagtccggagctccatctgcttcgtctagtttcaatcccagattggttcgattaaaacaagggagcaaaagggacgcaaaaagagaagttttaggggtttcaatcccagattggttcgattaaaacccagttccgtcggtggaggccatttctggccaattgcgagtttcaatcccagattggttcgattaaaaccgggttaagtatggtagagccacgttggggcatcgctgtttcaatcccagattggttcgattaaaaccggagaatatcaccgtgaaggggataaacctgcatagtttcaatcccagattggttcgattaaaactccggtcctttgatatgcttcattaattcttttacagtttcaatcccagattggttcgattaaaactgatgtgtaacttgcccattcaaaggtattctctgggtttcaatcccagattggttcgattaaaacaagaaaatgaactgtggttggaaagcgatgatgctgtttcaatcccagattggttcgattaaaactccggtcctttgatatgcttcattaattcttttacagtttcaatcccagattggttcgattaaaactgatgtgtaacttgcccattcaaaggtattctctgggtttcaatcccagattggttcgattaaaacaagaaaatgaactgtggttggaaagcgatgatgctgtttcaatcccagattggttcgattaaaacctttaccacttccaggcattttcggcctgtcctgctaagtttcaatcccagattggttcgattaaaacctgccgctacctcggcaaaaaaagccgaggaggacttgtttcaatcccagattggttcgattaaaactctcaattagaaactggtacaagaggtttcccatctaaagtttcaatcccagattggttcgattaaaacatcgttcttgccagaagtacactttgaccgatgcatagtttcaatcccagattggttcgattaaaaccttgtcaaggctcggccgtaaggccgacagtagccgtgtttcaatcccagattggttcgattaaaactcttgccatcatgtagcttcagaccgtcaacccattcccgtttcaatcccagattggttcgattaaaacttggaggcagaaaagagattagaagaagcttctgaaagtttcaatcccagattggttcgattaaaacaggcatttcgacaaaagttttgtcaaggtttttaagagtttcaatcccagattggttcgattaaaacccgcctaattccccatcaccaactgctattctcggtttcaatcccagattggttcgattaaaacccggttggagctttcctgctggaagaatttcctgtgtttcaatcccagattggttcgattaaaacgaggcacttgagaagtggttaaagcgatatgagacgcgtttcaatcccagattggttcgattaaaaccttataataaaattaaacggcttcgtaaatattgaagtttcaatcccagattggttcgattaaaactggccagtgggcatttagaaaagcgcagtggaaacgagtttcaatcccagattggttcgattaaaactagaatccgctctcgatgtttttctcttcgtctaccgtttcaatcccagattggttcgattaaaactggatataaaggtaatctcagaaagattgggccactgtttcaatcccagattggttcgattaaaacgtgtaataagtgatagtgctactgttgcagaaggagtgtttcaatcccagattggttcgattaaaacaaaaagacatgttttatgttcccggtaggctccttcagtttcaatcccagattggttcgattaaaacttcctcccaagaggtactttcaaagcttgtccaggagtttcaatcccagattggttcgattaaaacatggagttgtttcagcttgcggaacgggaggggagtttcaatcccagattggttcgattaaaacggcttgcggtattggcttcgcagcagagcccgagcaagtttcaatcccagattggttcgattaaaaccctcaacatcttcaaatgcaaccgcataacctttaatgtttcaatcccagattggttcgattaaaacaaccgaaaaagcaacaacttctttcttcttgaccatagtttcaatcccagattggttcgattaaaactttcggctgttgcagtatttttaacaatagctgggttgtttcaatcccagattggttcgattaaaaccggggtgttcttttattgcggcgatatagtgttcgccggtttcaatcccagattggttcgattaaaactagagatagatgtgagggtgaaaattgcgagaatttgtttcaatcccagattggttcgattaaaactggtggtgcgcttttatcaccacgtcgccctcttcgagtttcaatcccagattggttcgattaaaactatcctgccattttcatcttttgacgcgcaagctccagtttcaatcccagattggttcgattaaaaccgggacaaaatagcctgtctttactgacaagctatttagtttcaatcccagattggttcgattaaaacttttgttgctgcttttgctggaaatcctgctgaatgtgtttcaatcccagattggttcgattaaaacaaagaattgctttactattctgcactcctccggcgtgtttcaatcccagattggttcgattaaaacaattgtcgaagacccagaagccagagagcttgcccgagtttcaatcccagattggttcgattaaaacaaaagacagatatcagcgagattttgcgaggtggggtttcaatcccagattggttcgattaaaacaggtgtaaaggtaataggtaaaaagaaagatgctattgtttcaatcccagattggttcgattaaaaccttgagaacaaaaagcgtcgttcgaaaaagaacgacacggtttcaatcccagattggttcgattaaaacctggttctccgtatgcgttgtagccggtagtggtttgtttcaatcccagattggttcgattaaaacgtgaaaaatattattccattccaaggcatattttcgatgtttcaatcccagattggttcgattaaaacccggtcagtattacatcagccgacacattccaccggtttcaatcccagattggttcgattaaaactaaccttatggccttacaggtaggcgtagatagttatggtttcaatcccagattggttcgattaaaactaaattgctatatttattatatgacgatgttaaagagtttcaatcccagattggttcgattaaaactgaaagcttttgcgagagatatatgggatacaatgggtttcaatcccagattggttcgattaaaacagcataaataaaacaataacccgctaagtaagcgggtgtttcaatcccagattggttcgattaaaacaggcaaaatttccatacttcccacctgctttctctttggtttcaatcccagattggttcgattaaaacccaaccgtcttattatttatccctgccttaaagttttagtttcaatcccagattggttcgattaaaactcgccatgttagagccagccacgatgttgaatgcgggtttcaatcccagattggttcgattaaaactacccctactgatataccttctggattgtccgatgcgtttcaatcccagattggttcgattaaaacaataaccgagaaaaaagcattggatatgagcgagtcatgtttcaatcccagattggttcgattaaaacttaccgaagaagaatatttggaaattgttgctatagtttcaatcccagattggttcgattaaaactttgaagtagttaatgaagtaaatcgtttaggtatttgtttcaatcccagattggttcgattaaaacatataatcaaatttttagaaattgaatttccatcttgtttcaatcccagattggttcgattaaaacaggactgtcaaaaaaatgtagatatatgttctatatggtttcaatcccagattggttcgattaaaacgagggctcaataataagggaagtgagccctgaaatcgctgtttcaatcccagattggttcgattaaaactttttggaaggaggcgcagaaatggaacaggaaattagtttcaatcccagattggttcgattaaaacagcggcgtgtctcaatcgtatcgtcaccgtatggcagtttcaatcccagattggttcgattaaaacgctttcccagactgcgctttcagcaatatttgccatgtttcaatcccagattggttcgattaaaacccataattaattataaaagaaaaagatttttaaagaaagaagaagtttacatttttcatgtgaatattggtgcatagtggtaaatttcaactgaacgcttatttttcaaagtttaaagtttattttcaccctttcgtcgacctcccgggatttttggggtaaccgcaggtcgacgaaaaacatggtataatatttactttgattgcatatatattcattttttatcggtaaactccggttgaattaagttgcttatttatggtttatgtaatcttttcgtcgacttcctaaagaaatgttcagtatttcacataaatggcatgattaaaacttcttactcttacctctttttccaaaaaaataattttaattgattaatcttaattcaacgaaatcaccagtgcatttgacaaaagcctcccgggtttggttaggtacttgccgtttacataaaggccgctggaagctcccccatcaagattcatggcataataagctccaagtttttgcattattatggcccattcttttatagttgccctgttaactgttaccagtaaaagtttcttatttttggttacacctataccgcttctggcaaaggaaccatctttgattttataatgggtaaaattttctttaaggggatcggcaattatttttccttctttcactaaataaggtcctgcttccaatacggcatatgctttgctccaaaggacgttttcttggttttccggctctatcttaagagttacgttactgtttaataaattatccggtggacataaactgccggtatttaagacaaatccttgtgggggaatggaagttttaccgtaaacaattctaataaccttttgcttttcaacgacaatattataaccatcagaatacaaaacttcttttcctacttcaggggtaaacaatgtatatccccgccagccaggtatacgtaccggatttaaagtatgcaccgggtaaatatacggtagctccgtcccttcttcactataagttgaaaaaatcacacttatatcccattttacgtatccaaatattacttcattacctggcaaaatacctaccgaacagcgttctccattaccttttctaattaatcgaccgtcaatcattaaatttccgtagggttctttataagcatcataggctgaaaagaaggccccatttataccaattaatccttttttccttttaaccatcgattccaggctttcaacctgaccaatttggtttttggccaataccgtttgcatctttaattttttcgtatttaaatcgacaatcacacctttaacggtaaaatttttattattaattttaagtttcttttcaaacacctgataactatttgctcctaaagctaactgggaaaataaaataatgtataccagtaaaattgcccctaaagcgatttttcttggtaccattttagacctccagttatgttcttaatttgtcaattaaaaccctgcactccttgaaaatcaagcatttttctttatcactgtgggcaaattgtacctacacattgtttattttagcattgtctctaaaagttctcttaattccaccggtataactgcaactttttccttacgtccggaaacagtggctcttccaataaacaccagagcttttgcccaaagtttgcccacggtggaagtcggctcttccttatcccagtaaaagctgtcatctttgggcgaaccaaacttcctggaaactaccgcaagtttgccaaagcctccgttatttaaaagatattttaaaagttccttttctttttctgataagttatttactaccctttgcaggttttggcgacttgtcagaaaagttgctatttgctgctcccggtctttgcgatagcgggcaggcggtaagttataatgctgtgaaataaagtcaatccagtaaaccggcatattttttaatcccctggcaatcgttgggtttaaagttatggccttttcttctatcactttccgcagttctttttcatagtgaaaaacccctttagaaaacaaagcttctcttagataaataactatttctaaatgtttgatcttctcccgcaattcctgattctgcacatttaatcttttaagtttatgtaaataccttttagcccgggccacatccccaatttccactaaaagcagcgtaaagaaataaagaaacagaggattatcgggaacaattttttcaatgtactcataaaagtttagcgctcggtcatactctttcttctcccggtaaaattcagccagatatatagcggctaaaggataaaaggttcccttttgccaaaggttttcaagaattttaagaccttcttccaatttccctcgctcacgcagcctcagcgcctcaaaaactattttatttaaatcttcgcggttgattaaaataaagtccattttacgaagtttggttgggatttcttgattgttaaaaactatgggaatcgtgtcctcttcaccaaacactcctttttcttttaaggcaactgccgcagcagtcttaacttccatggaataaagggaggattttaaaaccgttttggctaactcttcgccccaatccccgccgtagcggacaaaatcctccatgcttttttgcgctaaatatttatctaacctttcaataattactaataataagaaagcctttactgtccccagttgcaggatttgttttaaataatcaacatcttcctgggcttttttcagcacttcctccatttccgctatgatacttaactgatactctattttaaatgggggaatttcttttttctctaccaaccgggatactttcgccagccccgcaaaaaactcggaatgccctttaatactttcccagattttagccgcttcctcatatttcccgagattaaaacaagcagcagctcccagataatggctttcccatttaatatgccatttctgccattttttataaagctcgtaaactttacggtggtccatgagactgccggcagcttccaaaacaagagcggtgtattccaataccgcttggggagcaggctgagggtaaaaggctattaactccaggtcgaaggttttttcagcttcctgtaaatgacgccgggctaagagttcattacccatcgatgactggattaaggaagccagggcaaaagtaaaagtatttggagtatatttaaggatgttatttttatttttaagaagtggttctaaaattttataagccttgaaagagtttttagttgtatagtaaacataagcaaggttattgcgaacccaaacattgtcatctactttaagagctttttcaaaataccgctgggcttctaaaatattacctttttgtaatgcataaataccctgatccataaatttttcaaagttacgattggtcattgctcccatcctttcaaactttttgcccgttaaaattcccctcattcctgttttcggcaactatgctctttttccttctctttttttaaaaaattgacttaaaccaccaagatcccaagacacccgcaaagagaaatcagcgacttaaaccagcgttttgattatcatgggaaaaaagttaaaagcttgggtagcaccattcatcctaagcaccttaccagtacgacatttaaggataaatatgataatagctgtgtaaactgccaccctttaaaaattgatgtaactcctgcagtaaacgaaagaaaatagtaatataagaaaatttaaaatttatgtaaaaaacaataaaagtacttgtatatttatagatttgatgttataagtattcaaaaggcacacaaccttcttttgcccccggagtataacctccgggtattttttccagttatttctatgatttattccgaaaaatcgagctgctaagattgaatatattggagctacaacagcgtttgagataatgtctgcccggttaaatcaaactcatgagcattcacgaacaggatgttatcggttatttcgtccgaatagttccttgtccgccacggatttttcccaaaagtggtggtgtcggcttttattacaactgtgccggtcagaagcaaacatgtcattaataacaacgcctttattttttgcatctaagttaaaacccggctgaaaaccgtgttttcttacctcctttctataattcttttattaaaacgttatccaaatcttttacataacctttcttggttacggttttgtaagttgccacctttttgtagcatgggacttttttgtatgccgctacttttttgccgttgacttttttgtagtatttaacggttacgtagtatttttgggtgacgtaagtttttacttttacatcccatttaacttctttccagccgtaatatttttcatctttaagaaaggtatacgttactttttgccctttcggaagcgttgctgcttttgttttgctgtttggagcggcatacaaagtgactgttctggtggtgatgcctttcacgttggtgtttttaatgggaagcgggtttttgacaatttcggtttcattccagtttactactgttacaggaacataatccaaaatatttttttcgtctacaccggtaaattcaacataggcatagtggtcatatttatccttccattctcccattaacaccgctttcccgattactttatagctcccatcattttattcggggttatacaggcggcattcaaggacgatgtatttgccgttttcctgcaaaaactttaatttcgatacttcatttgggtcatcactggattttgccgggtctactaccgcatactttatcccctgcccctgcagttccggcggcaagtcgatggtgggaatgtcgccctgtttcgtgctgcggtcaagatagttggttgccattgttccatattccggattccctgggtcaggtacttcttgaactcctaaataatacgctatctcttccaaatccaagtggcttgtttgaatccgcttgtgcagaaagtatactttttcgccggtggtagtttggtttccagtgtcagcaaagacaacagcaccggacattatgcctaccagtaaaactaaaattaccatcataaaaactcgtttacgcatttttatcacccttctggttttttatttttctcaacaattttgtattttgtgtcttttcattttattttgctttgctaaaatacagtgatattttgcaaaagttgataatggcttactaaaatattttgcaatttttgcagattacaacttatttctatgctaatttattttgaaaaatagatgcgagattaatttgcaagttcacacgcaacattaatccggtttccatcccacaatggttctattaaaactttttaaatattctattaatggttttcttgcattaatgctttttctttacccggaagattaaaggttttttaattccgcagatcaacaaaatttcagagcactgtattgatagagctattacaagaaaagttaaggcagaagatgttttgaacgcattgcataatccgttaaaaattggtaaaatcaaggtagatgatgaaggacgaaaaagcaagaaatatgttggtgagaaagctactgtaacagttaatccggacacaggaacagtaattcaggttaatccgaccagcagtaaatatgcaaagagacttaaaaagcaaagaggggaataaaaatgttgaaatttagtaaagaagattatgagtttttctttccgcttcttgacaaagagaatcaagagattcttaaaaaagttgcagtggtaaacgaagacgaagtgataattgatgatgaagagattgaagttgacttatatgaatggctgaacgaccttgtagtaacaaagggatttgataaaagatataatctcaacagtattggacagcgacttgaaaaacttagtgattacgtcttttctataattgaagaatgaaaagcacttactgggtggaaacagtaagtgcttttattatgtccaaaatttatgatttcgcctttttggtattgtaggcgtaaaagaacaagacatcaccggacgcgaccgggttaaaaagcgaagatgaatgaacggaggttgatattttatggaatggttaaagaagcttttaaaatcaaaaggcgttgccgatgaggtaattcaaaccgttgttgccgctgccgaagaaaaatttaagaattttatcccaaagcaccgtttctcaatttttaatcccgccagttctcccaaaaaacggtcttcagtagtaccaagatttcttttatcgcatacttgatttttcatcctggcttaaagcaagttccgccaaaacctccaactaataaataacggctaaatttttattaactatttttatatttaagttcaacttttaaaacttcaaattaaaaacaaaaaattccaggtattttctcccggaagtacatctggtaattgattagttgaaaaaaactgaccccactggcactttacaaccggaaattcagccgttaatttccgaagcggttctttccaggtcatcccgatacaaattttcaaggtaataatggttttttagatctatcgtcaatttatcccataaatacaatcttctttgcaattcaattgcgtattccctcgtcagcatacacttaatctcagcagtgtggggctcgttattaaactcctccaaagttttcagccttttatctttacggtctgtgagaagcgccaggatatttctgccatgttcctgacaattttcttccagataaaacctgatagtatggataagaccggtaataagaaaatgctcttcaattattccttttccggcatattgccttaaatgagcataaaattccgcttttaaatcctttaaatactgtaaagagtgaaaatactcttccttatgcttattaagttttaaaagttttagacctctcgcaattcccccaatacttcttaaacacagggtcgtaagctcaattccatcaaaaacataccgttccttagttatttcattgataaaaaggtcatagatgtggataaacttatcaatcaataaaccttcctgcaatttatcccggaactcctccctaaactcttctttatgtaaaagtgtttcgcacaggctttccaaatccaaatcagatagttcgggattggtgtcataaattgaaaggattaactgattaacatatctgttaagctgtggttttagtttttcaacattttcgctatttaagttttttattaaatcttttaaactcttgtaaaacataaacatcaccccttccacgcctcgaaagacaggcaattttattcttgcaaataagcctttaaacataaaggcataaaactaatttttcaggggaaaccggtaatgcccgacaattcccggcagccaccataaaagttcatccgcctcgcggggataagggccggcgttgtggatgataaagggtacaccgtccggccgtcgtttatccgagatgatagctatatgctgggggtttttaaaaactacgatatcgcccccctgccattcttttaagtttttcgggtcgccggggataagttttaaggtgaggctttgggcgtgacgacggaagaaaacgtctaaatttggtacccgacgaaagtcgatgttgggatcgggtttgcctcctacccgggggtaagcttcgggatgttcttttatgtcttgatcgaccatctcttttaaatcatacccggcgtttttaaaagcccgccaaataacatcggtgcatactccttcattatccggaggatagcccccccggtaatatgcacttttatagcggggtttcctggcgacttccagccgcgctccctggacaatatcatctaaatcataaaggccgtcgccatcctggtcgtggcggataactactttttcgactttgaccttcgggccaaaagcttcctttaacgtatagtaagaatactttaggacaaaaccgtcccggtagaaaattgaaacacttaaagccaggaaaattaagataataagcaaaagttttttggacatttttaaaaccttcttattggtaaattttactaatggttgttgactttatttgtaaattaacattagaataaaaacaaagcaaaaggagatggttttattgccggaacttataaaattaaatattcaagatttgctcgacaaaatcctgccggttttaaaatcctacccccaaattgaagcagcttatctatttggctcagcccttgtccgggtccggccggatagtgatattgatattgctttacttttatctcccgacatagatgtagaagatctggaaagctggactttagccgaagaaattggtcttcatttaactcgtttagttgggcgaagctttgatatatcccttttaaatactaaagattatatatttgccatgaatgttttaacaagtggtaagcttatatatgttaaaaacaatgatcttttgggggattttatcgaaaaggtaagtttgcgtcaccgcatgtggtacaattattacaaacgggctcttctggaggttgtcgaaaatgaccgcaaataaatatatcgataaggatagaatcttaagaaaaattgcttatatcaaggaagaagttactccattaaatgaacttttgcagaaaaaaactttttccgaaatattaaaagacacaaataaaaggaataaaatactcattgcagacatccattgaagcaatgatcgatatagcctttcatataagttcaaaagcgtttaataaagcacctgttgatggccgcgatgcttttacaatcttagctcaaaacggggtactaaaagaggaaaatcttttaacttatttaaaaatgatagcttttagaaataaaattgtccacggttatcaaagtatcgaagatgaaaaaattttggaaattgctaagaataatatttctgattttaataatttcattaatgaaatattaacttttattaataactgaaaaatcccggggtttcccccgggttctttattttggctgggttagcaccaaatacgctatataagctaaaattccgtacactcccagaaaaaacagcgtcgaaagaatcttttggcccagtttaaataaaacgagaccagccagcaagaaaagtaggatcccaccgccgtaaagccttgctatcccttctgccccgtataaaaaataaaacgaaaaaggtagcattaaaaccaaacttaagattaaataaacaatcttctttaaaatcatcccggccaaaagtaccgctgcccccactaaaaccaggggccagccaaagatagccggcattaggcttgaaaagaggtccatctccccaccacctttaaaagtataaatatttttcggctgccgttctaacatgccgctcacctgccgctttcttcttaccatcatcctaccatgattttacagttaagtaaacggtgcattttttacttacccccaaccacttacgacttaacaccctttaatccacctgctcttttaagatttcccccgggggaatggcggcgattttccgccggtttaagaatttggcaaaaagccaggtaagtaaaagcacgccaaacaccagcccccaggttttggcagatacgatcatgttaaaggaaaagtcgataactttggtggcctgggccattaagtaattgaaaagcctgtaaaataacggtattcccaggacaaagccggctaaaaacaaaaggtcgttactgcctaaaatcataaaattcacttcattattgctccagcctaaaatttttaataagcttatagtgcgccggttttcctgaataatcagggaagtcagcacgaaaatcaccgccaaggcaaataagatggcaaccatccccatgatgctgaccgatatttctaaaggtttagcggtgttttctaatgctttatttagatactgtttatcaaaaaaggcaacgagtttatcttcgggaatagttaattttgggttgctccagagaccgttatagtaattatccggcagatttaaaagcttatttaggtcttcttggtagataaaaattgtgttgcctaaagtgatatcggctaccgccactatatctaaagaaagttttttcttgcctaccgtttctaattccatcaactgccccggtaccagaccggttttttcggaaagaggcttggagataacgataccattacctccaagcttaaccatcccgcctttatctctaaccgtcaccattctggagccaggtttaattccgtaaagctgggcgtttattttggttccggaaatctttgccgggactacagtaaaactttcggctccttcgggcacctggtctaaaggtgaggtcagaaggtactggtactgaaaatgaaagacctcgccaaaactctgggtcatgagctttcctatggaatccttggccgccagaccataggcaagtaaaaaggtggcgaaagctatgcccacgattaaaattatcccccgcgccgcattgatcgccccctgctttagagccattcgggtaaggaaattggttccctcgccaattttcaggaagggctttttaaagcggcctttttccagacctttgattagctctaagaccggacgcttcatcatccccctgagggcgagataagtcaccgggaaaataaataccgccggcagcaggagtccggtaattattatctgaggtagaaatttaaagcttattatggggatattaaaatacgcggcataaaaccgggctaaagggatggccaggcctatcccggcaacacaccccagaactgacccaaacaaccagagataaaagggaaaacccaaaagcgcccggagcacttccccggaggtataacccagggcaaaaagcgccccgatttcctgctgcatggcgccgatttgccgccgtaaaaccgtaaagagaagaaccgaagcaacgactaaaagaagggttggaaactgggtagctatgattttggcccctttaattttcgcgtccacataataaacccggggattttcggtgatcttctgcagggagaggagagatgcattggcactaagttccgagacaaactcatcggtaatcttaccccgcaccatatagtagtggtacggcaccggccctaatgtttttacttcctccgtcggtagcaccgcaatgccaaactcgttggggtcgtttaaaaggtcggaatcgtttttaataatgtaaatataatcgggcagagccaaactcccagcaattttatatttctttccaccaaaagttatggtatcaccgatttttaacccattagcttttaaaaataacggatcaatataaatcacatctcccgcttcttcccgggataaataaggcaggttaactttttggcttttactcaaaacccgcaaggttttcccctgccactccacatctttttgaaagcgttcttcgattgaaaggttgtacttttgctcaaaataacttacatccaccggctttaaggtagaaaaatgggcagactcctggcggtatttttctttaaaatcccggtagttttcggtgatattttccatggatagctgcaaagacaggtaagttaccactgcaataaaaattaaaaatatcgtccccacatactgggctttatttttgcgaattatccttcccggaattttcccgattaccattaccactcgacctcccgggcggcaatcggcgccggattttcgctaaatcccgtcacctggccgcttctcaaggtcacaaccccgtgacacatccgggcaatggcctggttgtgggtaattatcattaccgtggctccggtttctttatttacccgttccagaagctccaacacctttttggcattttgataatctaacgcaccggttggctcatcgcagaggattagcggcggctttttgaccaccgcccgggcaatggctactctttgcgcttcgccaccggacagctctaaaggatatttgtctttatgttccagcataccgaccagctctaaaaccgtttttatgtcggcaggggaagcagaaaggtccgccgccgcctggacattttcgtagacggttagagtattgatgaggttgtagaactgaaaaacaaagcctaccttctctctccggtagcgggtaagtttttctggagaataagagctgatttcctcaccatccacccatatctttcccccatcgggccggtcaatcccgccgattaaattaaataaagtggattttcccgaacccgacggccctaaaacagcgtaaatttttcctttttcaaaagttaaacttaccctgtccagagctcgaacctccgcagttccggttttgtaaactttggttaaatcttcggttttaatgaacacatcccccacccctctccgcctaatagcgcacagaagtgcgccaacgttacacccgaacttccttctctaaattaataaaatataaatacttttcttttacctttttcccggtaatctcctccacagcccgggcgtaaaggttaagctgaccggcatactcttttagccgctcgtttaagatatccccggtgacccggtcggttttccagtcaacgataaaaaacccatcttcttcaagagccaaaaggtcaattacccctcgcaccaggattttttccgaaaaaccggtagcctccggataaatttcaccggccttgactcccagggtaaagggaaattccgggtaaatttcccgagctctaaggattctctggcccaagggcgtagcaaaaatccgggcaattttcgtaaaatcaagcatttctctgctttcgggaggcaaaaccccctccgctaccagcgtttccccctgggctttaagtccggaagcagacagatccccttgaaaatcaatccgccgcaaaaactcgtggtaaacaatccctaacatagctccgtcttcaaagtatactccgggtaaaaatacttcatcctcatcttccaaagaaataacgtcatcagtgctaaaaacttcttttaaatcggaaacgctcatcttcgcaggaagcttagcaatttttaacccgggataattaaactccaaacctgccctaaattgcccggtataatcggtttcttcggtaaaaggtgtttttgtcaggagcttaacccttagcacttctggaagttcccattgctctccctcaattttttcctgctggggatgaacttccactttaaggcagtcaggtaaatcgctgccctccctaaaaactactggcccaatccagtccagaaagttccctgctctggcaatctggccatcggacagagtatctttcaaagcctcggtttggctttgccagccggccattttctttgctaagtttttcaccgtaccaaccaaaataagcttttccctggcccgggtcagggcaacatacaaaatccgcatctcttccgctaaagtttcccgccgcatccgctcactcaaaatttgcgaagctatggaatggcgccggattcttttctccgggtcaaaaaatttaggcccgaaaccaaggtcgctgtggagaaaaacagtgttgctgtaatcaaatttaaaccgtttcccaaggccaaccacaaacaccaccggaaactccagccctttgcttttatgaacggacataacccggaccacatcatccgcctcgccaattaatttggccggtgaaaaatcctcggattctgctgcctggcttaaaaaggtaagaaagttataaatgcccccaccgttaatttcagcaaaatccactgccagatcatgtaacaattttaaattcgcctgccgcacttctccgccgggataagctccaaaaatctccggtaaattagttttacggtatatttcattcacgagctctgccaaactaatttgccgggacagtttctgaaattcaactaaaagttctaaaaacttttggctttttaccgaaagctcatcctttcctaaagatttatttttaagagcatcatagagaaggccttcggggtattccttccgaacctgccagagttcttcataggttaaaccggcaacgggtgagcataacaccgcggccaaaggaacatcctggcaggggttatcaattacctttaaaaagctggtcatcagcaaaatttccttggaatttaaaaagctgccagctccttcaacgtaaacaggtatccccgccctggtcaattcctcctgccaaatattggaagagttactgagggaacgtgaaagaatgacaatatcccggtactgcaaaggccgaaattccttagtttcccggtcaaaaactttaaaaccttcttctttgagctttaaaatttttgccgctaccagccgggcttcccggtggaccgcagttagatcttcctcgggttcaccgtttgagttaatatcctcttcgggttttccttcaattaagtgcagttccgcaaaacagttagcattgggaagatagtctgctccctttttaagaaaagctttttcatcataagaaagctccgctaccctttttttcatgatttgcttaaagataaagtttacggtagcgataatttcctcgcggcttctgaagttcaggcttaactctattttcttttcatcagtaaaatcttcatatttctttagaaaaatctccggccgggcccagcgaaaacggtaaatgctttgctttacatcgcccaccatgaaaagattttgcccatctctggagacataagttaaaatctcttcctgaaggccatttatatcctggtactcatctaccaatatttccacgtatttttcccggagttcccggtaaactccactttttaaaatatcaagagcccagtgctctaagtcggaaaagtccgcaaaaccatgtttccttttttcctcctgatactttcgggaaaattcccggactaactttaccaaagggtcaagataggaggttaaagttcttaactcttcccgaaaattacctgcttcccaggaaaaataacgtttttttatggtttcaaattgctcttttgccttatcccgtaagtcttttgcttcgtccttgcccccaactcctcttccccaggaaaaggttccaaatttcacctgactcaagtactgctttgccgcctcgtacccctcatttagtttcgcatacagtccccgcaccttttccatatcttctgctaagagggaaaaagccctggcctggccatacttttccgctacacttttagcccgtcctaaaagctctaagatatactccaaccacatttcggtgctactttttatttcccggtaccagaaagtatcttcaaacctttcccagttcccgttaaataaatttaatgagtccaaaagccacttttcaggctcgggattggaccgggagaaatggtaaaggttaaggattagttcctttaagttacggtcatttttttcatcgtttaaatattccaacagggcaaaaagttcccggtcccctttttcgtatctctcctccaaaatttcctctaagactttattttttagatacgtttcccttggtccctctaaaatcgcaaacttggtttcatacccacacacccgtccgtatttccggataattttatgacaaaaggaatggagggtagaaatatcggccactggcaacagttctaactgttctaaaatccgtgaatttcccggatcttcatttaaacgctttaaaagctccgtcccaagacgctctttcatctctcccgctgctgcctcggtaaaggtaaccaccaaaagccggtctatgtctaccggaggtgtatccgtcaatacccgggataatacccgctccaccagaaccgaagttttcccggctcctgcagcagccgatactaacagggcattacccctggaggtgatagcccgcatttgttcggctgtccagtttttcatcccccacacctccccctgaaagcgccagcaacacttcgggatcttttttcctgggtattacccggtattgtttttcctgttcttccaaacggcacacttcaagataagaacaatacctgcagccggtagcatcttttaattgatagggtattgccgaaaattctccggcgctaattttaaaaatagcttcggtaataagacctttaattttggtaaatagagcttccagttccgccggggttaaagcattatcaatcctgccgtctttataagttcgtaaatttaccgttttaaacttgttgttctgggcataaaagctatctaaatgttttaagctttcctcatcctttaaggcataaccactcaggcgaaaatttttataaacttcttcctttaactcctccattgagagaccttcggccttctcatctaacatggggttttgaaagcgaaaataaaacgctcccgcaggcaccaaattttctccaaaaagttccttattttcactggccactaaaagataagttaaaagctgaaggttaatcccacccactacttcgtcaaggcttattgatatagagccggttttataatcaattattctaagataggtttttccattgttctcataaacatctatccggtcaattttaccggctaacgtatatttctctccgttgacctcaaaaaccggggattttaacctttccttttccccaaaagctatttcttctccaaagggagtaaatttagtaaagccttcgaaataagcaagagcttcaatagctttaaataacataagatacagacggtttaaaaagtaccttccccggtatgtggccaggaatttttctccgtattcttgctgggctttggtaaaagcttgataaactaaggtttttaaatcttctgctaaaagggttgaaagcttctgccctttttcccttaccgtttttattatctccgctactgccccgtgaagaagagcaccaatttcggttgcttccggagtaaaaatttctcgctcttcggctttaatgaggtattttaaaaaatattttaatgggcagctataataagtttccaaacgcgaaaccgaaagggttttagaagggagaaattccttaaaaccggcatttaactttattttgccaggattggtggcaaaagcccgggcgatttttgttataagctccggcttacttagcagtaaagcattaaaagctccttgagcaataaaaggtagctccccgttctttttaacctttaccatttctctggaaagaagtcttgttaaggcctgaggggtggtttcattaccgtaagatccttcctccgattttaaattgggaaaagctttctttagccagtctactaaaagcgccggagtaaaactttcaccggtaagacttacccggggataagaaacataaaccctttcccgggcccgggtcagcgctaaaaatacgtgaaaattatcctctttaagccgctggcggattaatggtgaaagttccaatcccacctttttaagcttggcccgttcttcctcggtaaaaattagtcccgctgccggcggtgagggaaatttcccttccaccgctcccaaaataattaccgccctagcttcaccggtccagtaacgtttgctgccacctgcccgcacctggtccaatcctttggggatggtttttagagaaagttttgccaggtatgctaaaagttcttccgcaaaggtagtaggatttaacctttcagcgccaaaaacttcttctatctcggttagtaaattcgtaaaggcctgccagaaccgctcaccattttcatcggaaattcttcggggaacacctatttttaataagagctgttttaagctctggctgaactcccggtaagtgttaattagcggtagtatttgcgaaaaagaaatgatttccccaaaacctttctcccagctctcccagtacgatgaattggggtcctcccaggcctctttcaaaactaatttttcaccatccaatccccggcttaaaaggtaattttccaaagcaaaaacttcatcggcggttaaatttaataggccggattttagacaattgatagccgcttcccggttaaactccccgagcactccttttaacaggaaataaagtccgtggtggtcaaaagcaaggcctttatccacatataccggcaaaccgtattcgttaaaaacagttttgatattggaaatatagtagccatcttccggtattaataccaggatatcggaaagtttataccccttaaatttggcaagatagcggatgatccgggccgctttttccatttcttctaaagggttggcagcagcaattaaacttaaattttctaaagacccggagtaaggatcaggaagaagcgggtaataattctgggccaggtgaagaagttctgaagctcgataacgttcaattttttccagttttagctcttttacttttatacctaaatttaaagcctcgctataaagcctattaaatatccccggatcgtattctgtaggcaaagttacggtaacttcggcgcaggtttttaaaagggttttaataacttctaactccaaaggtgtaaaagtataaaaaccatcaataaacacttttgcccccgctaaaaacttgctcttaggggcatattccaaaaacttttctaaaagtccctcgctggtatactcttctccaaatttttctaagtataacttgtataacaggtaaacatcttttaatttttgctgcagcatccaattctctatttcagacgacgctttttctaaattctccggttttacccggtaacgccgaaactctttaaataactttaaaaggtcttcgataaacccgggattatccgcagctttttgtaaaatttgtagttttcccttattttcctgtaaaatcttttttaatgtatgctgataaacaaattcggaagagtttttaaaaaaagctttaaattcccggacaacatttaaagcaagtcgactaaaacttaacacctgcaggcgaaagctcccgggcaaatcctcccgggtatttaaaagatactcgttttcaaaagtagcgctctccggcactatatacagcaccataggccccagcggtgcttcttttaaaactttgattatctcttcccggcagtaccggcttttgccggaacccaccggcccccttactatcgtaagcacaatgatccctccagggacggttctgtcagtgaccattttcgtctaaaaaaattggaagcgattttacgcctccttttaaattcgctttttaaattttttttccttttttttaaagaaagtaagttttataaaatacttctgaagacgatcttgaaaatggtggttgtaagaaccgtccctacagtgacaccagttccgctttcatactctctaaatccaccaccgcaaaggttcccttgccggtcaagactcccgccagttccccgggattcacatgcaaagttttgccctggggcataatgtaagcctgatgggtgtgaccggttaccaccaaatcgtatttaccgcattccaccagtgcccgggttaagacttcgttggtaccgtggtacaccgcaattttccgtccggcaatttccacttccccggcttcatggtagtactcaatgccgagcttatccaccacttccctaaagtagtaatgctccccttcgttgttgccaaagacggtaataagccgcccttcccggccaatcccctttttcagggctatagccgcaaagggtgccacccagtcgccggcgtggattatggtggtaatccccttttctttaaaatactccaccgctttttgaatgttggttaaattatcatggctgtcggacactataccaattaacatgcaatcccctccttggtataattttggggacagtccctattcttatacttaaagtataattttagggactgtccctatctttatacttcgagttttaaaaagctgctttgagcatcctttaaggtataaaatagcactccaagtcctataagaaaagaaagcccgacaaagcccacggtgcacggccagaaggaaagtttaaatttcaagaagaaaagccagtagaggccgatttgcataaaaggaaaaaatattcctaccgtggcattgaggttttgtttaaaagctttttgcgggtggtcccagtttaaatagggccgctttaagtcaagtaaaagcccggctgccagaaccggtaaagcgcttaaaagtaccgccggtaaaataaataaggcttttaaacccgaaatcttcaaaagaaacgcaccccctaccgcaaaaagcgaagctattatcccaaatacataaccgtgggccagtttccctaaaagccaggttttttctgagaccggaagacttttaaggtagtaaagctctttggcctcccgggagatggcggtagaggtgatattggtagccgcagccaaaaagaccccaagggataaaaggccggctaacagataattctcaaaagctttgttacctaaaagctttttaatttcacttaagccagtaattccctgaaaataaaaggaaataccaaaaacaaagggtatgataataataacaagcggaccgtttaagaaataaaccggttcgcggttcataagccggatttcccgcagaaggttcgaagtaaagacaggttttggggtaaaagttaactccccttttaccctccggcgtccaccgcccccttccgcccccacttttaagctcttttcgtaagcccgccccagggtataaaggcctaaagctaaaaggccaaggctaagaataatgttagcccccagggaaaaagcttttatagtaacatcctctccggttaaagatttcaccgtaagcaaggccggaaggtaaattttataaagcttcaggtttataaggttggggtcggaaaattttgcgacaagcattcccggatttttctcggccatttgcacggtattggaaaatttttgaataagtatcgctgctccaaggccaataatgccgcccacatacatgagcaaatcttttttccgggcaaaggagaagcttctaaaaatcaggacaaaaacgataaagactaaagtcaggggtaaaataggtaaaagaaacaaattcaaaaaagcagtaacccagtaataaaagccttcaccgccaaaataaccgtaaaccccggcaggtatgccgaagaaaagtacggctatgggaaggtggtaaaaataatttaccagtattttcgcccctaaaagctctctcccctttaacgacaaagccaaaagatactccgctccatcgtaatagtaacccgaaaggattgttatcactcccagggctaagataattaaaacggtatttaccgctcccagggctagcacggtggattcaagattcacctgctttaaagccaggaaaaggtttttataaaaaacaacgttcatggaaaaaaggcccgacaaagagaaaaggattaagacgataaagccaatagcctttaaaaattctttgggattttggcgataataggaaaaagatcgaaccgccagcaaaacttttgttaactgcaaagtttttctcatgaccgcaccagctccaggaaaagctcttccaggcttttatcttcctgcttctgggtttttagatcttccatggttccggtaaagattagctttccttttttaataatccctaaagtagtgcagagcctttccgccacttctaaaatgtgggtggaaaaaaacaccgttttaccccgggcagcgtaatcctgcataagcttttttaagttaaaagacgactccggatccaggccgatcatcggttcatccaagatccagatgtccgggtcgtggaccagcgaagcaataaccagaagtttttgcttcatcccgtgggagtagctgccaattctatcgtttatcgccccttccaggctaaaaagttttaaaagggggggaatcctttcttccctgagcttagcggggacttcatacacatcggccacgaaatttaaaaattcaaggccggaaagcctggggaaaatttccgaagtatcgggaacataaccaaattttcttttggctttaagaggctcttttaaaaggtcaatcccggaaagctccacttccccggtgtccggagccaatatgccggtcataattttaatggtggtagttttccccgccccattggggcctaaaaagccaaaaatttcccccggcggtaccgtgagatttaaattatccaccgccaggacctttccctctccgtaagttttggaaatattttttaaacggatgatataaaccactcctctcgacaaaaaatactaactcttaacaaattataagcaacaaaatccccttgaatttcgggccagcggctgtcatctccagctttttggttatttttgttattaattcgtcccggttttaaaaattcctctaatcctcgctaaaaaacaaggcacaaataaaaccggcgttttagccggcatcaatcaataactactgcgggattaccaccggaacattattaattttgtagactatagctttaataccataaacttgataaatgttttccgtactcaatactttttcatcaccaaaggccacaatttcaccatcttttatcagtaaaaatttatcggcaaaacgtaacgcctgattgaggtcgtgaagaatggctattatggtcattttccgctcccgggcaaacttttttaagagtttcagaatttcatactggtgtcttagatccaaattgcttgtcggttcgtctaaaagaagaagtttcggttcctgggccaaaagcctggccactgctactttttgtaactcaccgccgcttaactcatcgagaaaacgtaaagcaaactcttccatttccaaaatctttaaaacctcttccaccacttccagatctttttgcgttgcctcaagccggatatgaggccttctccccaccaaaactgtgtcaaacacggtcaagcggcttacctcttggcgctgggccatatatcccactttacctgcaaaccaacgaagattggttcgaaatatctcttggccttccaaataaacagcccctttttttattttaaggttacggcttaaacattttaataaagtcgatttacctgcaccgttattgcccaagattgctaatatttctccttcagcaactttaaagcttacattattaagcacagctttactgggataatcaaaggacacaccgactacctctaaaagcattcgcctccccctttttcaacttattttccccgaagtaagaggtataaaaacaaaggtgctcccaaaaaggaagttaccgcaccaaccggtaaaatcaccggggaaattaccgtgcgggcaaaggtatccgctaaaagcagtagaaccccgcccaataaagctgctccgggcagtaaaaaccgctggtcatggccaatgacccggcgcaccatatggggggctaaaagacctataaagccgatgatcccgcaaaaggaagttattactgccgcaatgccagaagaaaccagcattccccaaaaacgaattttatcggggtcaactcctaagcttctggccccttcttctccggtaattagggtattgtaattccagcggtttaagtaaaagtaaataaaagccaaactgatcccgataaccagtagccttacttcttccagccccaggcggcccaaatccccaaaactccaaaaaaccaccgccgcaagctttaactcatcggcaaaatactgaagcaaagtggtacccgaagcccaaagggaacctatggccacccccgcaagcgcaatggcttccggggcaagttttttcatttttcccagccacaaaactaaaagggacgtcaagagggcaaagctaaaagccgtcaagctcaccaaatagcgattaacatagtttatcttggcatccgctcccacctgataactccccgcacctaaaacaatgatggcaaaggcagccccaaaagcggccgcctgggagataccgagggtaaagggagacgccaaaggattttttaagagaacttgctgcacgtttccggcaaggccaagtcctataccggccaaaaccgctcccgctacccgcggcagacgaatttcccagatcaccgtctttaaggcgtccggacccttccccaaaattcctttaaccacagcccaaaagccaagtttcatgctgccggcattaatggcaaagacgattgctatattcaaaattactaaaagaatcaataaaaacaaaactttttgccaaagatagctttgatagatttttcccctcattttcctctcccactaatcaaattttagcggaccaaaccctccgaactttttctttaactcctgatacaaaggttttcctaaaaagaacttgtaaatttcatcggcttttttcaccggatccaccccggcaaaggctttggggtagattactttggcaacatagtaagcatcggcaaaagctgtctctatgttggtattgtaaaaattataggggagcagtccgtaaactttatttttcttaaaggcagttaaactctggtaaaaactgctgtttttgctataatcctctttcaccaaagaaagtcctccctcatcgataaacaccacctcaggatcccagagcaaaatctgttcccggtccacggtaattgctccctgtttccctaagccatcggcaacattctgggctttaaccatttttaaaatgggatgggaaccctgagtactttcaaaaccccgggctcctttaaaacttaccgcccccacgtaaaccttcgggctttttgccttacctatccgtttggccaaatcactcttgattttttggacgtaattttgcagttcccgggctcttttttctttccctaaaatttttcctattaaatttattgattttaaagctgtgtcgtcaaaaaaccctgcttgaccgtaatttaaaactactacaggaaccttaacctgttgctggagccggtctgctcctgccttatccaaaagctggacgacaaaaattaattcgggcttaactgctaaaattttttcgggatccggctgggtatccggtccaccctggccaatggtaggtaatttttgaagtttaggataagctaaaatatatggtttggcatttggctgtttttcaattgcctcaaccccaacaatacgtgccgctccatccacataactcaccaaacgtaaagctcccggtcctatagctacaacccttttgaccggttgctttatggtaatttttcgcccggctaaatcagtaaccactatggtcttggtcgtaactttttttgtagccgcttgcgtttttgaacctacaccaaaataagttaaccctatacttaaagctaaaatcagaataaaaatgcccaaattacgcgccttttgcattttaccttccccctttattcacaaactttataatcaataaaacaatctttacaaacaatctccccctggtaaagccgggctttaggctccattaccgcttccccgcatttactgcaagttaagcttttgaaaattcttaccggccggaccttaaaggaaactttctggattttaaataattggtccgaaggcattgttaaaatttcttccgcccgtttattttgaagctctgaaaaacgcctcctttcctcttcagtagcttttttctctaaaattttattaaataatttttcctggtccgagcttctttgccaaagctcgcctcgtaccaccaggcgttctcccttgccccaggatatgctgccaaaggtataagccattttgccggtatctttgtaaattaaccgtcctttgccaaaagtacatccggtcaacacctgaatggcatccacaccacaggcatcattttcggtaatgacatataaatcgtccaaattccctcctttctccaaaaatcgttccaaagctaatttagccgcccggtagccaatggccagtcccgggcagacatgtccgtggaactccaccacccgttcccaatccgtaaatactctacacacctacaatccctcctaatttttgctaaataaaaaagccgctaaagggctgcttcagcagccagcttcgcggcttttttcttcctatttaattgccttatagaacttcaaagcgtctaccttctggtagaccttttcaacaaaaaaattcgacactcaaaataattttccttccttaagattaattatttttttcacattttgcccccgttatcaactaacttcaccttttaggtctcttttttcggaaatatcctcttcctttaaaaacaagcttacaaacactttaaccaaatccggatcaaattgagtaccggaaccttttaaaagttcctttaatacttctttgcgcgtaagaggtgctcgataaggtcgcggggataacatcgcatcataggcatcaataattgccataatgcgacttaaatacgcaatttcctccccccttaacccctggggataacccttcccatcccagcgttcatggtgttgtaaaataaggggagctatagccgaaagttccccggaggtcaaagcaattcggtaaccaatctccggatggcgctcaataatccgcctttcctcaggagataagggttcaggtttatttaaaacattttccggaacccccagtttgcctatatcatgcatctccaccaaaaggacaagcttatccatctcctcccgggataattttaaagctggaccaaatttaagggcaacttttttcatccgttcggtattgtgaaaatccctttccattaaagcagtttttagagctttaaccaacgccacccgggcatcattaccactggcaagtttgtttctatacatcgcatcatcggcttcccgcaaagtttcccagagggaaacacccggttttgaggctgttgaaacgccgatagataaacttaggggtaaatcggggtgaagcttattatactcccctaccttttccaggattctctgggcaatttcttcggccgcttctctggaagtaccgggcaaaagaatgccaaattcatcgccaccaattcgcgctactacatccgattgtcttactccatttcttaatacttcggcagccctttttaataataagtctcccttatcatgaccaaacatatcatttaccgcttttaagttatctaaatcacaaatcaagacactaatagggtattcccgacctttttccatccgctttacttcttcttcaaaaaatgctcgattatacagacctgttaacacatctctggtgctgcaatattttaattcattttctataattctcttttcggttacgtcccgaacgcactggacggcccccagcaagttgccttcatcatcctcaataggtgcagctaatgtccagtaacaggctccctttcctccataggcatttggcgccaccccttctccgacaatcaccttacctcttttttctaatttttcataaccatttataccaatttcactaaaattaccaagcaccagatctacgcaaattggttttcttctcccaaaaaacggctcggcatatatgtagtcgccttttcccaaaatctcttctttcttaaccccggtcatctcttccatcgcctggttccagacaatcacccgcccatatttatcaatcgctaaagtagcatcgggtaaggaatcaataattttttcatataaataaagcttttctaacagattttcccccctttcaagggccgttataaatctctccaacgctgaaagcttctcttcggaaagttctttcaccatcaggataagtttatccttcagggcagtcacttttctcatcctttcgggtaaaggactctaaatttcccttataataaatttcatttattaagttataaacgttagttatacacttcgccgtaactcaaaattatcctgcaccttttggcaaaaaatttaaaccggcttttttagccggtatagggatatactttttaaataatcaagcgggtaaaatacaggataatccaggcggcgggaattaagatggcctggcttaaaagagttcctaaaaatttgcttatcactagggacaaaacaagccggttcagcgaatccagcggcaaggctccatttaagaccctgtcggttaccattgccgaatacgggtcaaccagtaaaaccaaaactatcgttgcaaaaccgttgataattccggagagctgactggcagttaagcggtactccgggtttaaaactccggcatacattgccgataaaacaccggtggtataaatgccggttattataaggtttaataaaaggattttatagggcatttgctcccgggcaagtttttttaccgatttaaaaggtactccccgaatattttcctttatagcctgggttttccgctgccgcagggtcacaattatgagcctgggaacggaaccaacttcatccaatttatttaaagctatagtaaaaaaatttataaaggtaggtattaatactgccccaatcaaggtaccggcggttgctccaaggagtacccagcgaaaaaccatttccaacccggccaaatcatgtttaagcaaagcaatttccacgatactacccaaaaggggtgcttgaatcatattagaagttctcgacaccaggacaataatattaaaaaccgaacccgccaaagcaagttttttagttttaattcccgctatccgggcagcaaacgacaaggtatctatcagatggataattaaggttaacaaaaccaccaaagcaatccgcttaaattccatagctatctccttaaattatttttaattcttttctattatagcattttaaacaccggctattaaagaaaaaagcgggcaaaaaatattgcccgctataagcgtttttcaattgttcccccgcctaaaagttcatcaccccggtaaaataccaccgcctgtccgggagtaattgcccgctggggttcattaaacaccaccttcaccttatcttttcctatcctttccaccaccgccggctgcggtttggcattataccgtatttgagcttgggcttcaaacctttccggtatttcatcaaaccagaggaaatttaaatccgaagcaatcaagcccgggctgaaaatctccgaagcttccccgataaccacttcgttggtttccggtctaatatcaaccacataatacggctttcctaaagccaggcccaaccctttgcgctggccaatagtgtagtaggggtaaccctggtgctgtcctaaaactcgcccgtttacatccacaaaattacccggtttaatttcttctccccggcgctccttgagaaacttgcggtagtcgttatccggtacaaagcaaatctcctggctttccggcttatctgccgttactaagttgtacttccgggcaagttctcgcacctgttccttagtatattccccgagcgggagtaataaccttcgtaacatgtcctgagtaagattgtataaaacataagtctgatctttttttcggtctacaccgcgaaatagcccgtatttacctatatcatccttgtaaactacccgggcataatgaccggtggccatgtaatccattccaaggcttaacgctttttttaacaaagcgtcaaatttaatataacgattacaggcaatacagggattgggagtacgcccccgcaggtattcttcggtaaagtagtctattacttttctttcaaacagttcccgaaaattcaagacataataaggtattcccaaacgatctgctacccgccgggcatcattaaccgcataaattgagcaacagcccacgtattcttccccgataacctcaattttcgggtcccagatttgcatggtaacccctactacttcatacccctgttccagtaataaagccgcagtaacggagctatcaactcctccgctcatggccaccagtactttttttctacctataacgtccactccttcccaagaaaagaaagcggtaatataccgctttcttatttttgcccttttttctttaagtaatcctcgatagcaacttttaaggcatcggcagctaaattggaacagtgcattttttgcggtggtagtccatccaaagcatcggccacagctttgttggtaatcttcattgcttcttcgatagtcttcccttttaccatttcggtcaccatagaactggtagcgatagctgccccgcagccaaaagttttaaattttacatcggtaattttatcaccatctactttaatgtaaatccgcatgatgtcgccgcaggaaggattacctacttccccgactccatcagcatcggggatttcccccacatttcgcggattggtgaaatggtccataactttttcgctatacatcataattactctccccccaacgctttttggttataaagcggagacatctcccgcaatctttccacaattcccggaagaacctccaggacataatcaatttgttcttcggtattggctttacctaaagtaagcctcaacgaaccatgggcaacttcatggggaattcccatggccagcaaaacatgggatggatccagggagccggaagtgcaggcggatccgctggaagcggcaattcctttcatatccagcattaaaagcattgactccccttccacaaattccacgctgaaattagcattatgcggaagtctcttggtaggatgcccgtttaaccggacatagggaatcctctccaaaactcccttaatgagcttgtcccgtaattttgttaatcttgccgattcctccggcatttcggcaacagcaagctcaatcgcttttccaagccccacaatgcccgctacgttttcggttccgggtcgccgttttctctcctggcccccgccattggccaggggctcaagttttaatccttttcttacatacaaagcccctacccctttgggtccataaattttatgggccgaaagggataataaatcaacttttagctcttttacatccaccggtattttaccaaccgtctggacggcatcggtgtgaaagtaaacccctttttccctggcaatttctcctatttcggcaatcggttgaatggtaccaacttcgttattggcatgcatgatggtaattaaaattgttttatcggtaatggcttttttcacatcttccaccgataccattccgtatttgtctaccggtaaaacggttacttcaaaaccttccttttgtaaagccaaacacgcatccagaaccgcatgatgttctacagcagaagttatgatgtgatttcccttatgcttataggcccgggcaattcccttaatcgccaagttatccgcttccgttccccctccggtaaatactatttcgccagggtcggaagcgtttatcgccttcgcgactttctcccgggcatcctcgatagcctttcttgcttcccgtccaaaagcatgaatgctggagggattgccaaacttctcggttaaatagggcagcatttcctccaatacttcccgggataaaggagtagtagctccgtgatccaggtaaatccgttccatagctgaatcctcctaactaaaattaaatataatacattaaattttggttttgattttttttggcttcttcaatcatatcctttaaggtaatggagtccaacaccttatttaaagcatcccgcactttggcccaaaccacgcgcgaaatgcaggcatccgcctggtcgcaagcttctttcacattttcggaaacgcattccaccggtgctatgggcccttctaagactctcacaacttctccaacggtaatttcttcgggaaggcgatttaaaaggtaacctccctgagctccccgcacacttttaatgaggccggctttccgcagtaccgaaaaaagctgctctaaataaggttcagaaatcatctggcgccgcgcaatctctgaaataggaaccggcccttccccataatgcaatgctaaatcataaattgccttcaaaccataatgccctcgggtcgaaagtcgcatggttcaccaccaattccgagtaaattactttactttcaaaaacatcatagcacttactcaagtgtatgtcaagaattccgatttatttagtaaagttttttacttttccccacaattccttcagccgctgttttatttgggcttcctgcccggaatcggaaggctcgtaaaaacgctgaccttttaagttttccggtaaatattcttcaaggacgaagtgaccagggtaatcgtgagggtacttgtaaccttttcctcttcccaactctttagctcccgcataatgggcatcccttaaatgctggggaattgggccattttccccttttcgcaccaccgcaagtgccctgtcaatagcttttatcaccgcattggatttgggagcacaggcaatataaatagctgcttccgccagcggtaatcttgcttccggcattcccacaaactctaaagcgtgaaaagccgctaccgccacatttaaagccatgggatcggcaagccccacatcttccgccgcatgaacgattaatcttcgggcaataaaccgcgggtcttcaccggcttcgagcatgcgggccaagtaatacaccgccgcatccggatcggaaccgcgcaaacttttaataaaggctgagatcgtatcataatgattatccccttctttatcgtaaacaattgcttttttctgcattgattgctcgataatttcaacggtaattttccgtactccgtcctcatccggcggggtagttaaaaccgcaagttcaatgccgtttaacgccgcccgggcatctcccgccgccatggtaactaaatggtcaagggcttcttcagaaatttccaccttatactcgccaagcccccgttccttatccacaagagctcttctcacaatttctcttatatgttccggctctaaaggtttaaactcaaaaatccgggaacgggataaaaggggagcgtttacttcaaaatacggattttcggtggttgccccaattaacactatggttccagcttccacttcgggtaataacgcatcttgctgggctttattaaagcggtggatttcatcaataaacaaaacagtcctctcgccataatatttttcccgctccttagctttttttattacttctcttatttccccaacccccgaagttaccgcatttatactttcaaagccgcttttggttgtggaagcaataattcttgctaaggttgttttacccgttccggggggaccgtaaaaaattaaagaaccaagccgatcacttaaaatagcccgtcttaacagcttgccttcacccaagatatgctcctggcctataaactcgtccagactcctcggtcgcatgcgataggctaaaggagcttccttattcactttatttttggcagtatcccacaaatccataaaactccccttccgaccgcaaaataaaaaaatgcgcttttttaaaataaagcgcacttaaccgctcattacaaattttttataataattttcattaattcgtttttatgtttaaacccgaccgttcttcccacttcttccccatttttaataaaaagaagagtcggaatactcataatcccgtaacgtcttggtgtttcagggttgctatcgacatcaagttttccaacggttaattttccttcatattcctgggcaatctcttctaaaatcggtgctatcatccggcaggggccacaccattcggcccaaaaatcaacaattataagtccttctctttttagtgcttcggtttcaaaattttcatcggttaaggtaataatacccattttaaaaaccgctcctttccccccggtaaatatcaaccccacttataaattatactcctctaaatattttattgtcaattaaagcaaagcttgaggtccattacaaaatcttatgccttagcaaaaggtctcttaccgcctccccggcagcaattaacccggcggtagccgttacaaacataacgcttcccggaaggtgctttttctctgccggcaacggctcatcactggtacctctttccagcaccggcggttcttccgaaaatacaacttttaccccttgataaatcccttcttttttaagggcctgtcgaacccgccttgttagaggacaggtatgggtcctggaaatatcggcaactttaaatcttgtagggtctagccgattaccggctcccatgaccgaaataaaaggtatatattttcgatacatgtaggtaattaacgcaattttattttttaacgtatcgatagcatccaccacatagtcagggttgtacctgaaaaatctctcggtattttccggtgttaacttttccgttacggttataacctccgcttcaggattaatctcccggattcttttagccaaaacctccgcctttaagagccccaccgttgactccagcgctggaagctgacggttgatattggtaaggcttacacggtcgaaatccaccaaaaccagggaacctactcctgttcgggctaaagcctcaacggctggagaaccaacccctcccagcccaaaaaccatcacccggcttctatgtaaaactttaagcccttcgctacctattaaaatttccgttcgggaaaaccggtgcatagcaacacctcacagcataaattgacacaagaaaaccccgctttgccgtaatccacgaagttccgaaccccttctctaccaggtgggtgtcctcctgattgctttgggcttcccctaagcggggcgtgcacgccacaatcagagtccggactccctttgtatgagtgttggatacgaacttcccggtggactacgcacaaagcagggtgcgttttcttggttaaatcataacacaaaatcgtactgctctcaaggttctaatttttggattattgctgctctttaaccggcaaatcaactttaatgtgaagttcctttagctgacggcgttcaacaacattaggcgcaccaaccattaagtcggtagcactttgggttttggggaaggcaattacatcccggatggactctcttccggccatcagcattaccagccggtcaaagccaaaagcaataccgccgtgaggaggtgtaccgtattcaaaagcttctaacataaagccaaatttttctttggcctcttcctccgaaaggccaattaatttaaacatcttttcctggatatcccggcggtgaatccgaatgctaccaccaccaatttccacaccgtttaagaccatgtcataagctttagcccgaaccagtaacggattttcatccatcagaggtaaatcttcatccatcggtgccgtaaaaggatggtgcatcgctacaaaccttttctcttcgttatcatattctaaaagcgggaaatctatcacccagaggaagttaaactcattttcgggaattagcccaagtctttcagcaagatggagtcgtaagttccccaaagcttgagcagccacttccggtttatccgctacaaagaataaaatgtcaccgggttcgccctgtaaagcattaatcaacgctcttaattcttcttctttaaagaattttgcaattggcgactttacttcttcaggtgttaaaattaaatacgcaagacctttggcgccaaagttacccacaaacttcgtaagatcatccaggtctttgcggctaaaacccgcacaacctttggcgtttaaaccgcggattaccccgccagcatgagctaccgtttgaaacactttaaactccacatctttcaccagttcagtaacatcggtaatttccagtccaaaccgtaaatcaggcttatcggtaccgtattttagcatggcttcctggtaggaaatccgcttaaagggtgtttttacctcaaccccaattgcttctttaaatacgtaagctatcatttcttccattaaactcatgatgtcttcccggtcaatgaacgacatttcaatatcaatctgggtgaactccggctgccggtccgcccgcaaatcttcatccctgaagcaacgaacaatctggaagtaccgttccatcccggcaaccattaaaatttgcttaaagatttgcggtgactggggcaacgcataaaattttccggggtttaaccggcttggtaccaaaaagtcccgggccccttcgggcgtactcttggtcagcattggcgtttcaatttcccagaagccatgccggtccaaaaagtcccgaaccgctttcgccgctttgtggcgaagttcaagagcccgctgcatttcggggcgccgcaagtccaaatagcggtagcgaagccgcacctgttcatccacatcaattccgtcttcaatgtaaaagggcggggttttcgctttatttaaaacctcgactttgctggcataaacttccacttctccggttaaaaggttggggttttccgtgccttccgggcggagtctcaccgttccctctattgctaaaacgtactcgtttcttaccgcctccgctacccgaaaagcctccagatccacgtcaggagaaaaaaccacctgcacgattcccgaacgatctcttaaatctacaaagattagaccgccatgatcccttctcctctgtacccagccgtttaaaataaccttttggccggcatgttctttccgtaactctccacagtaatggcttcttttaagcattgtccttacccctttccctggcatatttttcgataagttcatcccgggaaagctctacctgctcacccgtatccaggtctcttaaaataaacctgcctgactttaactcctcttcgccaataattaatgccgcttttgcttttaggcggtttgccgcctttaactgagccttcaagcttttcccctgataatcggtttctacccagaggttcagcctccgtaattcatttattaaaggaaacccgtactcgcgggcttcttctcccaaaaggcagacgaaaaggtccggcacaggaacggaaatctcttcgctttttctttttaaagccaagatagttctttcttcccccagagcaaagcctattcccggctgatccggccctccgatctcccggattaagccgttataccttcctccgccgccaatggagctttgggctcctatctccggcaccacaaactcaaaagctgtcttggtataataatcaagcccccttactaaaaaggggtcaattacgtattttacttgagctaaatccaggtatttcctaacctcggtaaaatgctcccggcaatcggggcaaagctccgataagggcgtgggagcattctgggcgattttttgacagctttcatttttgcaatccaaaattctcaagggatttcggttaagccttgccttacacaagtcgcataattcctctttacgctcttcaaaatagttaataagtttctcccgtaagcttttccggcactcagggcaacctacgctatttaagcgaagctcaacgtcattcaggccaatctcccggtaaaactccagcgccattaaaattacttccgcatccaccatgggctcatcgctacccaggatttcaaccccgagctggtgaaactgcctcagccttccggcctggggtttatcgtaacgaaacatcggtccaatgtaaaaatacttcgcaggaccggggtcggcgtatttttttgcttcgacatacgctctaatcaccgcagccgttccctcgggccgtaaggttattgaccttccggccttatctaaaaaagtatacatctctttttctacaatatcggtggtttccccgactccccgctcaaaaagctccgtatgctcaaaaatcggggtgcgaatttcctgatagccaaacctccggcatacttcgcgaaacttccgctctatctcctcccacaggaaaacttccggtggaaaaaggtcgttagtgcctttaggtttctgggtaagcatctataaaaatacccccttttctataaactaaaacccgcccctggaatacccagggacgggattacccgcggtgccaccctgcttgaaggtagaaaccttccgctcttggccgtaacggggccaaaccgtcttaacctactaagacctttcagttaagccgcctcccgggtgttcctttaaaccggcattcagagaaaagctctcaatcgcggcttttcctccctgtctgaagccctctggtttaaaagtcccggtcattgcgtttcgttaattcattttaaccttagaacagcctgttgtcaataattctttttccgcacaaagccaaagctgatttttcttcaaactcatgaccacctttatttgttaacttgttttattttattcaacaaattttagggttttcctgccagtaattttgcgaaagctcccggtatttttgggcaattctcgaccagtcataataactgtggataaagtcgcggtttaaattccagatttgctcctctccaagtttttcgtaaagttcaaggagccttttgcctttgtccactatttcccttaccccttcagcagtacgcagtttactcaagataaaggtatctaagcttaaattaaatccctttttctttaaaaatgcggtgtaattggtaattatcgaagccatacctccttctccgtccaccagaggcagcgcacccgctgcaatcccttccaccgcaaccatgccaaaagcctccttcaccaatgaaggaactaccaaaagctttgctcgctgaattactgctgctaattccgggtgaaaaatctgcccggtaaataccactctatcgcctgtcaggttttggcgtgctaactttaagtattgctctttttcgctcttcgtaagctcttcataaaacattttcccgggattgggataaccttcttcgccgtaatttaaaatttccgctaccaaatcctcccggttttctcttaaaaaataaaccaatgcctccactacctcccggtagagtccgtgacccacaaaagcagcattaaccttttcctccaaaagatacggtagggccagggctaaaagctggggccctttggcatataaatgttttcccaaaaataagattaaatttcgtcccctacttaccttatttagcttttccccggcgtgttgatccgttagcgaatagtcataatttttgcggataaaatctatatatttcaacagctcatttagcgatcttacctggcttaacccatgataaaagctttcttcggtttccttacttcttccattacctttaatttgtagcaaatttactgctgcaagttcaccaaaaagtttcccatctactcctggagtaatctctataactttttccggataatcaaggtacggttttaatctccgggttagttcattgcttaacgtaataactttgtaagctcctttaattccttcccgggcgtaaaaatgatagcgttcatcccgttcaatggtatagctaatgtcacttccatgaacggttatgctgtaaggtaaaccaagctgtttcacaatatagggattaattattaaatgctgggcaaaaacaaattgaatattgtggtttgcgctaattatttttagtgaagtcaccatttcattaatataccgctctaattcttcaattgagagctcggtaaaagtttttaccttaaatcccgggtaatcatcataaacaaaaaccggtaaaagactggttttaggattatataaaattacttttcccccgggattatgataataaggcacgagttttccggtatccggctcaactataatggcatcccggataaagggatacttttcagggtttctttcctgacacaccaatacggtttttagatctttttcagcaaagttagaggccaagtttcgtaccaagagattacttccactcccggaaagaaagtaaccgtgaagaaggagtaattcctgcacaaaacttcacctctctttttttaaatttagaagcttaaattatcaaaaaccatcatcaataaaaacccaaaaataaccccaaaagtagccagactttcaccgcctttagcatgggtttcgggaattatttcatcggaaattacgtaaatcattgctcctgcggccaagcttaacgcaaagggtaaaatgctccctgaaagactgccaagaaaagcccctattactcctcctactggttcggcaagcccggttaaaaaagtaatcccaattattttccaggtggaaaaggaaaaaccgagaagacttaccgccaccgataacccttccggaatgttttgaagaccaattcctaaagctaaacttaaggctttggtgatatccttttctaaaaagccaatacctactgccatcccttcgggaaagttatgaatggtgattgccaagataaataaccatatcttatttaaatcactctttggaccctcagttccagaagccggatggaagtgcgggatcaatcggtccaaaaaataaacaaacaaggaaccggttaaaaagcctaaagctgttaaaaaaattccaccggtctctaaagccggcagtaaaagactaaaaaaagatgcagcgagcatgataccggcagcaaagcctaaaagtacgcctatcgtgcttttcggaaactcttttttaaaaagtagtaaaaaagaaccaagcccggtagcaaggccagttaaaagagaagctaaaaacgacgccataaacttcctccgtaagttttaatttaagcaatttaccgggaatattttaccatttattaagtatttttttctataattcgacactttttatcagaagcttaatttataatttgggacaggtaacaggctggggaattgaatacaaagaaaaccataaaataattggcacttgcggctttgtctaaaagagtaaagccttccgcttaatgcagaaggcttacattttcatccgggcaattctatcttttttatattcgttaagtacccgggacaccttatcccattcagcggctcgtttgtccaaaaattccgccgtagctcccgttaaaacttcgtctgctccttcgtgggttgggtgagcattactttcggcaacgatatctcttagagcctctggaacatcaataattggacacggagaaaagtagttttccgaaaaaggctggcgtttctgataagctgtaaacagcggattctttaaaacttcttttaaagatttctcattaatattatctacagcaaaatgaacaaaagcgcagggctctacctcacctttagcattaatgtggaaataacttctacccccggcaatacaaccatgggtaatatggccgtcattccagaaatcggcaatcatgattggtttggtaatccgcaaaaccgggattctctgggctaaataaagtcgctcttcgggggtcagcatcaaggaagtatcgggatttttacctaccggtacataatggaaagaccagatgtacttaactcctttttcaaccaggaaatcgataaactcatcggatgtaagctccaggtaattttcccgggttaccgttaccgaagctccaaaatatactccccgttcgcgcagtaaatccatagcccgggtaatcttggcaaatacccctttgccccgccgggcatcggtccgctcctcaaacccttcaatactgatagccggagagaagttaccaacttttgctattttatcggccatcttttcgtcaattaaagttccgttggtataggccataaacgccatatcgttatgtttttcaaagagttcaaagaggcgctcgtacattaaaggttcgccaccggataagacaataaagtaaattcccagctctttggcttcattaaataaccgatccaaccgttcaaaggaaagctccggacctttttgatattttcctgcccagcagccggtacagccaagattgcaccgtgaagtcggatccaccaggatggtaaagggaacgtgaacaccggtctcagctttatactgcttttgcctaggaatcccaaacaacacaccatttataatggtattataagcaagcttggatatgatttggggatttgtttcactaaaaaagcggcgaaactgttctttaaccgcagggtatttttcatagctctctataaggtagttaatataagctttatggttttcttcccgggcaattttgtgtaaaagttttaaaatatttaagatatttttttccgggtctttctctaagtatttaagaagctcatttaaaagtttttcggctacaaactttttagcaaactccacattaaccttaagcgccatacccccacctccgaaattaatttttatacccaaaaatccaaaatttccttgaaaaaaatttaggttctcacctcccggtgaaaagcttcaaggagcaaaagcagcgcctttgcctcttctaaagctaagttttcaatacaagcagtaaatttgccgagactctttttgatctttccaatttctttctgtccccgttcgtttatgtgtaaaagccccaatataaagcccggaagctgttttaattgaaattcaacaggtttctgcggccagatctgcggaaaacgggcaagttccttaatatttactttatgcagcacaaccgttaaatatgccaaaaaagtggaacagtagacaaaaggagtattttctgaagccagctcttccttcattttctttaaaacaccggaaaggctcttggttttaacttcgcgaatctttcttaaaagctcctcttctatatctttaggtaccattttttgttttattttgggaataaagcccaccgctgagcgtcccggtgcggacttacccttttccaaaagatactccctaattaccagtccttccttctctaaagcccttaacatatcgtacgcggtccagcggctaaccttcatctcttccgctaaaatttggtacgataccggaaattttagcttatcgtaaagctctcttaatttggccaaaaactgttccttgcgtttggtaagacccaattttatacccccaaaaaaccaaaattttaattatattttataccctattttaggaaatatgcaagatagtgttattgtgttttagtcttgatttctgtttaacattgatttttcacagcttaaatatttctttaattacctcttcaagcattccttcttttgctaaaaagaagttcataaaatactttatttctctaaaagctttttgtaattggggttttgtactattcccccaacattttttaccatcggtgataaaagcaaaatctatattgttttcttttaagtctctttgcctatttatataactgtcaattatttcctctggttttgaacctgctccgccaaaaaagtttacctcaatatttaagcactttttatcttttaataaaataaaatcagcttttctttctgatatattatcggatatctcaaacccgtactcttcttttaagactttaaactgtttttgctctattaggataatttcatatttatcacaaaggtccctaattattggataacatgctaattcaaaggcatgtccaccacgattttttctcccattagaatctaatccaactaaaacgcctattacataatcaataatattattttgggcaagatttagaaataaatgttttaatcccattttttcaaaaaaataaagataattttcaatttgttcgtcggataaacctttttttagcgttttaagactaaaatcatattctaaaatatcactttccccaatcttatcatttattataagtagcttttcagtaccattccatgttttttctctttcagcttttgacagtgcaaataaataaggaaaagttgctacaacagtaggcattttttttagtaatcttttaaacgtattatcaaaatcttcatttcttattaaaacattcattgcatttaattctatatcaaattttttatattcctcaacatttttccaatttacataaaaattaaaagctctatttgtctctaataggcttcgaacaaataaatcagccaactcatctttttgaaggtttaaatataacatatttacactccttttatttcttaaaaacaaataaatattcatgagcaattaacaaaaaattatactttatgctttgatttctccaatagccagttgaactacaattatgctgttctttaataataatctcctttaatttaaatcctatttttcgaaatatctccataacactaaatcctatagggataatatatccttttcgccgagtatccccaataagaattgcacaaaacttccctttttttaatactcgataacattcttttgcaactttttccatttctaaaagaaaatcgttaacgtcaaaatgcgaaagatcaccctcgatattatcgctatacttaataatattactataaggtggatgagtacaaatcaaatcaatgctctcatcttttaaaaaataaagatttctcgcatcacctacccgtacctctatctctccaccctcctctatttcaaaatttgtattttttaacgtaaggcttactgcctccggattaatatctaccccaattccttttctttttaacaattttgcttcaactaaagtcgttccactaccaacaaattgatctaatacaacctcgccttctttagaataccttaaaataatattccttggtataaagggcgaccaattcccccgatattttcctgaatgagttgcccaacttcccctgtcaggaaaactccaaacagtagtggtttcaagagaaaagttttcaggcgcccaagttcttggtttattatttacaggtgtataatttttttcttcttcttttagtaaagattgtgaatgttttacaacttcttttataaacttttgggttacaaaataattatttgctatttctttaatactatttcccttctcataatctcttttaattgcaacaactaaattttgatacacttcaggatgtaaaagttctaaatgtactggatattcagttttatttattttttctccgcaatatttacagttcatttttttagccatttttactacaacccctgccctatgtctaaaatcacctaaacccctattccaccttataattagtgataagcaattcctttattaatcctctaccttgcccatctgagtttatcgatcttcttgccataacccgataaatattaaaatttttatataaatcatcaaaaaaattatcattagggtcttcatttttggggtcagaattacttaaaagaagaaaagcacctaattcgttcatttgggcataaaacctggcaagttcaatttggtctttatctgtaaaatcacttttactatatgatgtaaagtttgaagttttatttaacggacgatatggggggtcaaaatagacaaaactatcttttgaaatatacttagcactttcccgataatcaccagcaaaaatttgaaccttttgtaatagtgaatttaccaagtaaagatttctttcatcacaaatagttggatttttataatcaccataaggaacattaaatttgccttctttattaaccctgtaaagcccattaaaacaagtgcgattaagaaaaataaacttagcagctctttcaatatctatgtgtttagtattgcttacttttgagttatactcatctcttatttcgtaatacattttttttctattatcattgtctaaattataatatcttttttctaatgattttaaataatacaccaattcatcaacattaaatttaatcaccttataagcatttatcaaatcaacatttatatcaaaaatatacgcttcctcgatattaaatttttgtaaaatattaaataatacagctccaccacccacaaaaggttcgatataacgctttatttccccttgaagtagtttaagaggataatatctttctaaggtgttaagtaattgtccttttcctccagcccatttcacaaatggtcttgcgtattcggttattaaaaaatttttggcaattaccaaaactaaatctccccttttgtgtttaggaaaatgatttctaacaacattttagcttaagtaagactaacttagctataaaaatttttactccaccgcttcaatattgcacagcacgtcataaaaaggcacaccatcccccatatccggacggacctggggtgttaaaacatttaccccgccaccgtctattccccagctcccttcttcaatcaccaccgtatccggccgcacccggtcggacacttttaccaaaccggtaatttcgccggtaacggtctttacccgcacttctgccagattatcaagattatggcgggcagcggtagaaggatgaataaccacccgcggttttgttccccactccgccgattccaggttatgaaattgcgaatgtaaataatctttagggtgaaccgttaaaagccggtaaggaaatttcttggcggttagcgaatcgtaagcctgataaagcccaagtcctttcccggccattaactcaatttttccggaaggggttaaaaacttgccgtcactgaaagtaaacggcgccaggggatggcgaacataacctttttctcttaaaatctcaaaggtaatccccaagggttttagcggttctaaagcttctatgataaattcccgggctgtttttggttcaaagtttttaaggccgattttccttgctaattcgttccaaaactccacttccgtaagcataccattgggcggagtaactatcttgggcaaataacttaaataataatgccaggagctaaatacaatatcctcttcctcaaagaccgaggtagcagggattatcaagtccgaagcataagcggtatcggttaagaaaaagtctacggtaactttaaagggaacattataaaaggcctctttcatcctcttggtatccggcgcctggttcaagggattggagcgggttacaaaaataagcttgataggtggttctgccgcaagaatcgaattggccattaccggccaaggaaagtacctctcccgcactttttcttcagcctttacaatgctaccaaaataaggtttccagagaggatgggcatagttaggtccaccgcctttaacccccacattgccggtaatcgctaaaagggcatttatcgcccgcacggtgttaccgccgttttggtagcgctgaagtccatagccatataacacggcaatgggctttttaaaagcaaaaagttttgcgagataagctaaatcgtcttcacttatcccggtttcttttaaaactttttctaccgttatttcttcggtaagccttgaaaactcttcaaaatttataaccttttctttaacaaaagctttgtcgtagagcccttcacttattaaaagacgggctattcccaaagccaaaaggccatcggttcccggttttaaagaaatatgccttccaattgctacctttattttaaggggatttatcgccacaatctctgccccggcttctttggcctcctttaagaacggcagtaaatgcaaattcgtggtatccggatcccgcccccagagaataatagccttgctgtttatcaaatcgtggtactcacctaaagtcggagctccaaagtccctttgcattgcctcatagccgctaccccagcaaaggctgccggaagggttagtaactccacccaggcaattaaagaagcgttcatctaagcgctttaaataacctccggaaccatggtcgtataaatgtaaaatcgaaagggtttccccttttgcatataactcaccgattttttccgttaaaatggcaaaagctttttcccaggaaattttccgaaaactactcttttcttttaaaaggggctgagttaaacggtccggagaataggtcctctcaattacttttttaaattttgggcaaagaaagccccgggttaaaggatggtttttgtcccccaaagcttttaccacccgaccatcttctaccgttacctcaacccggcaggaatcataacagtttaaggtacaggttgtggaaaatttcatttatatgcccccttagtgttctgaaattggagttttaaataacctttaaataacttaaaaaatacatccatcccaaaagagtaaataaagataaaaaagtagaaataaatactccttgagctcctttgaccgcgtcaccgccgtatttattggcaaaaatagcagtattggccgccgctggcattgctgctaagattacaggaattgcaagcattacccctctatttccagtaaaaaataatattccaaaagtcaaagcgggaattactaataacctaataatagccagtatccaaagtttaaaatcggttaaaatttccttaaaggacagttcccctaaaatcgaacccaccaaaatcattgagagaggcatggttacctcgccaatctcttttaaagcttgtcccaaaaataagggcaattttactgaaaaataaaagaacgaaaaccctatagccaccgctataattcctggattgataaacatcttttttatctcttcccggctaaaaatggttttaatgctctctccctttaataaagcaatccctacggtccagttaaaaacttgaaaaccgatattataaagggcagcctgaaaaacaccaatttttccgtaaatggcatgtaaaagaggatatcccataaagccaacgttggaaaaaataaggataaacttgtaaaccccggcaatttcccgggataaacggaaaaatttcaccactatttcggcaaaaatggtaacaagaaagtaataagaaaaagagataactaaaagcagtaaactatccagtaaaagctttttactgaaaggaaactgcattgcagaaacaatcaggctcggcagggtaataaaaacaactaagtcgccaaaagccgcgtcggtattttcactaaaaaatcgcttctttttaagaataaaccctaaaagcaaataaactccaaaaaccagtatctgattgaatactgcttccattccttgcctccattttttgtttttatatcatatatcttaacaaaatctcttttaaaaagtcagcaaaaaagttaagatatgattgtatacaactataattatgctaaaaggagggtatgaagtgaatttagacagttacattgaaagcctgaaggaagatattgttcgcaccactcaagaatggataaaaattaaaagcgtggaaggagaaccaaagcccggaatgccctttggcgaaggtgtaaaccaggctctcttaaaggctctcgctgactccgccaaaatgggatttacgacaaaaaatgttgacggctatgccggctatgctgaatacggtcaggggaaggagttagtaggtatcctcgtccacttagatgtggtgcccgaaggagacggctggagctatgacccttacggtggtgtcattgtcaataaccggatttacggccggggtacggtagataacaaaggcccggcggttgcctgcctttatgccctaaaagcaataaaggatttaaaccttccggtctccaaacgagtacggattatttacggtttaaacgaagaatccggctgggcctgcatggattactaccgggccaacgaagaaattccccagcttggttttgccccggatgccgaatttcccatcatttatgccgaaaaagggattttgaccttaaaacttgcccgggaattttctaacctaaaaaacggcgagttagtgttaaaatcctttaagggcggacttcgagccaacatggtgccggattttgccgtagcggttttagaaggaagtgaaaaagctctaaaaaccgcttccgatgccctggaaaattacaaaaaagaaaaaggttttaagatggaagcggtaattgaaggcaacacccttaccattaaatcctacggcatttcggcgcacggcagccttccggaaaagggtaaaaacgccatagcccagcttttagtatttttgaccactctgcctctgcccggggacgatatttccgcctacttaaatttcttagctgaaaaaataggtttaacttataacggagaaaatattgggttaaaactctcggataacgtttcaggtaatcttaccctcaacctcggcgtcttagaacttaccgaaaaagaagcttacgctgctttaaatattcgctacccggttacctataaaaaagaagatctcttaaaaatcttagaagagcaaatttccggtaccggcatttacttaaaagatatctccgatatggctcccctatacgtacccgaagaccatttcttagtgcagaaacttaaaaaagtttatgaagaaaaaaccggcgagcctgcccggttaatagccattggcggcggcacttatgcccgggctattcccaacgccgttgcttttggtcctctattcccgggcatggaagaacttgcccaccaaaaagacgagtatatcgatatcgaccatttaattcagataaccaagatatatgccgcagcgatttatgaattaattaagtagcaaaaagccctgaagcttttagcttcagggcttttaattctttaattttcaacagctacttctggttgctgcggcttacttaaaatattcagccacttgataattgagcttaccataacgataatcgatagagacaacattattgctactaaaactgctggtaccatttgcccctgcgggagataaactttggtaagatttataaaaccagcatccattaccgtgacaaaaaggaaggtcattggtaagaaagtagtcagcgcataaatccgcttttgactcttctgtaatatcattgaagtcccaatagctaacgctaaaaccccaatagtttggttggctaccccaaacaccggccagatagttttaatatctccaccataaattagataaccccaggtaaaggaaacaaaggcacttaaaactacagctaaaacagttgatttactttctttaattggctcataaatcattcccagtaagtcctgagcaatataccttgccaccctggtacctgcatctatggtagttaagataaacagagcctcaaacatgatggcaaattgataccagtaagccattaagtgttttaaacccgggatacttgcaaaaatgttggccatccctaccgccagggatacagctccaccgggacgtcctgcaacatcctcacctacaagtttagaaagttctggtaagtgaactaccggcatattcaacgttttaaaaatttccggcttggtgttgatggcaaagtaatcacccggcattaaagtagtagcagcaattaaggccattaaagccacaaaggcttccgttaacatggcaccatagccgacaattttaatatctttctcgtttgctatcattttcggcgtagttccggaactgaccaaagcatggaaaccggaaatagctccacaggctatggtgatagaaataaacggccatactttgccaccaattatcggaccgccgccatggataaatttagtaaatgccggcatttgaatttggggattaactattataattcccaatgccagtgccaaaatcgttccgattttcatgtaggagcttaaataatcccgcggtgctaataaaagccataccggcaaagctgctgctaaaaagccataggccggaagtaaaatttccagtgttttatccgataaagtcaggtacggagctaagaacgaatttttgacgtacggtccaaggaataccgctaaaagaaccaagataacgccaataagggaagcttcaccaatttttccgggacgaatcttatgcatataaagaccaataaatattgctatggggatggtcatggcaatggtaaagacaccccaggggtttttaaataacgcattaactaccaccaggcccaaaccggccatagttaaaataatgaggaaaaataccgcaataccggttgcaacccctgctacagggcccacttcctttttggcaatttccgacaaacttttgccaccgtggcgaatggaggcaaataagaccaccatgtcatgcacggcaccagctaaaaccgacccaattaaaatccagagggttcccggaagataaccaaactgcgccgctaaaaccggacccaccagcggtcctgctccggcaattgccgcaaaatggtgaccaaaggcaacccatttgttcataggtacataatctttaccgtcgttgtatttttcagcaggagttttccgcatttcatccaaggttaaaaccttagccgccagaaaactcccgtaaaaacggtaagctaaaactaaaataagggctgccccaatgataagttctaaggcactcacaaaactcaccccttcaaataataattattattccctaacctaatttaagggacaacccttacctttgcatataattttgtaatataatgttgaatttttgcaataactgtcgaaaactttgtaatatttgttttatatgtttaacccaattttttctttaaagcttttcagaaaagtcctgcctaccggcacctcactggctccatcatctcccattcttaaaatcaatcccccaccaaaaagcggaataatttcttttatctgctcaaagtttaccaaaaagctcttatgaacttttacaaaatttttttcgccgagcatatcctccaattccgaaagagaatgccggcacatgacccacttattttttaaccttagccgggcatatctcccctgagcttcaacgaaatatatttcctctcttttgagcggtaaaattttatccgcagtctgaataaacactttttgctgtggagcaatggcttggatactctgccacatcttctgtttgtatatctctttatctcttaacttttcctcaattttttccaaagtcagctttaccctttctgcagaaaaaggttttaatagataatccaaggcatttaattcaaaggcttttaccgcatattggtcgtaagcagtggcaaaaacaattaacgggggatctttttcctttaaaagctccaaggctacgtctaaaccgtttaaaccgtacatttcaatatccaaaaaaaccacatccggttttcggtctcttaaaacctcaaaaagctcttcacccgaatctgcttccccgataacttctactctttcagtttcctccaataaatactttagttcttcccgggctaaaggttcatcatccaccacaaccgctgtgatcatcttaaagcctccttgcttaaaagaggaattattaacctggatatcgtgcccccatcttccctggaatataaataaaattgcccttcttcccggaaaagattccttaatctttcttttagattggaaagtccaactccaacttttacgtcctccctaagaccaacaccattatccactatctcaattaccgctttgttatcctgaagtttggcatttatttgaactaacccaccctttttgggcaaaatgccgtgcttgacagcattctctaccaacgtttccacagcaaagggaggaaccataacttcttttactttatcatctatatttaaatttacctgtaacttatcagaaaatcgtgctttttcaaaggtgagatacaattccacattttttaattcttccgccaagggtattaaaggctcccattcccttaaattccgccggaaatattcgctaagctttattatcaactcccgggcctgatcgggattttttcggcaaagagctactatggtatttagagaattaaacaaaaagtgaggattgatttgagcttgcagggcttttaattcagccctggccaaaagctttgcctgatgttccagcattgataattccagctgggtggaaattaaacgggataatccttcaataaaagtaatggtaaattcaccaattttgtcaggtttattgtaataaagctttaatgcccccaccacttcgtttctaataaataaaggagcaatcactgccgacgccaatttacaattggaattgctgcagcctatagcctccttatttaaaactacggttagttccccgttatttaaagctttagcggtagcagctgtttttattggtgtgccgcttaaatggtgatcttcgccactgccgacatgagctaatattatgtttttatcggtaagggcaacagcatcagcatcggttttatttaaaataattctggaaaccttaaaagccgtttccctatttaaaccttcccttaaaattggtaaggtttcgttagcaatatttaaagccttttccgcataaaccgctcctatatgctctttttctttcaccgtgctttctaatattaaaagaaaaacccctatacctataccgtttaccaaaatcattggcagtccaattacttttactaaactaagggcatcttcaaagggccgggctaaaagtaaaataataatcatttgtaacgtttcgataaacataccggttaaaataccaaaaactacattaaaccttttttccggaaaacgccgggccaagaccccggcaattaatccctcaacggttgtagatatgccacaagccactgccgtaaaaccacccagccaggcccggtgcactccggcaattaaacctgccagcaaacctgcggcaggccctccaattataccggcaatagcaggccctactactctggagttagcaatagcccctttaatcggtatcccccagtaagtcccgatgattccaaaaagtccaaaccccaaaattagacccaacttttggcgaatggttaattcctgttggagaatattgcgaaaaagtctggttttggaaacaaaaaaggctaaagtaatgatgacgcttaacctttcaattaaatttataaacaattcattcatgttctcaccctctaaataaaacctctaaataaaaatgaggcggcatcctaccacctcgtttttaaaattgttttatgcttcttttttcttaaaagtattgctttcaccgcactgaggacattttctcggtttacaccgggtttctttttcataaccgcacttttcacatacaaagactgccatttgagaaccctccatttaattttatttaataactattactattatatcaaatctatttttcttgaaaagagtattttcattaatcctttaaaaaaggattatgctccttttcataccctacggtagtctccggaccgtgtccgggtagcacccgggtatcttcgggcagggtaaaaattttctcccggatggattttaataacttttcccaggaaccaccgggaaaatctacccgacctaccgaaccaaaaaacaaggtatccccggaaaagaggacatcacagctgtataaacaaatgctccccaaagtatgtccgggggtatggagtactttaagtttttctccaccaaaaattatttcatcaccgtccactacttcctgatctgccggcgccagcttcaccgctcctcctaaaaagccagataaattcttgctgggatcaagaagcatcggggcatctttgggatggattaaaactttcgcaccggttttgttgcgcacctcatccactgccgctatgtgatcgccatgaccgtgggttaaaacgatatattttagttttaagccattctgatcgataaatctcaggatcttatctccatcaccgccggggtcaattgccacagcctcgcccgtcttctcgcaccacgctatatgacagttagcagcaattacccccaccgttaaagtttttatctgcacccttttcacctcacccaattaaatttccacaataaccgtaacaggaccatcgttaattatttccacttccatcgtcgcctgaaaaatcccgctttttaccgaaacctcttgttcttttagtatatctaaaaatctttcaaatacctcccgggcaacctccggtggggctgcctcggtaaagcttgggcggcgtcctttacgggtatcaccgtaaacggtaaaattcgaaacgactaaaatctcgcctcctacatctttgacactgtaattaaattttccctttccatcctcaaaaatacgtaaatttactaacttttccgcaagataccggcactctctctccccatccccctgtcgtatcccaaccaaagcaaccaggccaggtcctatctcggaaacaacctgtccgtcaacggtaactttcccacgtttaaccctttgcactactgcccgcatataaccctcctatttatttacccgataaacttcggtgacccctctaaccttttccaatttatcggtaatttgttttaattgattgatattttttacctccagagccaaatccaccacagctccaccatttttggtactccgaccggatacataattggcactaattttttgttcggccaatacccccaagatgtcatttaaaaaaccggcccggtcatgaccgcgaatttccagacggactgtaaagggaagttcaatagccccttcccagttcacttctaccaaacgctccggttcgtggcgccgaaaatattcaacgttccggcagttagtatgatgcaccgaaacgccccgtccgcgggttacatagccaacaatagggtcccccggtacgggcatacagcactgggcaaggcgaaccattaaatctgcttctccccgcaccactaagccccgggttggcttattaagggtagctttgctttcctttattaccctttcttcaatacttttttcagttctgggaaggccttcacgaattttattaagaacggtattaggagttacagttccatcgccaacggcagcaaataaatcttccagagaatgaaaatttaattttttaactacttcggatattttttctaaagaatactcttcggggtttaagcccagtttcttaatttctttttcaattaactcccggcctctaagggccaactcttccctctgggtctttttgaaatacgatttaatttttcctttggcatgggaagttttaactattttcagccaatccctacttggagcggctccctgcttggtaataatctcaacaatatcaccattttttaactgataatctaacggtaccagcctgccgtttaccttggccccaacgcacctatttcccacgtcagtatgaatgcggtaggcaaaatcaatcggcaccgatcccgccggtaactcaaccacatcgcccttgggagtaaaaacaaaaacagaatcggaaaaaatatcaactttaagggtttccataaactcccgggcgtctttaagttcccgctgccactcgaggatctggcgtagccacgatagcttttcgtcaaactttttgtcgcctttacctccttctttataccgccagtgagcagcaataccgtattcggcagtgcggtgcatttcaaaagtccgaatctggatttccaggggctcgccaaaaggtccaataacggtagtatgcagggactggtacatattagacttcggcatggcgatgtagtccttaaagcgtcccgggaccggaatccacatggtatggataatacccaacaccgtataacagtcccggacactttccacaatcacccgaaccgccatgacatcgtaaacttcgctaaaatctttttgctgttcccgcattttttgaaaaatgctgtataaatgcttgggacgtccttcaattttggctttaatattatatgactttaatttttcttctaagatagaaataacctgttggatatactgttccctcttggccctggttttggcgattttttcgacaatgtcataataattatccggatctaaatagcggaaagccaaatcttcaagttcccacttaatccggtaaattcccagtctatgggccaggggagcaaaaatttccaaagtttcccgggcaatttccttttgtttttccggattgtggtactttaaagtgcgcatattgtgcagtctatcggcaagctttattaatattacccggatatccttggccatggccaaaaacatttttcttaagttttctacctgctgctcttctttatttttaaactctatccgggataacttggtaactccatcaactaaattggcaacttcttccccgaactcccgggctatatcctcaatggtataagccgtatcttccactacatcgtggagtaatccggcagcaattgtctcatcatccatctgcaaacccgctaaaataaatgcaaccgccaaggggtgggtgatgtaatcttccccggaagccctcttttgcccggcatgcgcctctgccgcaaagttataagcttttttaattaattcttcgtccatgttgttattataattctttattttttttaaaagagcttccagcgaaagcacatcctcacccctttctctttaagttttttgtcttttattataacacatccggataaaaaaccttaaaatattcccgaaggttttgctcgtattccttggcccgggcataggtgctggaaatttccagatttattttatcctgggaaggtggaaacaaaaatacccattttttaccgtcctcttcccaaatttttattaaatttaattctgttaaaactttaagaatgctaattaaaagcaagtaatcatctttcaccctcatttcatcaccaaaagcattaaaaaacagctctttctcagaaaaagtaaagggatttcccgttaaaagtttttgccgcagagccatataaactttggcaattttatcccgctggggtaaaattcgcacaagccgcagataaagtatttttagatcttctttgttagccaaaactcccagactgcccgaataatccgtaagcagcggaatggtaacatctaaaaggagcggcggagttgtaaaaattatttgttcaaaggtaaagtttaatgcttccggcaaatactgctcggaagtaagtaatattcccgtttcccggtattttttcagggctttctctttaaaagtttcccttagttcaggacagtaaggtaataaagtaaaaccattttcccacagttccagggcctgaccgtacatttccgcaagattagctgtaaccactaacgttttctttgttcccgcaagttttataaaactaaactccctctggtttaacttgttaattctccgggcaaaacttactttttccggatggttggcaaacttataacaatacggttttgctaaaagggataactcttcttcaatggtatttaactctttttcctttatttttttaactttaaaaatacgcccttcccccggagcaatttccttgacatttagttgcagttccgttttaccgttaaaccgattgggcttaggaataaacgctaaatctacttcgttctgctggtagacaaactctaaataatcccctttagaaaacgcaatggaactaaaaatttcccggttaagctttacattaaactttaggtgatttccgtttttcccaacggcttgagctcccctaatttggccacctttaattaaaaaaagcggttcgggattttgttctccaaagggagcaaaaagcgcaatttcatccgaaatctttaaatttaaatcattttcacccacaacctcttccacttctattttgggcagtaaaagctcgtccggtaaatgtttttcggcataagccagcagcgcttctttaaactccaaaaagcgggattttaggacccctacccccaccgcccgctcgtggccaccaaaatgggttagataatcctttaccgcttttaaagcctcaaacaagttaaaaccaaaaacgctccggccagaacctttaccttcttccccgtcaaaacttattaaaatcaccggacggtaatatttttccatgagcttcgaagcaacaattccaattacgccgggatgccagccatctccacctataatgagaattttttcccggtctaaatccacttccctttcaattgtttccaccgccgccttaaaaatttccgcttcgattccctggcggttctggttttcttcggaaaggcggtaggctaaagctaaagctcgctcgtaattttcttcaatcaacaattcaaaagctaaagcaggatccttcaagcgcccggcagcatttaaacggggagataatataaacccaacatccctggtagttatttcttcccggtttaattgagctacttctttcaaagcttttaatccgggacgcccggtagcggcaagcctttttaatccttcaattacaaaaatccggttttcatccacaaggggtacaatatccgctatcgttccaacggtaaagaggtccaaatactggtctaaaatatcctcttcccgctcccccagagccattcctaaagccagaaccagttttaaagcaacaccaaccccggccaagcccttaaaagggtaaggacaatctttttgcttgggattaattaccgcctccgctactggaatttcttcctggggctcgtggtggtcggttataaccacctttgcccccatttcccttaccgttttaacttcatccacagcggttatcccacagtcaacagaaatgataaaactaatcccctcttctaaagctttcaccagaggtgggagatgaaggccatatccttcatccaaacgattgggaatataccagtctacattaaagcccctttttcgcaaaaagtcgtaaagaagggcggtggaagtaaggccatcggcatcgtagtccccgtaaattaaaaatttttcggtgttccgtccggaaagaattaacttgacagctttttccatatcctttaataaatagggggaatatgtatcatcaatatttccccagaaaaaccgccgtacccctcgcgggtggaaaatacccctatttaccagcattttagccgttaaaggctctatcctaaaaaaatcctccagatacttttctcccaaatgcgaagtttcaaaaataagccagttctttttttccatttaatcctccaaaatttagttaattatttatacccaaaattactattctatgttagtattttactatatattacttgcaaatttaaattattatcttcaattttatttcaggagggggaaagatgctgggaacaattgtaaactttattgccattcttcttggcggaagtatcggtgtattttttaaaaagagcctgcctgaaaactataaggaagtagtaatgaacattttagccttatcggtagtagtcgttggtatccaaatggctatcacctcgaaaaactttttggtagtaattttaagcctggtactgggaggcctggtgggggaatttttgggaatagaaaagggtcttaactctttagggcaaaaacttgagaaacgtttttccgagagtggaggagattttgcccggggctttgtttacgccactttagttttctgcgtgggagctatggcgattatgggagcaattgaggatggtttaaataataaccaccaaattctctttattaaatcccttttagacggtatttcttcaattatatttgcagcgacactgggaaaaggtgttatcttttccgcttttccagtactaatctatcaaggaagtattgccctttttgccgggcttattaaaggctttttaacgccggcaatagttaatgaactcaccgccaccggtggtatacttataatcgggatcggtacgaacatgttaaacttaaccaagctaaaaataggaaattacctcccggcactgatctttgtcttcgtctttgagcccgctttgcgctttttaagctaaataaggaaggatggaaatatggaaaagaaaaacctcggcttaacttatattttactggttatagttgcaatgctttgggccagtgcctttgttgccgcccgggaagtggtcagggaagtgcctccggtagttgctgcgaccctccggtttttactaagcggcctaataataatgccccttgctttataccgggaaaaaaaccggcgttacgggttaaaaaattacctgtatcttgttatcatgggatttaccgggatttttctctataacctctttttctttttcggcgtaaaattcaatcccgcttccgacagctcgctggttattgccgtcaaccccattgttgtttcgctgttggctgctcttttcttaaaagaaaaacttacgtttgaaaaaatattaggactgataatttctttcatcggagttttacttgtcatttcggaaggtcatcctttaacttactttcagggaccgcttgaacctacccgctttttacttttcggagcggtaatttcctgggcaatttattccgttatcagcaaaaaggttatgggaacggtttcccctttggcaacaactgcttttagtattttctttggtgctattttctttcttccctggggaatcggagaaatgcaacacgttaatatgttaaaaatatcgttaaaaagttatcttttaatcattcatttagctgtattccctacggttctcgctttcttttggtggaatctcggaataaaaaaagtaggtgctcaaaaatcagcactttttattaatttaattcctatctttaccttgattttatctgccgtttttttgggagaaaaaataacccttccccgagtactgggagggttactggtaattttgggtgttttagaaggaagttacggctttatctcccttcctgctaataaagaaaccagtttatccagctaactttttcttcgggaatttttagatttccaagcccccgacccaggaggatttcaggcttattttccccgtgaaaatcactgccaccggatattaaaagattatacttaccggctaattccaggtacagcctggtttgttcttcattgtggtaggtataataagcttcaattccatccaagccataagatattaattcctctaaaattttttttaagccctcgtcatctttttctaagtacaccggatgggctaaaaaggtaagtccaccggctttttttataatatttatagcttgtttaggggttaatttttccttcggaacataagccggacaccctttgccaagatatttgctaaaggcttcctcaattgaagaaacataccccttttttaacaaaacccgggccatgtggggcctaccgactatatctcccccggcttccgcaattacttcttccaacgtaatctcaaaccccagttctcgtaatttggctaacattttcgggttgcgtcgctccctgttttccttaagttttgtgagcgcttctgcaaaaatcgggtcgttcacatctataccatagcccaaaatatgcatttccgttggctcaaaaaccacacttatttccactccaggaattactttaactccatacttttttccagcctctaccgcctcaataactccggcagcagaatcatggtcggtaacagccaaaatcttaagcccttccttttgagcaagtctaactaaagcttcgggagtacaagtaccatcggaagcagtagtatgggtgtgtaaatctatcataaaatcctccttctttaagatatattaccttgtttcgggaagccaaaaacagcttaaggtccctgcttcatttttttaaattatactaaaaaaccgtcaaaaagaaaaagagcagctctttttaaaagaactgctcccaacgtatcttagccacctaagtaggctgctttgacctgcgggtcttccgccagctcccgggcaggaccagataatacaattttaccggtctccaaaacatagcctttatgggcaatagataacgccatatgagcgttttgctccactaaaagaattgtcgtcccctgctcgtttaactctttaataatggcaaaaatttctttaactaaaaggggagccaaacccatagatggttcatccaacagcataaggcgcggggcagacatcaacgcccggcccatagccaacatttgctgctcaccaccggaaagcgagccagccagttgccccttcctttccgcaagtcttggaaaccgctcgtaaacccggtttaatctacgtttaaattccgccttatcctttaaaagatacgcccccagttctaaattttctaaaaccgacatattggcaaaaacccgccggccttcaggcacctgactgattccccttttgacaatttcgtgggcgggtttgccggtaatatcctcaccttcaaagattatctttcccgatttgggttttaccaatccgcaaatcgtatttaaggtagtactctttccggcgccgtttgccccaattaaggtaactatttccccttcattcacggtaatggaaattccctttaaagcatgaatagctccgtaaaaaacatttaaatcttcgattcttaatacttcttttccgctcacagttatgccccctctcccaaatatgcttcaatgacccggggattgttcttaatttcttccggggtaccgtgagctatatttatgccgtaatccaaaacgtaaatccgctcacagatgttcattacaaggtgcatgtcatgttcaattaaaagaatagtcaagttaaacttatcccggataaagccaattaattccataagctcggtagtttcctgcgggttcatacccgctgccggttcgtccaagagcagcaaagaaggatgtgttgccagcgcccgggcaatttccaaccgccgctgctctccataaggcaggtttttggccttttcttccgctttatgggctaagttcatgatttttaaaagctcataagcttcatcccgcatttctttttctccccggtagtacttcccgaggcggagaatagcatgaaccatattataaggagcatgcaaatgccgggcaatcaaaacgttttctaaaaccgaaagctcgctaaaaagacgaatgttctggaaagtacgggttatgcctttggctgcaatttcatacggttttaaacctacgatactttcacctttaaagatgatatcgccggtagttggcaggtaaatccccgttaaaaggttaaataccgttgtttttccagcaccgttgggaccgattaacccaactaaatccccttcatttaaggtaagatttaaatcctgaaccgcttttaatcctccaaaactaatccccaggctatgcgtttgcagaatggttgccatgacttacacccctcttcctctgcaaaagcttaaaggataattcgtgggtcccaagaagtccctggggtctaaacaacataaccaagattaagattatcgcatagataataagccgtaattccgccagactttgcagaaatgtggaaattaaagtcaagacaattgccgctaccaccgaaccggtgaggcttccctgtccacccagaactaccatcactaaaatatcaaaggattttaagaagttaaaagcgttgggttcaataaaggtaatgtagtgcgccagaagcgctccaccaattcccgcaaaaaacgaacccatggtaaaagcgataactttatatttagtagtattgatacccatcacttccgctgcaatttcatcttcacgaacggaaatacaggcccgaccatgactggattggacaaagtttttaattaccataaccgtaaccagcatacaaccaaaggcccagagccagttggtccgctgggttattcccatcagtccataagcaccgcccagataatcgatattggttattaccccccggataatttccgcaagtcccagagtagctattgccagataatcaccttttaagcgaagggtaggtataccaataattatacctccaataccggcaactattgctcctactaaaagggagacaataaagggagcattaaagtttaaagtcatgatagcggaggcataagcacctaatgccataaatcccgcatgaccaatagaaaactgaccggtaaaaccaaccactaaatttaaactaaccgccaggataatgtttatagcgatgataattaagtttaacatgacaaaggggcttaaaattcctgcagagtacaaaacctgaactcccaacattaacactaagagtaaaaccgttacagtgagattttcctttgtaagccagtttttcagcatctgtttcacctacactttctcccggacgtttttaccgaatatgccggatggtttgactaacaagatgataattaaaatgacaaaagccaccggatcccggtataacgaacttccatagccgcttaccaaagattcggtaatccccaaaattaagcccccggtcattgctcccggaataattcctattccccctaaaaccgcagaaacaaaagctttcaaaccaaacattatgcccattaaaggaaagaccttattgtaatataccccaaccagcacccctgctgctgctgccagggcagaaccaatcgcaaaggtgatggatattgtcgtatctacatttatccccattaagcgtgcggcctgcatatcataagaaaccgcccgcatcgctttaccaattttggtattatgaacaatgtattgcaatagaagcattaaaataatggtaacaacaataatcaaaatttcccgattggagatggtaacttttccccccaacaacggataagaaacttgtttaaaaacctccggaaaagctcgaggctgggggcccaggaaaaacatggtggtatactccaaaaggagcgaaacacctatcgccgtgattaaaattactatcttgggagaatttcttaacggccggtaagctaacctttcgataataatccccaaaattgcacaagcaatcatggaaacaatcaacgccggaacaaacgacatttttaaaaccgcggtcgcataaagcccaacaaaagcaccaagcatataaacatcgccgtgggcaaagtttatgagttttataataccgtaaaccatggtatatcccagggcaattaaagcataaatgcttcctacagatattccgtttatcaactgctggataaattccgtcattttggccacccctaaccttttgaattcatttttttgggggaggaaataatcctcccccctttaacaacttaaggatttacgtatgccttataggtctgcttaccatctttatattctaaaataaccaaacctttaacagcattatggtttttatccagggaaattttagcagtaaccccttctacatctttggtggttttcaaagcctctttaatcttctcgggtgttgcctctccagcccgtttgatagcatctaccagtactaataccgtatcgtaacctactgctgccatagcatccggctcgctaccgtatttttccttatatttcttcacaaagtcctgaactttcgggtcaggcattaaagatgaatagtggttggtaatgaaggtattgttaagcgcagcagcaccggcaatttctaccaatttcggagagtcccaaccgtcaccgccacccatcggaacattgataccaagctcccgggcttgttttacaatttgccccacttgctcatagtaaccaggtacataaatgaactcagggtttaaacctttaattttggttaagacggaacggaaatcctggtcctgggtggtatagttttcatcggctaaaatctcgccaccaccagctttaaaagcctccacaaagaatttggccaaaccaacggaataaggagcagtattatcctttaaaacagcaactttcttaagttttaagtcgttcaacacaaactttgccatggcagttccctggaaggggtcaatgaagcaagtccggaaaatgtattcccgcactttgccggtcttggggtcaacggttacatccgggttagttgctgaaggggaaataaccggaactttgttggtctctgctatattaacgtaagaaagggtattaccggaagtcatcgaaccgataatggctacaactttatcctagtaatcaaacgggtagctacagatgctgcctcagtgttatccgacttattatcatacttgacaatttcaattttcttgcccagaacgccgccggagttattaatttcttcaaccgctaacataattccatttaaaccagactgacccaaagtagcaacgtttcccgaaagctccaaattggccccaatttttatagtgtcactttcactcgacttattgccacaagcggaggtaaataaaagtaaaaacgctaataaacctaccgtcattaccgtaagaaaacttttgcgcacctactaccatcctcctttttaatttttcagttttttctaaattgttttgctctttaatttaaatcatcccagccctccgcacccctcccctcattataagggcgcaaatataatgtgcaaatcttctttatgtaacaaattatattcattttataaagcctgtctacaattttctcatttttctcttaaattttttctaaatattctgtatacacaactccagggacggttccgagaatcaccattttcatgaaggaataaaagtaaaaagggataggcagattgcctatccctttctatagttttttccggcagcgacctactctcccaggacctatcgtcccagtaccattggcgctggagggcttaactgccgtgttcggaatgggaacgggtgtttcccctccgctatggccaccggaaacttttttctgttccctcaaaactgcacagaggttgtttttttgaaggtcaagtcctcgacctattagtaccggtccgctcaaccgattgctcggcttacacgcccggcctatctaccggatcttctctccggggtcttactctggattgctccagatgggaaacctcatctcggggctggcttcgcgcttagatgctttcagcgcttatccattccgcacttggctacccagcggtgcccctggcgagacaactggttcaccagcggtgcgtccatcccggtcctctcgtactaaggacagtccccctcaagtttcctacgcccgcgatggatagggaccgaactgtctcacgacgttctgaacccagctcacgtaccgctttaatgggcgaacagcccaacccttgggacctacttcagccccaggatgcgatgagccgacatcgaggtgccaaaccccgccgtcgatgtggactcttgggcgggatcagcctgttatccccggggtagcttttatccgttgagcgatggcccttccactcggtaccaccggatcactaagcccgtgtttccacccagctcgacccgtcggtctcgctgtcaagcacccttatgcctttgcactcgccgcgcgatttccatccgcgctgagggtacctttgggcgcctccgttaccctttaggaggcgaccgccccagtcaaactgcccacctgacactgtccccccacccgcttcagggcagcaggttagaacttcagtgacgtaagggtggtatcccaccgccggctccacctgagctggcgcccaggtctctcagcctcccacctatcctgtacataccccaccaaaattcaatgccaggctacagtaaagctccacggggtctttctgtcctatcgcgggtaacctgcatcttcacaggtactacaatttcaccgagcccctcgtcgagacagtgcccaagtcgttacgcctttcgtgcgggtcggaacttacccgacaaggaatttcgctaccttaggaccgttatagttacggccgccgtttactggggcttcggttcagagcttcgcctttcggctaacccttccccttaaccttccagcaccgggcaggcgtcagcccctatacttcagcttcccgctttagcagagacctgtgtttttggtaaacagtcgcttgggcctcttctctgcgaccccctcgggctccggtcgctcccaaccttcaccctaccggggcaccccttctcccgaagttacagggtcattttgccgagttccttaacgagggttctctcgcgcgcctgtggattctctcctcgcctacctgtgtcggtttgcggtacgggcaccctcgccctcggtagaggcttttctcggcagcttggattcggttgcttcggtacttttcttccctccccttcacctctcgggctctacgtgggacggatttccctatcccactccctacgggcttggacgcgcttttccagccgcgcgctcaacctatccttctgcgtcaccccttccctcaagcgggctcgggtggcaggggattctcaaccccttccccatcacctacgcctctcggcctcggcttaggtcccggcttaccctgggcggacgagccttccccaggaacccttaggcttccggcgggcaggattctcacctgccttctcgcttacttatgccggcattctcacttcctacctgtccacgtaacctcccggttacgcttcccccaggtaagaacgctcccctacccatactggaagtcggtacctccaactcccagcatgccgaagtttcggtggcgtgcttgagccccgctacattttcggcgcagagtcactcgactagtgagctattacgcactctttaaatgatggctgcttctaagccaacatcctagttgtcttcgcaactccacatccttccccacttagcacgccctttgggaccttaactgtcggtctgggctgttcccctctcgaccatgaagcttttcccccatggtctgactccctgcctctaagctacaggtattcggagtttaactgggttcggtaacccgtgaaggcccctagcccaatcagtgctctaccccctgtagccaccagcagaggctaggcctatacctatttcggggagaaccagctatctccgggttcgattggcatttcacccctacccacagctcatccgccgccttttcaacgacggtcggttcgggcctccagctggtcttacccagctttcaccctggccatgggtagatcacccggtttcgggtctgctgcacgcaacttccgccctcttcggactcgctttcgcttcggctccggcctccccagccttaacctcgctgcgtacagcaactcgccggcccgttctacaaaaagtacgccgtcaggctttcatcgccctccgactgcttgtaggcatacggtttcaggtcctatttcactcccctcccggggtgcttttcacctttccctcacggtactcgtcctctatcggtcgccagcgggtatttagccttggagggtggtcccccctgcttcccatagggttcctcgtgccccatggtactcaggctcgtacgctgcagctacgcgtaatttcggatacagggctttcaccttctatggcggagtttcccaactccttctcctattacgcttcactgccgggtacatggcagtgtacccacccgtacggcctcctaccccgcatacgcaacggctgccaccttctacacgtatgcggtttgggctcctcccctttcgctcgccgctactcagggaatctcttcttgatttcttctcctccgggtactaagatgtttcagttccccgggttccccccgtacacctatgtgttcagtgtacggtgaccggccattacgccggccgggttcccccattcggaaatccgcggatctacgctcgcttgcagctccccgcggcttttcgcagcttgccacgtccttcttcggcctctggcgccaaggcatccaccgtatgcccttactaacttgaccttctcctttttacccccaacctctgtgcagttttcaaagaacagttattggtgataagtggtgtgtcgtcagtggtaggtttttcttttgtacctacctttaccgacggttgtggtttatggttttccccgaccacttaacactaaccaccgaccacgttaattgtggtaggtggtgagtcgttggtggtaagtttttcttttgtacctggctttgccggcggccttggtaaatggtttctgaccaccgaccacagaccaccgactactgttaataacggcaagcggctcttctctctccttagaaaggaggtgatccagccgcaccttccgatacggctaccttgttacgacttcaccccaatcaccggtcccaccttcggcagctccctccctttccgggttaggccactgacttcgggtgttaccggctttcgtggtgtgacgggcggtgtgtacaaggcccgggaacgtattcaccgcggcatgctgatccgcgattactagcaattccgacttcatgcaggcgagttgcagcctgcaatccgaactgagagcggctttttgggatttgctccaggtcgccccttcgcttccctttgtaccgcccattgtagcacgtgtgtagcccagggcataaaggccatgatgatttgacgtcatccccaccttcctccatcttatcgatggcagtccccttagagtgcccgtctttacgctggcaactaagggtaggggttgcgctcgttgcgggacttaacccaacatctcacgacacgagctgacgacaaccatgcagcacctgtctcgcggttcctaccttccggcaggcaccccggtgtttccaccaggttccgcggatgtcaagccctggtaaggttcttcgggttgcgtcgaattaaaccacatgctccactgcttgtgcgggcccccgtcaattcctttgagtttcaaccttgcggccgtactccccaggcggggtgcttattgggttacctccggcacggaacctttccggccccacacctagcacccatcgtttacggccaggactacccgggtatctaatccggttcgctcccctggctttcgctcctcagcgtcaggttcagtccagagagccgccttcgccactggtgttcctcccgatatctacgcatttcaccgctacaccgggaattccactctcctctcctgccctcaagtccagcagtatcaggtgctcccccacggttgagccgtggccttttacacctgacttaccagaccgcctacgagctctttacgcccagtaattccggacaacgctcgccccctacgttttaccgcggctgctggcacgtagttagccggggcttcctcctccggtaccgtcatccactcacccttttcgaatgagtgaacttcgtcccggaagacaggggtttacaacccgaaggccttcttcccccacgcggcgtcgctccgtcaggctttcgcccattgcggaatatcccccactgctgcctcccgtaggagtctgggccgtgtctcagtcccagtgtggccggtcaccctctcaggccggctacccatcgtcgccttggtaggccattaccctaccaactagctaataggacgcgggcccatctgtaagcggtagcatgctaaagcctcagccaccctttcctatcaggcctctactcccgatagcgtatccggtattagccccggtttcccagggttatcccggtcttacaggtaggtcacccacgcgttactcacccgtccgccgctaaggaaacagttgagcaagctcaaccgcttcccccgctcgacttgcatgtgttaggcacgccgccagcgttcgtcctgagccaggatcaaaccctccatttatatccgtacaacccctctcagggttataccccttggatagtttaatccttccttttatctgctctcgtactcttaccgagtacgggccgcttgccgttattcccttgccaaggtacctgtcgctttcggcgtttcccgccgtcggcgacgtctcttaatttatcatatctctgcgtcccttgtcaagcggttttttacctgcttttttgcttccggtccttatcgctgacgccgtgacgcttttttaatatatcaaattcctttacctttttgcaatggttattttctggaaatacattttctttactaatcatttgaacaggcttcggcttttttaacaatgtaataagctacagacaacacaaagataatcaaagtattcgtacctatctcaagcaacggatcccaaccatgacttttatttaatgaaatttgcgcttctacaaaaaggttttgtctgatagcagaaataatacctatcataataaatgaagcaatgctaaagcgttcttttttaaaaaattttatgaccgtccataaaacctctttaatgatcataattaataatgcatttccaataagtagcaaaacatttttagttatcgaaaaaccggttaaagtacttaagacaattcctccaaccgctgcaacaagcatgaacaccgcaactaagtgaattaaatactctatccaaagtaagtatcttactgcgttaaacattttttccgctactcctttctttatttacatttaaaggccggcaaatgccggcctttacttttttaaggttcaacgaatttcctataagtttgcttaccatcaacaaactctaaaatcactaaaccttttttagcattgtgctgctcatcaatcgatattttacccgttaccccttctacatctttgacatttttgagagcatctttaatagcttccggagtaatttctttcgcattctttaaagccgcagctaaaacatagccagtgtcatacccaagcgccgctaaggcatcaggtacattgccgtatttttctttatattttttgacaaactcttttaccttgggatcatcccgatccggggagtagtggtttgtaatgtagcaatttttcaacgcatctttcccggcaatttcaataagttttggcgaatcccagccgtcgctaccaccaaaggctacatttattcccatttcccgggcttgcttcacgatttgaccaacttgctcgtaatatgctggaacatagatgaaatccggatttaagcttttaatctttgttaaaaccgaacggaaatcctgatcgttaacggtaaagttttcatcggctacaacttcaccaccgccggctttaaagccttcagtgaaaaatttagccaagcccaccgaataaggagaggtattatcctttaaaatagcagctctttttacttttaattcttccgtggcaaatttagccatagcggtcccctggaagggatcgataaagcaggtcctaaaaacatactcccgtactttcccggttttcggatctacggttacatcggggttggtagccgtcgcggttaacaccggcactttattagcttccgcaatgttaatgaaagccatcgtgttaccggaagtaaccgctccaaaaataattggtactttatcctgggtaattaaacgggtggccaccgatgccgcttcggtgttatctgacttattgtcatacttgataatttcgagctttttgccgtttatgcccccggcagcattgatttcatccagggcaagggtaaacccgttcaaggcagattgaccaaaggaagccacattacccgaaagctctaagtttacaccaatcttgattacatcctcacttttcttttccccggtagatttagtcccacatgccgacgtaaaaactaacaaaaacgccagcaaggaaaccaataataaagttgtaaatccttttctcttcatcttccatcctcccgtaaacttttatatatttaaaaaaacaaacaacaagcctatcttgctcctaccatccctccattcttcaaaatttatttaattttaaaaataattttagcttataacataattttctgtccagtatttgcaagaagtatacataatacccgaaacatcttcgagtttatctattcatacctcaaagcttcaatgggatcaagtttagctgccttattggcaggatatataccaaataccactcctaccagcgtcgagaaaaatacggccaaaaccatgctccaccagctcacaataaacggccagccggcaatttttgccacaacaaaagcaattatcacccccaggattaatccaataatcccgccaagcaaacataaaaggagcgcttcaattagaaattggattaatatatcccgtcttttggctccaatggctttgcgtatcccaatttccttggttcgctccgttaccgatactaacatgatattcataaccccaattccgccaacaaataaggaaatcccggcaatagagcttatgataagggtaactaatcccagcactttattggccacctgcagctgttcttccatgttaaatccttcgtataaatcttccgttcggtggcgtttatttaatatgcgcttggtttgttcaatagcttccttaaccttatcggccgataccgcttccccttctaactgatctaccctggtagtattaaaaagccgctgccaggaagtaagcgggagatatatccggtaattgggcattcccatattaaagcttaaggtttcggttttagaaacacccaccacggtaaaaggtaaacctctgattttaatggtttttccggtagcatccgcggtaccaaaaagttcttttgctcctttttcatcaattacggctactttgcgaaaatacttaacatcttcctcaattaaaaatctaccgttaactaactgaatattccgcacctctttatactcgggaatcgtccccaccacaattaagtcaatttttttgctgccagaagctcctttggccatatcatagccggaaggaactattcttttcactgccggggcccccgcttctaccgcgcggacgtcatctaacgacaaacgttgatccggacgcaaggtttcctggccaatggttttggcgtacatgaaaaacaggttggaaccaatacttttcatctgcccgagagttgcttctttccccccctgaccgatggacagcaccgccaccaccgccatcacaccaataattaccccaagggcagttaaaaaagagcgcattttgttggcccatagggaagaaagcgcaacccttaaactctctttaagctccaacgccttgccccctctctattgcccggtcttcgacaatttcgccatcacgaattctaattaaccttttagcaaaggaagccacatccggttcgtgggtgaccaaaataattgttaccccttcctggtttaagccggttaaaatattcataatttccgtactggatttagtatctaagtttcccgttggttcatcggctaaaattaataaaggattggtaactaacgcccgggcaatggccaccctttgacgctcaccgccggagatttcattgggcttatgctctaaacgatgggaaagtccaacctttcttagagcttcaattgctttttctttccttattccaggttttactccttgatagagaagaggtagttcgacattttttaagacgttttcccgcggcagaagataaaagttttgaaacacaaagccaatttttcggtttcggatttccgccagctcattatcggatagacttcctacatctaccccgtctaaatagtattttccgctatccggacggtccaagcaccccagaatattcattaaggtagatttacccgaacccgacggtcccatgatggccacaaactcgcctgcgcttacggtaaagttaatgttttttaaaacttctacccgatttttaccgagaagatagcctttggttaagttttcgacccgaatcatttaactttcaccttatccccatcttttagctcagccggcgggtttacaactaccaggtcaccttttttgactccggataaaacttgggcttttaaatcatcgctaagccccagctttacttcttgaagttttaccttatctcccaccactataaacacatatttcttcgtatccctctccacgattgtttctaagggaagggttaaaactccgtttttccgccccgcttcgatttttaagtctactttatagcctggctttagccctgtaatatccccggtgattttaccgttaaaccctactttaatctcttccccctgggccgataccgtctttaccgcctgcggttctaccgtttcaattatcccggtatactcccgctccaaaccttccgcttgggcagtaaatttttgccccggggaaattaaggcagcatcaaattggtttacccttccttttaccttaaaacctgataaatcccccaccacaattaccggaacaccaggattggcggtttgtcccgcttccacatttaccgctaagactacccccgaaagcttagttttaagctgggtctgggcaattttctcctttaacatctctacccgatcgcgggccgactttagctggacttccaagcttttggtagaggtttggttcatccccggaagtttttctgcttttttggcatcacttagctggacttcaagtaattctacctggttttcggcttcttttaactgattttttaactcagtatcgtcaagttttaaaaccacctgccccgcctttaccttttgcccaggttttaccaggacctcttttaccgtgcccggtgtataaacatagatgttttccgttgttttaggttcaatcgtaccttcagcaaaagcatatttgacaatatccccttcggctaccttggtagtcttaacggctattcccggattttttttaattttaacaacatttaagcctgcaaccccgccaataaacaagacgattacaactatagctaatatttttttcttcataacgccctggtcatccaaactgtgcaaaactgcatcagtttagaaggttggggtatttgttgtccgcctttcagactgtcccagccccaactggcggtatttgggacagccatagcccctgccccaagaagcaggaactggccgtggcctttcagccaccttctcccataccgcttacgagcatcctcttcagcggtgacaggtcacgatataatggcctgtccaggagagctccggtcaggagggctacccgcaaaactcgccacggtttgtacggtaaggttttcccctttaccgcagtaccttcattccttccttcggttaatgtagataccgaccgtgactcgctttgcaggcttttcaaaagctctctatacttcaagggaattttctcccttaaagccaaccctcttcgggctatcacataggctgctgctgtatctttggttaaattaaactgcggtgcatactttaacattcctatcacgcttgtataagccggacttacttctcttatggctaccccgtaccttttggcaagtatctttattctggcaataagctttctatagctaaaaccgtgctttacccttctggattttcttcccttgtaatctccccggtagcctttgtcttttatcgctaacttttccattacaatgcctttgtttttcttaagggctaattttacaatttcgttggcgtacacccacgcaaagtaatcccttttctcttttctcccgtcccagagatgcggtgtggggatttctcctaagctttctaaattgccatctttctttatttcagcccaggcgatgtgggatggaaaagcatttaagtctatcccgatagctccatggctgaaatctatcgatacatcaggaaggtcttcttcaaaagaaatgtaagcatagtatttattgtttttcctctgcagacgaacgctgtaaggacaggaatttagcattgcttctgcaaactttctccatttcttatgagaacttttaagctggataaacagccatttcctgttgcctgtatttatccttagaaaaaattgacctttttcttcgataactcttaaatttaagttcccctgtttggttttatcccctctggagaaaagagttcctttgcgtttatcttcccactcttttttgtacttttgcctttgcttactgcttaaatgcttgctttttagtctataaaacaacactttcccgccaaagataaccttgcgtgggttttctccaagttctctgatactttgtaaaatttcgttagcttcaagtatagcatcgtctgcatatctggaattcaatccaaagaggctttgcagttctttcttcagttcttttcgggcttttccttcaagcaggcggttataggcatatctcttgcaggagttccactttcgcattaagttatctactacctctttctcctctgcccttggaaataaccgtgcctgtattgttatgacttgcttcacggctttcaccacacttacgattttgtacaattaaactttatcccttgctgagtaagtattattgcactattctgcattgtttgtcttaactgttgctgcctcctaagccattttctgtaaactttgtccgccaaaaaacgcgcttataattgaaattaaaataaaaattattaaccaaaaagcgatgctttttttagtatcggtattaaaagctttcccgtaaccatagcctaacaatactataccccaaagggtaaaaaagtcaattttagacagaaatatgtggataaaatccatctttacttctcccggcaaaagtaataaaaacgaagtttttacatcaagataattttcaggcttcatatagtaaacaagtccgttccggataatattccccaataaaatcggtacccagcttaaaaccgcaatttttaaataaagccccattttcccttctactcccgcaaactgggagtataaagataaaaccagcccaattaaaagccagataagaaacggtgttattccagctccaattaacccgctaatctttgccccttgaagggcgacggtaagttgttccggcggtattttatctactaacatttttttcatggtttcaagcataactggcatgctaagccatgccgcaaacacatttaacactgcaatgataattccgcttaaccaaaaatttgttttctgccattcttcctgaaaaacttctccgggagcataaatgactttaattaaattagttaagcccatattcctccactcctttgcttttaacttttccttttttccttaaaggtcttttaccataccctggggttttctaaaggccaattaccacctcctatcctgtcataatctataagctatgtcttcgttttacgaaaaacccggtcatagccacccccaaaattcccgcaacaacaactcctaaaacagcccccggccaaggagttaaactaacaataaaataaaaagcaactaaaatccctccccatggccccattagctccaagaaagccaaaaatctccccgggatacacctccaagtttaaatccaaaaccaccgggtaatcaccgtaatatttggttaaatgtttaatttccagaattggggttttattttatttaagatttggagttataagaaatattatttgccgggttttatcctggacggatttaagcgtatcctggcgggacttaatttggtctaattctttctccgggcggacaatctttgtaatggtttctaaaaaccgttccggttcatcggcgttaattaaaatttctcggacaaacccccgccggcttttatcaggaccagaagatggggctttaaccataattggctccgaaaggtttaattggatgacatcactattgcgtgaaagacaatacagccgctcaccttcccggtaaacacttacatttaataaatctccctgaggagctgaagccaaagataccgccctagcctccatcaccaacgaaagcggcaaacggcatttaaacctcggacccagacaaataataagttcatcaggagttaaaacatgcgccgacccaagcattagacggtttaagtttgaaacataaagatataacgctagcattagagcaagtaccaggtaaaatagccaatttttagtcatcatcatataaatagcaattcccactattaaaatttccacagtcactatcacctgtaaggcccatacgaactgtcttaattggtgactctttttggtattagtaaagacttttttattttcattatccggcaacataacaccaccaattacttttttccaccttttataataaattcctttaactttaaataatttttaacttagttattttttgtaaacggcggtccagccaaacccaggggaaaacctacagcgatagcagtaccaatgcctgtttgagtaattttaggggattgaaaaaataaaaagtctactatacctattacaattaaaacgataacaggtagcataaatcctactgatagcctttttctttctggaatcaccggtcttaagcgatatccgattaagtacgcaacaggagtaattattaaagaaacaaaaaccaataacaggtaattcacctgaattccccctgtattagttccctttaagaaagctataaccgcgaaaccattaacacaattaacggctttaccgctggctataaaatagccgccaggaacataagaaatcctgcagccttacagacaacaaaaaaattatgtcataaaaggccaaatgaaaatggttttttatggctcatagatcatcttcctggtcataccgccatcaattaataggttttttcttactgcgccgcaagccaatctactttccaaaccccattgacctttacaacccgccaatatctattttcgaaagttacagtatgcccactcttaaatctatgagtgtcggaaactttaacaaaggccatccttgcatcttttatttcaaaactgccaattttatagttaataagccttgcattatccaaagctcttttaaagtcagcataagatacttcaggtggtacgttcagcaaccggtatgctttttgccaatcacctcgaagttcagcttccagataagcctttactgcatctaccggagtatttttattgatatcatatacggaaatttccttaatttgctttttaagcagtttaatctcatcaagatattgataatatgcgtcatataaaagactttcgacattacttaaacgtaactccaaattaaaaaatttctttttcaatggtctcaagtctgcgcatttcatcattttgattatttttacaaccggttaatgataataaagctaatattaaaaaaaatgtaattattattttaaatttagtttttttccgtctaataattttattattcacatcaaaatagccctccctttttataatcaaacttttcggtatttcctaccccagggcaattttaaatttacttttccttaacttttattctttttttcctgctcgtaaagctgataggaataaaccattaccgctaccgtggtaaaaaggggcagtaaaataaacattaataactccaccatcggcggtaaaaaggcagccaaagccattatgattccggaagctataaaaaatttgccagaagctttatgggttttttcccagaccgtagggctttctaacgtccagggggtacggatgccaaaaaaatagtttgactttattttccccatggtaagaccgattagggcaaagataaaacctataccaacaggtacgagttccccgatcggtactttgtagccaaggcctgcgaaaagtatagctacctgcataacccccatgaataataaaaagccattaataaataaaacataaaccccaaaaaacttttcgtaattttcccgccgggggtcaataaagggaataactataaataagagaaataaccccagggtaaaaaagggtaaaaaccaaaccccaaaacctttagaactccagccgtcaacctccccgtataaattccagtgggtcggtattttagacggaagcattggatataagtaaaaacttacgccaaaaatggcgatgaggattagcaaagaaaaccagtaataacggagaaaatttttcaaggtaaatttcatatttcgccctcctttaggtgaaaaaataaacagcaggaaaggttaacattcctgctgccgaaaattttaagaaataagctttttacttagcttcaatacgtgtccccgttcttcgtttattaatttatcgaccatcgctttatctttatcatcaactaaatttttaagttccaggaaaaacaacaaactatctttttcaaactccaaagcaaattttaaagcttcgttggcatcggtaattttggatgctatttcttcgacctttttatcctgaaagagatgaagattaacgatactttctatatattcccggtactcatcaaagtaggtctccggcaggttttccgctttgacatcaccaaacatccttttaaaatcttcctcgtgctttacttcttcatcggccagctcatcaaacagtttttccagctccgttccggcaaaggtaaccgcaaactggcggtacatggcaaggccgtttctttccacacttacggcaaattctaaaacttctcctaaactaagttttcctatatgcatttttaaaacctcctgaattccttttttagattatattcttcatttttctgtaaatccctttttattcttaccggtaaatattttttcgccacttttaaccaaaaataagtgataagaaccgtaaaccccaagaacaaaaggccgttaaatccttcacttaagataatttctatcgattcccctgcggcgatcatttctctaaagcttttaataaactgggaaaaagtaaaaatacaaacaataagccacagtatccccataaagataaatcctataataacccccggcttgctggataaaggtttatccaaaagccgccggctaacatgtaccccttgccacatcgcagccgccgggtcaatgattacctggtttagatcaaggttattgccacagtttttgcaaattttaacttcttcttcatttaaaaaaccgcagtaagggcaaaggggtgaagatttagaaaccatctgtaaactcccccttaaggtaaatgcttacctctaaagcagggttaaaaaaggcagaattattggcacaattattgttaataccgtccctgataaaagggcgatagccccgtaatagggtccctgaacccgggtaattactcccaaggtggtatccatggaagtagctccggccaccgcaagcggaaagtacggaaaaaggcgtgctaataacggggttaagaggatagtaaataactcccgtaaaacattggctaaaaatccaattgtcccggcttcaatccccaggtttttggctaaaatggcagtggttacgctgtaaaaccccatgcctgcagccgaagagacagaaattccaggatttatattaaatatcagggcaaaagccattcccccaagaatgcttcctaaaagagctaatagaggaaaggaaattatttttacccctttttcgcgaaccttttttatgagctcccggtccccaccaaaacttacaccggttcccaggtacaaaaaagcaagggcaaaagtaatgatcctgtcacttaggttaagaaatttttccggtaaaagatatgctccccctactcctcctaaaaccaccgttaaaaccagtaagcctacaaatttaaggtcatcgtgagtttgggaaagattttcttcagctacttctactttggcttttctttcaaaaaggtaaattaaaagcatactccctaaggcagcaaaaagcataattccaaaacttttaagcccaagaaccataaggttttttaaaacttcctggttggtagcaagttttgctccaatcacaaaaagaaggacaaataaagaaagactaaacatttttataagtaagcggtttaaaaaagaagaccacttaaaatatcccagaaaaaatccaaaagaaaataaaacaagcggtaaagcaatataaaacaatgcctaatcccccgcccttataaatttttagtttatcttcctttaaacttgggaggtcttttttcaataaaggcattaaccccttcccgaaagtcttcggtttccgccactaaagactgataaagccgctcgtattcaaagaaggtgtttaagtccagtgatgtagctaaatgcaaaagctttttcgcatagccgtatgcccgggtaggaccatcggctaactgcttcgctaaattcatcgcctcatccaaataaaggtcatcatccaccacccggtttacaagccctaattcataagctttttcagctgaaaaccggtcggcagtaaagattagctctttcgcccggtgtacccccagagtccgggctaagaaaaacagccccgataaatccggcaaaagccctacctgggcaaaagccagggaaaaaatcgttgaccgggcagcaataataatatcggtagccaaagcaatactaagtcctgccccaacggcatagccatgaactgccgatattaccggcttctccatatttatcagaagggtaagccagttgtgaactaaattttccattaaagtaacccgctggtctgccggcgttttggcaaaattagaaagcatccttttcacatcgccaccggcacaaaaaccgggaccggcaccggttaagaccaccgctcgtatattttcgttatttttaacctgaaggagaatttcggccatttccacctgcatttcttcattaatggcattaaccgcttccggccggtttaaagtgataatcccaactttgccgttttgttcaaaaagtaccgtgttgcccacttcctcattcccctttgctcatattttcctcattattataaggggtttgtgaataattttcaaactttttaggcaaaacttttaacttttccttaacactttttgtgaatgagagcacttgtttttgaatgattttttgtatacaatatacttagagcaggaggtgccaccgatgacaattttttattatgaaattctcgccctgataaataaaaaccattaaaacttttgcgcttggcccctgcttttcagcgtactttaacaaaaactttaccaaaaccctctggtatttatgatgtttttggtatacaatatgcactgcaagcttccttagtttaacgtttctttttcttaatgtacacaacccgaatcttcccgccaaaattggcgggttttttattaaacatacaaaaaggagccttcctttcaggaaagctcctcacctgataaactaattggttgccggaggggtagttggagcataagcaccgccgccaaatccgcagccaccaaagccgcctccaaatccgcagccaccatagccagctaaagcgttgggacaggcagctccaggtccaaagccataaccaccaggtccgggagtaatagcagcaggatttttctcaagatagtcaagccttgcatcgatgttctttttaatcacttcaccttgctctttggtgagaagacccgctttcacccgcacatccaccatctttttctgaatttcagccatttgctggtataaacttttaagttcatccagctggggattggtgactgcagcaattgccggaacggccaccaccaataataaaaccactattaaacctgccaaaagttttttcttcattatttcacctcccgtttttcatttcctgcttctaaatttaccaccgaatctttagcaaaccgtgccgaatttgttacgattttgttacagaaaacagtatccggtaaactaccgaaacattaagcgctgaacctaatagtaaccacccgtaataattaaaacaacagccaaaaatattacctcagggttacgaagagagtaggaaaggctaaagttaacctaattagatttcatcatatgatttaaaaaaataatctttgccaaaagtacgcaaaaaattttaaaatatttttaaaaaagtcccattacaaggtgagaattgatgttttacaaaaagcttcaagaaatcgccaatgaagatactcgaaacttttttaacgaatatactccccaccgggaaaaactgatggccgaaatcttaaaggcaaaatcttccggacgggctattatcctgggtgcaggaaattgcaatgacatagatttaaatgagctcagtaaaaccttcgaccaaacttttcttctcgatattgatgtaacggcaatggagctgggattacaaaggcaaaaacccatttacccggaaaaaattaaaattttagaatttgatttaaccggtattttagccaatattcaactggtaatccgggatacttccttggacacacttctaaatgccttaaaagcggtaaacgataatccaaaactccccgaaggattcgaacagagctttgatttggttgtatccgccggtgttattacgcagataatttatccgttaaaagcagccgatttcatggccggcttttattccatccatgatttgttggaattcttaagagaccgtctttttcgtcaacatctcaaattaatttcccggcttttaaaggatgacggtcgagcaatttttaccgttgaccatccgctgcacgattatcccccggaagaagcagttaaatggcccagactttatatccggagaacttccaggctctacgatcagctaattgaagagtctcctttagcagatgctgtcccacctacctactggcactgggaaataccggggaatcactttctcgtggaatgccatatactaaagcgcaaaaacttttaaaagccactttcggtctttaaattgccaaaaaaaaccacccgcgcgggtggtttttatgctaatgcttcccgggcttgtcttaactgttcaattaccgcctgaggggcaggccccccgaaaagcttccttttagctaagacattttcaattttaagcttttcgtaaatatcctcttcgattaatggcgacatctctttaagctcatccaaggaaagctccaacagttcccttccagttttttcggcttttaacaccagttctccagtaatcctgtgagcttctctaaaaggaactcctttttccaccaggtattcggccaagtcggtagcattaagaaatccttttaaagccgccttatacatagccccctggttaaatttaattgttttcagcattccagtaaaaacccttaaacttccctttaaggtatcgacggtatcaaaaagcggctccttatcttcctgcatatccttgttataagctaagggcaaacctttcatcatcgttaataccgccattagattgccgtataccctgccggttttaccccggataagttcggcagcatcgggatttttcttttggggcatcatggaagagccggtagcataccggtcatcaatttccacaaaggaaaattctttgctattccaaagaacaatttcttcggaaaagcggcttaaatgcatcatcgtagtggccgccgcaaagagaaattctaagatatagtcccggtccgataccgcatcaagactattttcacagacaccattaaaacctaaaagttcggaaacaaactcccggtctaaaggtaaggtggtaccggccagtgctccggctcccagcggcgacctatcagcccgttttaaacaatcgtaaaaacggcttcggtcccggtcaaacatccagaaatatgccaaaagatgatgggccagggtcaccggctgcgcccgctgcaggtgagtataaccgggcatgatagtgtttaaatgcccttcggccagattaattaaagtttcctggagctcttttataagagcaataatagccgtaccttctttctttacataaagccgggtgtctaaagccacctggtcgttacggctacgaccggtgtgaacttttttccccacgtccccgattttcttaattaatagcgtttcaatattcaggtgaatgtcttcggcttcaggggaaaaatccaccttaccggcttttatctcctctaaaatttctgtaagtgccccaataattttctctttttcctcattggtgattataccctgccgggccagcatcgtcacatgggcaatgctccccctgatatcttcttcgtaaagccgccagtcaaagtggattgaggcatgaaaatcccgcatttcccggtcggtatccttttcaaagcgtccaccccagagcttcattttcctctcctttacctacttctggtatggtttctgggtcatagcccttactttaagtggaagaccaaataaattaataaatccttcggcatccttctggttatagaggttatcttcaccaaaggtagctaaatctttaacataaagggagtaaggagaagttataccggccgggtaaatatttcctttgtaaagcttaactctgacttttcctgtaaccgtttcctgggttttgtccacaaaagcttccagagcttcccttagaggcgtaaaccataagccatcgtaaataagttcggcatactttaaggctaccatctgtttaaagtgcatggtctgccggtctaaagttaagctctctaactcccggtgagcaaaggttaaaatggtccctccgggagtttcgtatactccccgggatttcatacccaccaaacggttttccaccatgtcggcaataccaattccgtgctttccgccaagctcattaagcttaaaaattaattccaccggcgaaagtttttccccgtttaccgctaccggttctcctttaacaaactctatttctacatactccggctggtccggtgctttttccggagggttggtaagtaggagcacatcttccggcggttcaacggccgggtcttctaaaatacccccttcgtgggaaagatgccagaggtttctatccatgctgtaaggctgcttcttggtaaccggtaccggaatccctctcttttcggcataatcaatggcatcttcccgggattttatctcccattcccgccagggagcgatgatttttaaatccggatttaacgctttaacggtaagttcaaaacgtacctggtcgttacccttaccggttgccccgtgagctaccgccaccgccccttccttttccgctatctccaccaactttttagcaataagcggacgggctaccgaagttcccagaaggtatttattttcgtacaccgctcctgctttcagcatgggaaaaacaaaatcccggacaaactcttccttaacatcttcaatatatattttggcagcgccgcttttaatcgccttttcccttaaaggctctaattcttccccctggcccacatcggccaccatggcaatgacttcgtaaccgtaattttctttaagccagggaatgataatcgaggtatccaggccaccggaataagccaaaactactttttccgccatatttatacctcccgttgtatttttatacgcattaaatcctaaattatcctaagagtaaagtcaagatagccttttgggcgtgcagccggttttccgcctcagcaaagaccaccgaatgttcaccatcgatcacttcggcggtcacttcttcaccccggtgggcaggcaggcagtggaggaagataaagtcctgcttggcatggcttaccagttcaccgttaacctgatagggttcaaagactttaacccgctcagcactttccgcctcctgccccatcgaagcccaaacatcggttaccaccacatcggcaccggtaaccgcttccaccggatcgtgggttaataataattttgttccccacctgctggtttccttttgggcaattaaacttactttttgatccggttcatatcccggtggggttgccacggccacttccatacctaccttggctgcaccaatcattaacgaatggcagacgttgttgccatcccctacccaggccacctttaaacctcttaactgccccttatgttctttaattgtcagtaaatccgccatgatttgacagggatgttcgtaatcggtaagaccgttaataaccggcacatcggcatagtaggccagttcttctacttcgctatgactgtaggtgcgaatcataataccatccaccatccgggataagacccgggcagtatcggcaatcggttcaccccggcttaattgcgagtcggtagcggttataaaaagaggatatcctcctaactgcaccataccaacttcaaaggaaaccctggtccgggtggaatttttgctaaaaatcatcgccaaggttttcccttttaaaatcggagtcgaaattccctttttttgccggatttttaattccgaagctaaatccaatacttcctctatctcctccccggtcaaatcgttcattgaaagaaaatcccgtccccggtaggatgctatcatcttttctaatttctcggcaaaggcgaaatcataaagctccatctacgcccgcctcctttacggccagcaaaattttttccgaagcttcccggatttcttcccgggtaattattagcggaggtacaatccttaaaatccactccccaacgttatttattaacactcctttggctaaaagtatttcagaaacccggcctgctcccgggaaattcagctcaattcccagcataagtccgtatccccgcacttctttgatacccggtgcatccgctaagagggtataaaataacttacctttatccaaaacctcctctaaaaatcccggcgctaaaacttcttcaagaacggccaaagctgcggtacaggccaggggatttcccccgaaggtcgaagcatggtcccccggctcaaaagccttggccacttcttctttggccaacaccgccccaatgggtactcctccggcaaggcctttggccagggtaatgatatccggcaccaccccgaagtgttcaaaagcaaataatttgcccgtccggccaacccccgtctgtacttcatcaaagataagcaagatatttttttcccggcaaagttctgctactttttgcaaatacgcggggtcagccggatttactcccgactccccctgcaccggctctaaaataaccgctgcagttttggaagttagagctttttccagggcattcaaatcattatagggcacgtaaacaaaaccgggcaccaaagggcgaaaaggtttctggtatttttcctgaccggtagccgaaagggcccccatggttcttccatggaaagagttaacggcagaaataatttcgtatttttcttcccctttttgccaccagtatttgcgggcaagctttatggccccttccaccgcttccgccccggaattggcaaaaaatacccggtcaaagggagaattttccacaagcttttgggccagttccacctggggccgggtgtaaaataagttactggtatggtgtaaagttttaaccgccgtttcgaccgctgccgttaacttgggatgagcataacccagggtatttaccgcaatgcccgcaaccaaatccaggtatttattccccgcatcatcgtaaacataggaacccttaccggaaaccaaataaaccggttttcgccggtaagtttgcattaagtatttactttccttttcaatgagctccttgtactccatcgctacctcccattttcagggagtgagcattgtgcccaccccagcatcggtgaaaatttctaatagcaatgaatgggcaatacggccatcgataatgtgcaccgaaccaacgccccgctttatagcgcttatggcactttcggctttgggaatcatcccgccgcggattactccccggttaattagctctttcacttcagcaatagtggccttggaaaggagagaattttcgtccttttcattaagcaaaattccgggagtatcggttaaaacaatcagtttgtcggcttttaaagctactgctacctccgccgccacttcatcggcgtttatgttataaaattccccgctaccattggagcccaccggcgcaactaccggaatgtagcctttatcaattaaagttaagagaatttccggatttacctccgaaatttcccctacataaccgagatcaaggtactcttcccccgtgggctccggatttttcgcaagttttttatgggcttttataagccccgcatcctttcccgaaaggcccaccgctttgcctccggctttttcaataagtccaacaatctctttattgacctttcccaccagcaccatttccactacttctaaggtagcttcgtcggtaaccctcaacccatttatgaagtttgactttatgtttagcttatttaacatgcggctgatttccgggccaccgccgtgtactaccaccgggttaatccccacaaacttcatcaatactaaatcattaataaccgcttcttttaactggtcactgaccatggcatgaccgccgtatttaatgactattgtcttgccgtaaaactttttaatatagggaagagcttctattaaaactttagttttttccaagtatttttccatctttttcccaccttctaagtccggtaactggcattgattttcacgtaatcgtaggttaaatcacaaccccaggctaccgcatttgcatcgccttcgtttaaatcaatggttactattacttcctcgcgagctaattcttctttagcctcctcctccgaaaaaggaaggggcactcccttttgcaatacttttaccttacccaggtaaatatcgattttctccaccgttatttcttctccggcatacccaaccgcagtaattatccgtccccagttagcatcttccccaaaaaccgctgctttaaagaggttagaagaggtaactgttcgcgcaattttccgggctttctgaaggctttcagcgttaaccacccgtacctcgataagccgggtcgctccttccccgtcccgggcaatagcttttgccaaacaaattgccacgtattccagagcattcttaaattttaagtaagcttcttcctctttactttctacccagaccccagaaagtccattggctaaaaccgccaccatatcgttggtactggaatcgccatccaccgaaatcatattaaagctttcgtctaccacttcccgcaatgtttcctgtaaaagctctttttccataccaatatcggtggtaataaacgccagcattgtcgccatgttagggtgaatcattcctgaacctttagctataccaccgaccttcaccgtcttcccgtaaacttcaaattctaccgcaatttctttgggaaccgtatcggtggtcataatcgcttccgccgcagctccgcttccctccctggataaagcctggcaggccatccttattccattaagcaccttattaacaggaagcggcacgccgattaccccggtagaagccaccagaatctgcgaaataggtattcccaggcattttcctgtttcatcaagcatctggcgggcagccagcattccctcttcgccagtacaggcgttggcattgccgctattgactacaatggctgaaataagctggtctttgatattttccatagataaaagtattggtgctgccttcactttattggtcgtgaaaaccgcagcccctaccgccggtttttcggaaaaaatcaccgctacatcttttttgctcttttttatccccgcatgaaccccggccgccaaaaaaccttcgggtgcggtaactccaccttgaattttcttcattttaactccctcctaaaagtaaattcccgtatttttaagtccgcaggtttcgtcaagtccggccatcaaattcatattttgcaccgcctgccccgcagcccctttgcccaggttgtcaatggcaacggtcacgataaccattcctcccggctccttattaacggcaattaaagcattattggttccgtaaaccgcccgggtttccggtaactggccgtccggaaggatttttataaaaggtttgtcctggtattttgccaggtaaatctttcttaactcttccaaagaaacatccgtagtaagattcagataaatagtccccaaaattcctcttttcataggaaccaggtgaggggtaaaaataactcttaagcctttcgcaaacatatttaagaaattttccatttccggtagatgtcgatgtttacctccaactccgtaagggcgaaagttttccgctacttccccaaaaagcgtttctcttttagccgctctcccggcacccgttactcccgatttcatatcgctaatgattacaccttgaagcaaatccttttcggctaaaggaagaaccgccagcaaaaacgccgttggatagcagcctggattggctataagcctggcagtttttattttttcggaaaaatattccgtaagaccatatactgctatttccaaaagttcgggagccggatgcggcccgtaccatttatcgtaaacttccagaggaaggcgaaaatccgccgacaaatcgataacccggacccctcgtcggattaattcttgagcataacggccactctctccgtgaggtaaagctaaaaaagcaaaatcaggattaaagcctgagagttcttctaaaggcttcaccttgccggcgaaaccaaggccgagaaaatgcttctccacttccacctcttctccccggctaaagaggaagagcccggtaacttccggatgcatagataataacctgatcagttcagcaccggtataaccggtagcaccaaccactgcaactttcaaagctgcccctccttttccgatatatttataatattacatacttttgtatatttatgcaatatttttgctaaaaaaaattccggaaagtttctttccggaataatcctttcccttaactcgctttcccaaggtacgaatatttcctaaactcataataataccaaagcgtacccaaacaatacaatattgctaccacccaaaaaattaacggataaccgccaagccggtaaaaaatcgtactaataggtcccccaatagcccagcccaaagaaaaagtagcttgatttaaacttaaaataagtcccttccgggacggatccactatcaacacgtttaatgcttgaaacaagggagtccccgcattcattaaagcgtggcgcgttagtaacacaagtaccgcccaagataggtagggcacatatcccaaataaacggcaaacggtaaggatattaggttaaagaaaacaaacgcccgcaccaaaccaaacctgcgggaaactttagttcccattaccatagctaaagatgttaacccctgggctccggctaaaataaggccaataaaagtattggaaactccaaaacggtttgcaaaatacaggtttaaatagggcataaagagacccgagccggtaccaattaaaagcgaaaaaataaaaattgttctaaacactgaaaattcttcagtatccgcagatattcctttaattgttgcccaaaaatcatcttttatctctaacttgcgacccttttccaaatgggttaaaaataaatttcccgccaaaaaaattaaagcccctgaaattagcgaggcccggtagctggctttaagggatagcattccggataaaaggtcggataacattccgcctgcaaaattgccgagcattgaagcgatcataattgaagaatagtgaagccctattaattttacttcttctcccggtagggaaacttctgataaataaggcacaccatttaccactaataccgaaaatcccaacccaaaaagaaaagccgccaaaataattaatccgggtttttcaaagattccttggaaaataagcattattccagcaacaaaacttccccagaaaataaagcggcgccgtccgtaccggtcgccgatataacccgccggaatcataaataacgcctgggccaaagaacttgctgccaccacctgaccagcaacatccatccccaggcccagttgctttaagtataaattaaataacacctggtaaacaccataaccaaaattcacaaatagctgggatattaaaaatttttttgcactttttcctgcagtaataaaggatttaatcaaagactgttccttcatagtctactccaacgttgtaaagtttttcatataatcaaagtttattattaattaatacaactttatccataaaaaatccttccctaaagaataattttaactttatttttacattgccggcaggtatctcctgaaagtccaggagtatccaccccaaaataatcccgccgaattaataatgccccacaatgaggacaaaaagtatcattggaagcatcgggcaaattgccaaggtaaacgtagtttagatatttccttgctatctcccgggcccggattaaactttccaccggggtaggcggtaagttaaacttataacgcggaaagtaccgggaaaagtgcaaaggaatatcccggtccaaatttgctaaaaactttgccaattcctcaatctgttcgggcgcatcattaagccctggaacgagcaacgtagtaacttcgacatgggctccaaaagctttggatgtttcaatagcctctaaaaccggagtaacgctcccctgacaaatatcacggtaatactcctcggttatcccttttaagtcgatattgagagcatcaataaaaggtaaaattttttttaaaggttctttattgataaaaccgttagttaccaaaacggttttaaaaccaagctctttaattaaaggagctgaagcctctatgtattcataccagactacgggctccgaataagtataagcgaccccaatcatttcttgagatttatatctttgagcaagttttaccaaatcttccggtagaagtttttcaccggtttcggcaatttgggatatttcatagttttgacaaaaaccgcaacgaaaattacagccaaaagttcctacggaaaggatagtacttccaggataaaagtggtaaagcggctttttttcgataggatctatatttatagcagttattttcccgaagtttaaggaatacaatcgcccgtttacgttctttctcacccgacagcgcccggttttaccgtctgcaatgcggcaacggtgcggacaaagacggcattgaactaaagaatcccctattacctcgtaaaaaacagcttctttcataaggccacctcaaaaataccgctctaccaaaaacctttcaattttcaccggctcgtccggcgctatccctgcttttcttttggcaattgcaagctgtttttctaccgtatccacgccttctaaattgggaagtaatagcccgcgacgaaatcctttagaaactatcactccgtattttttggggtctaattccgataaatccctaacttcttcgggaggataaagaatatccaccgagtaggtgagttcatccaattcgtgttcttccaccggctcaaatcgcggatcatgtagtccggcttccaaactgtttctgataatctcttctgccaagttttcggtggcaggcgctatcgtaccgatacatccccgcagttctccgtcttttttaatggaaacaaagacccccgctttccgcttaaaaatctccggtagtggatccggcggagttatggttttaccggtacgtacgtaagtttccaaagcctcccgggcaagccgcacatagggcgactccttttcccggcgcttttttatttcctcctgttttttggcaattaatttaggataaaagtagcgctctttatcttccccccgggcttcgacttccgccaccatataaccgaccccaaaaggcccttcgtagctaagcaccctgcttcttacctgatatccttcaaaagcaccaaataacataataaaggaacgaagaccgcactctcctgcttgctcggcaaagcttttatcaatagttaaaagttcccaagggtcaccatgggtaaaaatatctaccatcagccggtcaaagtaacgccctgaaggatcgtaaccagctggggcatccaaagttaaacggtgagataaatcccccgatgctatgataacaattttgcgcttaagttctgcagctacttctctaattattgtgcccaaacggtaaatctcggaaaaaggtataagcccctggcttatcacgacaagtttatacttttgctccggatctaaataataaagcggtaccattgttccgtggtcgagaaaagcgggaacccgcactgctcgagccaggctctcatcaatcccggcaaccgccagcccttcttgcttagctgctgtaagtaaagcttgaaccaattcgagatcattttggtaggaaaaggtgatatggggtgcaccaaaacttccgaaatttccgttcagcttctcattaatattaaccgcgaccacatcgctgaaaagcggagcatggggagaaattactattaatgtttccggatttattttcttaattttttccttgagctcttttaaagcattaatagtattttgacatttcttttcctctccccgcccaatttccgggagaattatcggcgggtgcggtactgcgatcccataaagattacccatctttattcctccccttcaaattctctggggcaaacatcctttggttcctggcaatatccctcacacagttcgcaactgccgtattcggcacaatcaaagcaaacacaggataaacaaaggttcggcatatcaccactccatggaaggttttcttaaattttattatatgtaattttagccaaaaataaaataaagaaggctgtctattgcgacagcctccctgaactttccttatgcttcttttttattgcttgcaacgtagcgatataaaattaaccccaagaccacaaacatggccaggccccaccaggggttacctgctattgttagcttagaaaagatggcaactttttccgaaaggcctttataggctaaaaaggcaatgactattcccatcagcgcatcgccagctattaaaccggaagaaaataagatgcctttttccactttttcttttaaagtttctccggagaaagcccgatcaataaaccagcggataaccccacctgccagaaccccggtgctaaggtgtaacggcaagtagagaccaatagctaccggtaaaatagggagctttaataccgctaaaatgattccaatcactactcccgacaaaaccagtgcccagggaagggttccggtcatgacacctttcaccaccatcgacatgagggttgcctgaggtgcgggtattttatcggtcccaaggccgtaagcctggttcaacattaagattacccagccaacaacgatagtgctggcaataccaccaattaagacgccaatctggacgtatttgggagtagcgccaataatgtatcctgtttttaagttctgagccaagcttccggcaatagaaatagctacgcaaattgttgcaccggtggtaatcgccgcaatcataccctttgttcccactacaccaattgcctttaataagagggtactggccagaagggctgcaatggtcatgccggaaacaggcaagttagataccccaaccaaaccggcaatccgcgccgaaactgctgcaaagaaaaagccaaagagcacaatggaaagggcacccatccaggtaactttcatctggggaactataagagctgtgatgaagacccctaaaaccccgaagaaaatagccactacgctaatatcttggttggtccgcttttgctcaccactttggccttttgccaatcctcccatagcagctttaaaagagttaataatcatgggaagggaccggccaaggctgataaaacctcccgcagccaccgcaccggcaccgatatagcggatatacttggaccaaatggcccaggcatccatttgggcaatgggtacggtactcgggaaaatggggttaggtacaccggctccaaagtaagaaataagcggaattaaaacaaaccaggccagtaatccccctgcaaacatgtaaagaccaatttctaaacctacaataaagccaacacccattagagaggctaaaatatcgaagccaaaaactccgtttttaaatcccggaatattccattcgatttcttctttaaaaaggccaaaagcaccggataacagtttataaataccgccaataagacctccccataaaatcccggaagccgattggccaccaacctgccccgctaccagcacttctgcggtggccataccttcgggataaggaaggataccgtgctcgtccactgttaggttctttcttaaaggtaccacaaataaaaccccgagaatcgtaccaagggttgccaccaccgcaatcttggccaaagtaaactggtctttaaacccccagataattaatgccggtaaagtaaacattacgccgctggcaatactttccccggcggaaccaattgcctgaataatgttagtttctaaaatattttgcttccttaaaagtccccggataattgccgttccaataaccgccccggggattgaggctgaaacagtcataccaaccttaagtcccaaataagtattggtagcaccaaataataaggccagtaaaatacccatgataagtgagacaacggtcatttccggaagccttgtcgtaggtggaacataaggctcatactggtctcccggaataccaccgtacgcagtgtgggataaacctttcttttccacaactcttacctccgtttttcaatgttttttgttagtttaaaccaagcattaattttttactcctgccgtggctcgccatcctgcaatttttgtatgtacacagtataaattatacactttcgatatcatccgtcaatcttttcttaaagtataaaaatagggacagtcccttaaaccaccgttaaagtttaaagatagggactgtccctatttaaaatactttaaaacagctaaataaatggcaaagcttactttttcccggtaatcggggtctaacaaaagccgttcctcttcaggatttgataaaaaccctacctcggcaattgccgaagccatctgggagttacgatttataaaataatcgccggatttagccacccggttggtatttgccaaaattgttttaaagctgtcctgaatatgctccgccaacctttttcctccactatctccttcctgataaaaagtctgagcaccgcggtacttgcgctccggaaaactattaacgtgaatgcttattaatacctccgcatgtttttcttcggcaaactggatgcgccgggctaagtcttgttttttccggatcgaatacccccgaatccccggatcagccaaatcatagtcaccagaacgggtaagataaacctgggcacctgccatttgtaatttagccgccacccggcgagctatatcaagggtaatatccttctccaccgccccctgttgtcctttacaccccgggtcctgacctccatgccctggatctatgacaataatcctattggcaaccgccaccgctaagacccgtacttccttatttaacaaaatatttctaaaaactgaacctaataccgttaaaattataattcccaccattaccgccagaactttttgccgagttatgcgatatactttaaaaataatcattacctatacacctccggcttgtaaattatatgccaagccgaagggcattattaatgtaaatttcaataaagtccgcctatcccggtgcaattagcttataaaaccgtctttcctttatccaaaaaccctttttaaccataaaatattatagcaagaaaaaggagggataaaatgaatcacaaaaataacgactttcagctaaactccccttatcctccggtgaaggttaaaaatcccaataccatgtatgctgaaattttaatggacgattatgcaggtaccgccggagaacttaccgccattacccagtacttgtatcatcactttgaaagcgaaaaaacaaatccgcaaattgctaaactttttgaaggggtagccttagttgaaatgcaccaccttgaaatactcgcaaagttgattatcgcctttggcggaaatcctacctatcggggtagttttggtaataatttcgcttactggagcggacactacgttaattattcccaaaatatacgggaacaactgatagccgatattcacgcagaaaaaaccgcaatcgtcaattatcagaagcatgcagaaattattgatgatccttacgcccggccagttctctatagaattattgaagatgaggaattgcatttaaaattatttaaggatgccttaaaaagcttaagggaaggttaacccttcccttttactttatcgaaaaactccattacctatttttattgattttatgaacattttaactatatacccttaagtaacctggttggcaaactttaaaattgcaatcaagaaaaaacataaaaaaaccaggcagatttgcctggtttttcccccttatctcttggtccactgaggtcttctccgggacttccgtaaaccgtattttttccgctcgaccatccggggatcccgggtaagaaagcctgcttttttcagcaccggtcttaacgaaggatcagcctgaaccaaggcccgcgcaataccaagtctcacggcacctgcctgaccggaaatgccgccaccatgaacttttgccttaacatcaaacttcccaacagtattggtgagttccaagggttgtttaacaataatctgcagggtttttctcgggaagtattcttccaaggatttgccatttatggtaatgttcccttcgccgggaaccacaaacacccgggcgaccgcttcttttctccggcccgtaccgtagaaattaactactgccatctaaaacgcctcccttcgcccgtatctaaaattgccagatttccggcttttgagcttgatgcggatgtgattccccggcatataccttaagcttcttaaaaagctttcttcccagccggttgtgaggaagcatcccttttacagctttttcaaaagccaggaccggattagttttcattaagattccgtagggaatagcttttaaaccgcctggatagcggctgtgacggtaaaacattttcttttctaactttttcccggttaaaacagccttttcggcattaatgataataacaaaatcaccagtatctacatgaggagtaaattccggtttgtgcttacctcttaaaagcttagcagcctcactggctacccgtccgaggggttttccagcagcatctataacataccatttcctttccacttcattgggcttagccatgtatgtggttctcaccttgttccctccttttgccgtaactatcgcggtattgccaatgggggctcgtcactggcaaatacctataccattataattttatgggaatacccctggcctgtcaagcaattcttcgattaaaaatgtaaattaagtaaaaaatataaatacagccgttaaatattaaagtccaggcacttaatctccgccggaaattaaccagaaaaagcgccgcgaccgccgcaaaaaaagccaatataccgcttaaaactacatccgtcgataaacgccacgaagtaaagattatcccaattgaggttataaccgagctttgaaaaaccatcgctccggtaatgtttcctaacgccaaagtatctttcccgcttctcatccacactacactgttgaacttttcgggaagttctgtagctatgggtgtaataactaaagataaagccattggcgatattcctattaagtgagccaattgggtcaaattagctacaaagtacttagcccccaccacaatcatcaagaggcttattatcagctgcaaaagtatcgcccgaatcctgggaattgtcctctggggagtaaagattaacggatccacttccccgatctcaccgctatcttcattaaccgttttatagacataaattaaatagccaaaaactaatattaaagcaatagatctttgcataaaactatggggtacaaaagccgccaaatacgaaagggtataaaataaaagaaaacttttgatatcccttagaaaaagcccacgttccaaaacaacctcgctcccgaaagtccgccggcgactgaaaagtaccgaagcggtgccggttaccataaaaccaatggtaataagcataaacggtgcacctaaaatcgctccaataccaatttcagtgctgtggtccgtttgactgccgaaaaaaatagcaataaccggaaccattgtttccggcaacgctgtccctaccgccgcaaaaatgcttcccaccgctccctggttaaaaccaaaacggcggccaaaccattccaccgcattggtaaaagtcaatgctccccctaaaataagcaaaagattaaaaattaacaggccccccagatacgtcaaggctttcccctctttcaataaaaaactttcacaagaaaaagaccgtgggctggggcagttttaccggcaagctttttatttccggtggttaaaatttctctaaccctttccggatggccatttaagccaatttccaccagcgtaccggttaaaattctggccatcttatacaggaaagaatcggccacaaacgtaaaataccctaaaaaaccatcctcccggtaacttgcctcaaacatggttttaatcgggtttttaccgctacttcccgctgctccaaagccggagaagtcatgggtaccgattaaatattccagggcctttgctactttttcccggtcaagtttttggggcaaagcccaggcataccgttcataaaagggtgagggaggaccgtaatacaaataatacctgtactccttttttcgggctgaatatcgtgcatgaaagtcatccggcactatttcagcttctaaaactcgaattgcggttggaagggtattatttaaaatttccggaattttatctaccggcgctttccagggcgccgaaaaatttaccacctgccccagagcatgaactccagcgtcggttcgcccagccccaattacttttaccggttcttttaaaattttatgaagcttttcctctaaaatgccttgaatcgtctgcggggtatttttttgcttttgaaatcctgcaaaattagtgccgtcgtaggcaatggttagcttaaaatttggcaggaaaaccaccccagagctttaagattacaaatagcacggtaagtaaaaaatttaaaaacaggaaaagatagtctttggccgcaaattttaacggctttaatttcccgcggggggcgcctatgcggtaacctctggcctccatcgctaccgctaactcatcggcccgtttaaaagcattaataaataggggaataattaggggaagcatcattttggctttgttagaaaacccccgggtgttaaaatcagctccccgggactcctgggctttaattagccgctccgcctccgccgttagcgtcggtataaacctgagcgctatggttagcattaatgcaatttctccatacggcaaaccaaatcggccaaaaggttttaaaaggctttccaatccattagttaactccgtcggtgaggtggtagcggtcagaagatatgccgatagcagcattaccaccaagcgtaaaaatactattccgctgttcaccaatccttcccgggttatcttcaaaggacctaaggtaattaacttttcgcccggcgtaaaaaaaagctgaagaattaacgccaaaaccaagataaaaactacaggctttagcgcctgccaaaacattttcggtttaatacctgctaaaaaggtaaccaatattacaccgaagagcaaaaacccgagaaacagtaagttgtctaaaaaaaacaccaggaaaaccgccacaagcaaactaaagaatttggtgcgcgggtctaaacgatggatgaagctattcccgggaatgtattgaccaatggtattgacattaagcatcgccccgcaccacccttattatttcccccacagtttcctccaaagaagcggtcatctttactttatgaccccggctttgcaaaagttttatgacctgggcatacaccggtaagcttaacccgggtatatttttttccataagcttatgaaatacctcgtttttttctccaaaagccgctatcctgcctcggtctaaaactaaaatctggtcgcaaagataggccacttcttccatgttatgcgaaacaataattaccgtaaccccctgcttttttagagacaataaaagccggtaaatggtttctttccccaccggatctagggcagccgccggttcatctaagatcaggtatttgggtgatatacccaaaaccgaagctatcgccagtcttcgtttttcgccaccgcttaattcaaaaggcgacctttttaaataggtttcatccaaacctacttgtcttaatagttccgccgcttgcccttcggttaattcccttccaaaattttttgggccaaaagtgagttcatcaaataccgtttcagcaaaaagctgatgttccgggtactgaaaaataagctgcactttctggcgtattgtttttaagtttgcttttttggaagttacaagaccgtctaccaccacgttaccccgggttggggttaaaagaccgtttaaaagcatgagaagcgttgattttccggaacccgttggcccgataatcccagttataattccttcgttaaagtttaagttaatggtatttaaggcaataacctccattggcgttccgggattataaacaaaagttacatcctttaacgtaatcggcatatttcctccaccagcatttccggggttgtcaccgtatcgggtacgaaaattttctccgcccaaagccgctccagaagtttataaagtgggggtatatcaagccctaattgccgaactaaaggtttttgtctaaagaagttattgggtgttccgtcaaaagcaacccttccccggtcaaaggctattaggcgttttgcccttaaagcttcttccatgtaatgggttataaaaataatcgtaagtttttcctcttcgttaagctttagtaataaatttaaaacttcctgcctgcccgccggatcaagcatggaggtgggttcatctaaaagcaaaatccgcggccttaaagctaaggctccagcaatagccagcctttgcttttgtcctcccgataaagcatatgaagccctctgtcgaagttcccagagccccgttaacttaagtgcttcctccacccgcttttttatttccccggtcggcaagttcaggttttccggcccaaaggccacgtcctcttctaccaccgccgctacaatctggttgtcgggattttgaaaaacaagaccaatctgggttcctaagagtccttcctcttttagctttttgggatttctacctaaaacttctacataaccctcattaggctccaaaagcccggctaacaattttataaaggtagtttttccggagccatttggtccaactaaggctaccagttccccttgcaaaaaggagagggatacgttttgtaacgcatacctctccttttctgcagcataatgatagctcaagctattggttacaatgaccgtttccataattaaaggagctccaccaaaaccatcattgcaccatcgccccgccggggtccaattttcactatccgtgtatagccccccggacgatcggcatactttggaccaatttctttaaaaagttttcttacgacattttcttcgtataaataagctaaagcctgacggcgattatgcagggtgtcgtttttagctaaagtgataagcttttccgctaccgctttagcagatttcccccgggcctcggtggttattatcttcccctcttttaagagggaagtcaccaagtttcttagcatcgcttcccggtggtctttccttctgccaagcttataatggtacatctgcttccctcccttattcttcctctttccgcaaggaaaggcccatggagttgagtttggaaataacctcttcaagcgactttttccctaaattgcgaactttcatcatatccgcttcggtcttctgaattagttcgcctaccgtattgattcctgcccgtttcaagcagttatacgagcgtaccgataaatccaggtcttcaatgggcatttccgccaatttttccttggcgtcctcttctttttcaaccataatttccacaccggtagcccgttcatttaagttaacaaaaagctgcaggtgctcaaccatgatgcgagcggcaaggcttaccgcctcatcgggtcgaatgcttccatcggtccaaacttccagggtgagcttatcataatcggtaatctgaccaacccgcgtattttctacctggaagttcactttgagcactggagaaaagatggagtctaccggtattacgccaataacatgctcgccctttttattccgctccgccggtacataaccccgaccccgggctacagtcatttccataaaaagacgaccgccctctgctatatgggctattacaaggtcggggtttaaaatttctacctccggtggggcaattatatctttggcggtaatgacaccctcaccttcagcttcgattctcaaaacctgttcctcatccccgtgaagcttcagcgtaagatttttaatgtttaagataatttccgttacatcttccactaccccgggaaccgttgaaaattcatggagtaccccttcaatctttatggaagtaacagcagctcccgggagggaagataaaagtatccgccgcattgagttgccgagggtaatcccgtacccccgttccaaaggttcaatcacaaaacggccgtaacggtcgtttaactcctcggtttcaattttcggtttttcaatttcaagcacaaagggaccctcctttaaagggaatacccgtcaagctcttatctggagtagagctcaacaatgagatgctcctcgacggggatatcgatatcttcccgttttggcagtgcttcaaccttaccgacagcattgttggcatcgtaggaaagccaagccggtaaagttttgctggcggcccgttccataatttccttggctatcggagagtccttcttttcttcttttaaagcaattacgtcgccaactttgaccaggtaggatggtatgttaactttccgtccatttaccgtaaagaaattatgccgtaccaactgccgggcctgagcgcgggactcagccagtccgagccgataaaccacgttatcgagccgtctttccaaaattaccaacaagttttcaccggtaatccccggctgtctttcggccatttcaaaataacgccggaactgcgcttccaatactccgtaaattcgctttgctttctgcttttcccgcagttgcagggcatactcggtgggctttttccttgtgtgtccgtgctgaccgggagcataatttctcctggcaatggcacacttatcggtatagcagcgatctcctttcaggaaaagctttattccttccctgcggcaaagcttgcaaacaggacccgtatatctcgccatttcgttatctacctcctatactctcctacgtttcggtggacgacacccgttatgaggaatcggggttacgtccttaataaggctaacttccaggccagcagcttgcaacgagcggattgccgcttcccgacctgcgcctggtcctttcacataaacctcaacagtctttacgccaaattccatcgcttctttagcagctttttccgcagctaactgtgcggcaaagggagtgcctttcctggttccttcaaagccaacggttcccgcacttgcccaggaaagggtgttcccctggggatcggttatggtaacaattgtattgttaaaagtagacttgatatgggctactccttgctcaacatgctttttttccttttttctggcttttgtccggcgagccatcatatccctcctttaagcttacttcttccgttttacaccaacggttcttctgggccctttccgggtacgagcgttggttcgggttctctgtcctctaaccggtaagcctttccggtgacgaataccccggtagcagccaatttcaataagccgtttaatattcaacgcaacttcccgtcttaattctccttcgaccttgtagttcttttcaatctcatcccgaagctttgccacttcttcttcggtcaaatctttaacccgagtatcggggttaataccggtcttctttaagataacattagctgttggtcgaccaataccgtaaatataagttaaggcaatttcgacccttttatctctcggaagatccacaccagcaatccgagccattaccgcacctcctaagaaattatccctgcttctgcttatgcttgggattttcacaaataacccttactcgccctttccggcggataatcttacatttttcgcagatcggtttaacgctgggtctgactttcatgtttaaaccccctttatttccctacttgtgccggtagataatcctaccccgggtcaaatcatagggtgataattcaacggttacccggtcacctggcaagattcgaataaaattcatgcgtattttcccggaaacatgggctaacactttatgcccattatccagctcgacccgaaacattgcgtttggaaggggctccactaccgtgccttccacttcaatgacatcatctttcgacattaagcaatcaacctcctcacccatccagttcttcgcccttttcggcaaacgatttaagaaatttccggatctccggattgctcagtttaccctcgtctggaaaacggtagtttaaaaatttcaaatgacggacgtttttctttttgggattttcaatacgacggtgctgaccatcaaccacttcaacataacggtcattaataacccgatagataatgtagaagtttccgcaatcacggccggctgtggacagcactacttggccgggacggattttgtctaaatgcatgaccttcaccacccattcctttttacggcaaggttagaatcatgggcccattttcggtaatagcaatggtgtgttcaaaatgggctgaccatttaccgtcccgggttaccaccgtccatttgtccggaagggtgaagacctcataggttccaatgttaaccatcggttcgattgctaatgtcattcccgggaccaaccgagcaccacgacccggcttaccgtagttgggcacgttcggctcctcatgcagcgctttgccaattccatgtcccgcatattgtctcaccacggaaaacccgtggcgaaccacgtagctttcgaccgcatgggaaatgtccgaaaccctattgccaaccacggctgcctcaatcccggcgtaaagcgatgcttcggtcacttcaatgagctttttagcctcgggagaaacttcccccacgggccaggtttttgcagcatcgccataatatccgtccacaacagctccaatatcaatactaataatatctccattccgcaattttcttaaaccagggattccgtgaaccacttcttcattaattgaagcacagatagttgccggaaaaccatataagcctttaaaagctggctttccgcctaattttttaattgtttcttctgcaattttatcaagttctaaggtagttatccccggttcaatcgctttttccaaggcctgaagagtcagggcgacaattcgccccgcctcccgcataagccttaattctttttctgttttaacggtaatcaattttctcaccagctacttaataaaaccttgataatgtctcattaaaaggtaagattctaactgtttcatagtatccagcgccacaccaacaacaatcaggagagcagtaccaccaaaggttacattgggaatccgggctattgccatcacgatattgggcagtatggcaataaaggccaagaatactgcgccagcaaaggttacccggctcatgaccttatcgatatattctgccgttggtcttccaggacgaattccagggataaagcccccgtatttcttaaggttttcggcaatatccaaggggttcatgataatcgcagtgtaaaaataggtaaagccaataattagtaaagcgtataaaatggtgttaattacagttccccagccaaaatattttaaaacccactgggcaaaactgttttggggaaaccatcccgcaatagtaatcgggaacatcaaaagtgaagaagcaaaaattatcggaataacccctgcctgattaaccttgatgggcaggtgagtgctttgcccgccgtaaacccggcggccgacaaccctttttgcatactgcaccggaattctccgctgggcttcgttaaccactacaacggcgtaaattgcggctacagcaattacggctaagattaaaacgtttaaaatgtttgccgtaccggcagaaacgtaatcaataatcgttttaatggaaccagggatcctggaaacaatcccggcaaaaattattagcgatatcccgttaccaatgcccttttcggtaatctgttccccaagccacattaaaaacgctgttcccgcggtaagagcaagggcaacgtataaatatgttaagattccggggttgtttaaggccgatcttaaaccaattgccatgaagaaaccttgaataaaggctaagatgacggttccataccgaacgtactcggtaattttccgccgaccttcttccccttctttagccagcttttccaggtatggtattaccaccgttaaaagttgcataataatcgaagcgttaatatacggggtaatactcatggcaaaaatggtaaatttcttaaaggcaccaccggaaataacgtcaaaaaaccccaaaattgtacccgattggattaattcttccatgcgggccaggttaattcccggtaccggtatatgagctccgatacgaaagaccaaaagcatcaataaggtaaagagcaatctactctttaattctttagccttcatggcattgcggagggcatcaagcatttacagcacctccgcttgcccgccggcagcggtaattttttcttttgccgattcactaaaggcatgtgctttaacggtaagcgctttctttagttcgccgccgcctaaaatctttacaccgtcccctattttctttattataccagtttccagcaggagttctggagttaccactgtcccatcttcaaatttatttaagcggtccacgttaatggcaatgatttctttggcaaatttattgtgaaagccgcgtttgggtaatctccggtaaaggggcatctggccaccttcaaagcctggtctgacgccgccgcccgaacgtgccttttgtcctttttgtccacgtcccgcagtttttccaaggccagaacctattccctgacctttccgggtgggtttttgccgcgaaccaggcacaggccttaaatcatgtaaccgcattttcccacctcctaaatttcctcaacttttaataaatggctcactttatttatcatcccgcggatttcaggagtatcggctttgataacggtctggttgagttttctcaatcccagggactttaccgttgccttctgccgttcactttgtccaatgacgctttttaccagggtaattttcagcttcttttccatgagttatccctcctagcccttcaagatttcggccggggtttttccacgaagttttgctaccatttccacggtttttaacgacttcagtgcttcaatggtagcatgggccatattgtggggattattggaacccaaggatttggttaggatgtcccgcacacctgccatttccaatattgcccgtactgcgctaccggcaataacgccggtaccaggtgctgctggctttaataacaccttacccgcaccggcttcaccaataatttcatggggaattgtagtattaacaataggaactttgatcagatttttcttggcatcttcaatgccttttctaatagcatcaggaacttccggagctttaccaaggcccacgcccacatgccctttttgatcgccaactaccaccaaggcgctaaaggaaaaacgccgtccacctttaacaaccttcgctgtacggttgatcgcaataactttttcgctcaactccagttgactggcatcaattcttgccatcgttatccctccttttctttaaaattgcaggccaccttcccgtgctgcttccgccaatgctttaacccgtccgtgataaagatatccgccccggtcaaaaacgaccttttcaatccctttcgctttggcccgctcagcaatcagccggccaacagcttttgctgcttcaatattgccgccgtagccaattttccctcgcaattccggatcgagggtagaagctgcaaccagggtacgcccgctgacatcatcgataatctgggcataaatgtgttttaagcttctatatacgtttaatctcggtctttccggagttccatgaattttcttccgaacccgtaaatgccgccgttttctttccagattccggttggttttggtaatcatcgactaccccccttttctaaaaacgttttacttcttgcctttaccgccggttttaccagcctttctccgaattacttcgtcggtgtacttaattccctttcctttgtacggttcaggctcccggacagcacggatagttgctgcaaaattaccaaccagttctttatcaattcccttgacaataatctggttttgagcgggaacttctatctcaatcccttcgggcggatccatttccaccgggtgagaataaccgaccgttaaaaccagtttacgtccctgctttgccgcccggtagcctaccccaaccaactcaaggcttttttgataaccgttggtaacgccaacgatcatgttattaattaaagtccgggtaaggccatggagggctttatgttctttttcatcggaaggtctttctaccaggatttgcgagccatcaaaagttattttcatatccgggtgaaattcccgggtcaagctccctttcggaccctttacggtaaccgtggttccttctacttttacttcaaccccttgtggaaccgggattggttttctgcctatgcgggacacaaaatcacctcctggattttactaccaaatatagcaaataacttcgccgcctaagccttctttgcgggcttttttatcggtcattattcctttcggtgtcgaaatgatagcaatcccgagaccccctaaaaccctgggtagttcgtctttcttagcgtatacccgaagtccgggcttggagatacgctttagtcctgaaataaccctctctttattggggccgtacttcaaaaatatccgtaaaatcccttgcttgccgtcctcaatgtactcgtaatccttgataaagccttcctcttttaaaatctccgcaattgccctttttaccttggaggatggcacttctaccttctcgtgatagaccatatttgcgtttctaatccgagttaaaaaatcagcaatgggatcggtcataaccatggtatttaccccctttctttaccagctggctttcttaacgcccggaatctctccttggtgggcaagttttctaaagcaaatccggcacatgccaaaatcacgcaagtacgctctcggtcttccacagattttacaccggttgtattttcttactttaaattttggcggcctttgcgctttggcaatcatcgatttcttggccataaacgtccccctttccttatctgctgaagggcattcccattaattgtaacaattcccgagcctcttcatcggttttagcggtagtaacgaaagtaacttccataccccgaactttatcaattttatcatagtcaatttccgggaaaataagctgctcccgtaaacctaccgagtaatttccccgaccatcaaaggatttgggcgataaacccctgaagtcccgaacccggggaagtactatattgacaaatttgtccatgaattcatacatccggtcaccgcgcagggtaacttttacgccaatagtagctccctgccgtactctaaaaccggccaccgatttcttggctttggtaaggaccggtctttgtccggtgatagccataagatcggcaactgcagcatccacagctttaggattttgcaaggcttcgcctaagccgatgtttatcactattttttcaagttttggcacttgcattttatttttatatccaaacttttccatcattgccggtattacatcgttttgatatttatccttaagtctgggcacggtataacctcctttcgccacggcttacctgtcaaggctctcgccgcattttttacaaactctaatcttcttgccatccgctaaaaacttcttcccgacccgggtgggcttgccgcagctggggcagatcaccatcacgttacttacgtgaatcggggcttctttctcaacaataccaccctggggaagtttgggattgggacgggtatgtcttttaacgatatttacgccctcaaccacaactctattttccttgggcaaaacctgcacgatttttccctttttgtctttgtctttacctgcaatgactaagaccatatcgccctttttaacctttaattttggcataatcccacctccttaaaggacttccggagccagggagatgattttcatgaaatccttttccctcagttcccgggctaccggtccaaaaattcgggtaccccgtgggctcttatcgtccttaataattactgcagcattttcgtcaaatttaatatacgtaccgtccggccggcgcacttcttttttggtccgaacaactactgctttaaccacctctccctttttcacaacggcatcgggtgttgcttccttaacggagcaaacgattatatcacctaaacttgcatatctccggttggatcctcctaaaacccggatgcacattaattttttcgcgccggtgttatcggcggaattcaatatggtttgtacttgaatcacttgctgctacctcctttcaggtagaacctgcttaaccttcaatagtttcaagattttcctcttcgcctaacactttgccccgctcgataatctccacaactctccatctcttttccttggagaggggccgagtctcggcaatttttactatgtcgccagtccggcaggcgttatgttcatcgtgggctttaaacttctttgttcggcgaatggtctttttataaagggggtggctgaccaactcctcaacggcaactaccaccgttttatccattttatcgctaacgacccgtccgatttttattttttggacttttttcttttccatcttctacgccccctttctacttctccactttttgtctggcaatttctctttcccggataatggtattaacccgagctatatcccgccgcacctcacggattcgggatggattatccaattgaccggtggaaagctgaaaccgaagtttaaaaagctcatcttttaaactcgccaatttttccactaattccgcatcggttaattctcttaattctttagctttcatgggcttcaccacctacttcccgtttcacaaatttggttttgatgggcagtttatgggaagcaagtctcagcgcttcacgcgcaacttcttccgataccccagcaagctcaaacataatcttaccgggctttactactgccacccagtattccggggcacccttaccactacccatccgggtttcagcaggttttctggtaatcgggtggtccggaaagatgtttatccagattttaccgccccggcggatataacgggaaatagctacccgcgcagcctcaatctgctggctggtaatccatgccccttctactgcctgtaagccgtattccccaaaatgaagctgggttcctcctttggccttacccttgaggctggggcggtggggacgtctatatttaacccgttttggcattaacatggttattcgcctccttctgtactaacgctctccttcttaacctcaggcaatacctcacctttataaatccacacttttacgccaatttttccataggtggttaacgcttcggcaaaaccgtaatcaatatccgccctcagggttgttaaaggtaccttgccctcgctataccattcggaccgggcgatttccgcgccggctaagcgaccgctgcaagctactttaataccctgggcacccattttcaaagcccgggacaccgcctgtttcattgcccgcttataggaaatccgcttttcaatttgggcagcaatattttctgctacaagctgggcatcaatttccggaactttgatctcggcgatattgatatttatttgcttgccggtcatcttttctaactctttccgcaatacttcaatttctgttccgcctttaccaatcaccatacctggccgggcagtatgaatagtaactttcacccggttggaagcccgctcaattacaattcgagaaattccagcttgataaaatttggttttaatgtatttacgaatttttaagtcctcatgcaaaagctcctggtaatgtttcttatcagcaaaccacttggcatcccagtctttgataatacctattctcagtccttttggatgaactttctgacccaccttagccctccttcctttccgcaacgacaatagttatatggctggtccttacccgccagagatccacgcgaccctgagcccgcgggttataacgctttaatgtcggtccctggtccacataggctttggctacataaaggttttctttagacatatcatgattgttttcggcgttggcaattgccgaccttaaaaccttttcaataaaatacgaagcttttttcggggtataccgcaaaatcgccagcgcttcctccacatccttgccccgaattaaatcaattacctgccgggcttttcgcggtgaaatccggatatattttgccactgcacgtgcttccatgaaaatccctcctctcttgactacttgagggcagtagacctttccgtatggtctccatgtcccctgaaggtacgggtaggagcaaattcccctaacttatgtccaaccatctcttcggtaatataaaccggaacgtgctttcttccatcatatacggcaatagtatggcctaccatctgtggaaaaatagtagaccgtcttgaccaggttttaataacccgcttttcacctttagcatttaactcctcaatttttttcagaagttttggatcacaatatggtcctttcttgagtgaacgacccaagctggctacctcccttcatggttacttccgtctcttaataattaacttagagcttgctttatttttcttccgtgtcttaacccccaaggtaggtttaccccaaggagtaaccgggtgacgtccaatcggtgaacgaccttcaccaccgccatgcgggtggtctaccgggttcataacaacaccgcgaaccgtaggtctaattccaagccagcgagcccttccagccttaccaatggtaatattttcgtgctctaaattacccacctgtccgatggttgcccggcattccaaaaggactttccgcatttcgcccgagggaaggcgtaaaattgcgtacctgccctctttaccaaggagctgcgccgccgttccagccgcgcgcaccaactgtccaccttttcccggataaagctcgatgttatgaactaaagtacctaccggaatattggcaagcggcagggcattacccactttgatgtccgcatccggaccggacattaaaacatcgcccactttcaatccatggggagcaattatataacgcttctcgccatcagcgtatgctaacaacgcaattcgagcagtccggttgggatcatattcaatcgccacaacttttgccggaatcccatctttatttcgcttaaaatcaattattcgatacatccgtttatgaccgccgccccggtgccgaaccgtcagccgtccctgattattccgtcccgcatgcttctttaagggaactatcaaagatttttcgggctcggttttggtaatttcttcaaaggacgaaacggtaacaaatctccgaccgggggaggtgggtttgtaagtttttacagccatccttttccctccttttatctactaccggttatacgccttcaaacagttcgattttatcaccggctcttaacttaacaattgcttttttgtattcaggggtccggccaacaaaacgaccaacccgtttcatttttcctttaaccctgatggtatttaccttttcaacttttactttaaatagctcctcaattgcatttttaatttcaattttgttggcatttttatcaacaataaaagtatatttgttttcctgggctaaatccatagatttttcggttattaacggcctaatgattatatcccttggatttttcacttaaaacacctcctccacttttaggaccgcatcacgggtcatgatcagcttgtcgtgattcaggaggcttaatgcattgaggctgggagctgtcattacggaaactcccggtatattgcgggccgatttttccactatttcatcataacctgcggtgacaattaaagtcttgccgttcaccttgaggttatttaatactctaatcatttctttggtttttggtgcagcaaaagttaaactatctactactataaggttattttcatttactttgtcggaaagcgctgacttcaacgccgcccggcgtacctttttgggtacagaataactgtaatcacggggatgtggaccaaagacgataccacccttccgccaaaggggtgaccgaatactaccatgccgggcacggccagttcctttttgtctccagggctttctgccaccgccagatacttcaccccgagtttttgtatcgtgagttccccttctttgatttgccaggtacattaatgaaacttcatataagaccgctttattcaccggagccccgaaaatttcgtcttttagttcaatttctccaacctgggctccttccatgttgtaaaccggaactttgggcatctttatccccctttcttaaccaaaacttctattttccttttactgcttctttgatgattaaaaggcttcctctaatacccggaaccgaaccttttataaccagtaaatttctctctggatctaccttaacaacctctaagttttgaatagttaccctctccataccaagtcgtccgggcaacttccggcctaaaaatacccgagccggtccttttgcacccagtgaaccgggccgacggtggtattttgaaccgtgagccattggtccccggtgaaaaccatgccgtttaatcccaccggcaaaccctttaccttttgatattccagtaacatcaactttctcgccaacggtaaaaatgtctacctttatctcctgtcctacttcataagcatcgatattttccacccgaatctctcttaaataccgcatgggcttaacatttgcccgattaaaatgcccttttaacggcttgtttactttactttcctttatttccccaaaaccaagctggatagcattatagccatcattagctattgttttcttctgcactaccacgcaaggcccagcctcaatcaccgtcaccggtattgccctgccgtcttcggtgaaaatttgggtcattccgacttttcttcctaaaattcctttcggcatttgtttcacctcctacagcttaatctcaatatctactcccgccggcaaatcgatccgcattaacgcatcgatagtttttggggtgggatcgataatatcaattaagcgtttatgcacctttaattcaaactgctctctggagtctttatcgatatggggcgaacgcagcacggtatacaagcttctttcggtgggaagcggaataggtcccgatacgctcgcacccgtcctcttggccgtttcaacaattttcgcagcggactggtccaagatggtatgctcaaaagcttttagtttaattctgattttttgtttattcacgcattacccctccttttatttcccttttacataaaacaccggaggaaggggaataaattcccccgcctcctgttttttgccgggagaggctttattactcttcgatcgcggtaacaacgcccgcgcctacagttctgccaccttcccgaatagcaaatctcaatccttcttcaatagcaatcggtgtgataagctcaatatgaatctttacgttatccccgggcattaccatctctacaccttctggtaaatggattactcccgttacgtccgtcgtccggaagtaaaactgcggccggtatccattaaagaacggtgtgtgccgtcccccttcttccttcgtcaatacgtatacctcagcaaaaaacttccggtgcggctttatcgtaccaggcttcgccaatacctgcccccgctcgatttccttccggtctactccccgtaataacgctcctatgttgtcccctgctaccgcttcgtctaacaccttccggaacatctccagtcccgttactaccgtcttccgcggagcatccatcaatcctactatctccacttcttctcctatggttatccgtccccgctctacccggccggtcgcaaccgtcccacgtccggtaatggtaaatacgtcctctaccggcattaagaacggcttatctacatcccgctgcggtgtcggaatgtattcgtctaccttgtccattaactccaatatcttcccacaccacggacaatcttccttgccacaaccgcactccaatgccttcaacgccgaccctgctactaccggtacttcatccccgggaaactcgtacgtgcttaaaagatcccgcacttccatctctacaagctccattaactccggatcatctaccatgtccgctttgtttaaaaataccacaatgtagggaactcctacctgacgggctaacaaaatgtgctcccgcgtctgcggcataggaccatcagctgcagacacaaccaggatagctccgtccatctgcgccgctcccgttatcatgttctttacgtagtccgcgtgtcccggacagtctacgtgggcatagtgccgcttctcggtctcatactccacatgcgctgtattaatggtaattcctctttccctttcttccggagcattgtcaatctcatcgtacctcttttgctgggctaatcctctcttcgccagcaccgtagtaattgctgcggttaaagtggtcttcccgtggtctacgtgacctatcgtcccaatgtttacgtggggctttacccgctcaaattttgccttcgccatcgttactcctcctttttacttaccttgtcttttttgaataatttgatctgccaagttctttggcacttcctcataatgggagaaatgcatagtataagtaccccgtccctgggttttcgaacggagatcggtagcataaccaaacatttcagctaatggtacatagcctcttacaacctgcatgttattccgggcttccataccttcaatccgtccccggcgagagttgaggtcaccgataacctcacccatgtattcttccggaacaacaacttcaactttcataataggttctaaaagaaccggatttgcttttaaaaccgcctgtttagcggccatggaaccggcaattttaaaggccatttctgaagagtcaacttcgtggaagctaccatcaaacagcgttacccgaacgtcgataaccggatatcctgccagtactccggattctaaggcttcccgtacaccagcatctactgccgggatgtattccttgggaatcacgccaccaacaattttattgacaaactcataacctttaccgggctccagcggttcaatttcaatccaaacatgaccgtattgaccgcgtccaccggtttgccggatgtacttaccttcagccttggcagtcccccgaacggtttctttgtaagcaacctggggcttaccaacattggcttcaactttaaactcccgcatgagccggtcgacgataatttcgaggtgtaattcacccatgccagcaataatggtctggccggtttcctggtcggtccacatcttaaaggtggggtcttcctcagctaaacgctgcagggcaatactcatcttttcctggtcctgcttggtcttgggttcaatcgcaacgttaataacaggctcggggaattccatggattctaaaacaattggatgcttttcatcgcaaatggtatctccagtgtgggtatcttttaaaccaactgctgcagctatatctccggaacatacttcatcaatttcttcccggtggttagcatgcatccgtagcaagcgaccaatccgctctttcttccctttggtggaatttaaaacgtaagaaccggctttaaggacaccggaataaaccctgaagaaggtgagcttacccacatagggatcagccataatcttaaacgccagagcggcgaatggttcggaatcgcttgccttccggaagtcttcatcacccgtttcggggttaatcccgcgcactgccggaatatccaccggagaaggtaaataataaacaatagcgtctaaaagcggctgaacacctttatttttaaaggaagaaccgcaaagtaccggaacaacttttacagcaattgttgcttttctaagtcccgctctgatttcttcgggagttagttcttccccatccaagtatttcaacattagttcttcatcagcttccgctgctgcttccattactttttcccgatactcagctaccaaatctaacatctcagcaggaatttccgcttccgctaattgagtaccgaggtcatcggtataaataatcgctttattttcaattaaatcgataactccctggaatgtatcttcatttccaatggggagctgaatcggtaccggattggcccccaggcgttctttaatttgcctgaccacttcaaaaaagtttgctcccatccggtccattttgttaacatacgctatccgcggaacaccatatttatcggcctgacgccagacagtttccgattggggttcaacgccaccaacagcgcaaaatatcgccacggcgccgtctaaaaccctaagcgatctttcaacttccacggtaaagtccacgtggccgggcgtatcaataatgttaatccggtgatttttccaaaagcatgtagtagccgctgaggtaatggtaataccccgctcttgttcctggaccatccagtccatggttgcggcaccatcatgcacttcgcccattttatgcactttaccggtatagaagagaatacgctctgttgtagtcgttttgccggcgtcaatatgagccataatcccgatgtttctcgtccgttccaacgggtattctctcggcatatcgtattccctcctttaccatctataatgggcaaacgccttattggcctcggccattttgtgagtatcctcttttttcttaacggctccgccaacaccgttagctgcatccataatttcagcggccaatttttcttccatgctccggccgtttctttcccgggcatagttgacgatccagcggatagccaaggactgccgccgttccggacgaacttccaccggtacctgatagttggccccaccaacccggcgcggccgtacttcaagtacgggcataacatttttcatggcttcttcgaaaacttctaatggatccctgccggttttttcccggattatatcaaaagcccgatagcagattttttccgccaagctttttttgccgtcaaccattgtcttattaatcaacttggttaccaatttgctgccataaattggatccggcaaaacatcccgcttgggcacaggtcctcttctgggcatcttcttcccccctttacaaggattctttcagttactttttacttcttagctttaggccgttttgttccgtacttggaacgaccttgattgcggttctgcactccagcacagtcaagcgctccccgaacgatatgatatctcacaccaggaaggtccttaacccggccaccccgtaccaataccaccgagtgttcctgtaagttgtgaccgataccgccgatatatgcggtaacttcaatgccattagttaaacgtacccgggctactttccgtaaggcagagttcggctttttcggggttgtcgtatagactctggtacaaactcctcttttttgcgggcatcctttgagcgccggtgcactggatttcactgctactttttccctaccttttctcactaactgattaatcgttggcatttattacacctccttccccggatcaataattgcagcacaggcacaacctacagcaataccgcagctttttcccaattctgccatagtatctacggtttcaactggaacatttttttccttgcagagggccaccaccggatcggtaacccgcttttctgcatctaaggcaataaaaacttttatcgctttccctttttggagggcttttaaagtttgcttggtgccaaccgtcctgtttttggtttccttaatctccgaaagcggcactatactccctcccgcctgttaacacacttttatatgatagcattttgcaaaatccttgtcaattcatctaaattttcgccggaggtaatatccattaaaattttgttaatttttcaggggccgtgaggtcccggcccctgaaattttactcttcattcttggcctgaaccatgatattgcggtaacgggccatacccgtacccgcaggtattaacttaccgataatcacattttccttaaggcctaaaagcggatcaaccttacctttaatagccgcttcggtaagcaccctggtggtttcctggaacgatgccgccgataagaacgagtcagttgccagcgaagccttagttatccccagcagtaccctcttagcggttgccggttttccaccttttgcaataactttagcattttcatcttcaaattcaaaaatatccaccaggcttcccggtaaaaggtcggtatcaccggaatcctcaatttttacctttcttagcatttgcctaataactacctcaatatgcttatcgttaatttccacaccctgcatccggtaaactttctgcacttcctggaggagataaagctgagccccctcgatacctttaactttaattaagtcatgggggttaataggcccttccgttagttcgtccccggcatatactttatctccggtctggactttgatgcgtgcttgataagttataggatataccttgcgttctccggtctcctgatttatgacctcaatttcccggcgtcctttgttatcccgaacctcaaccacaccatcaatttcggtaataatcgcctggcccttgggtctccgggcttcaaacagttcttcgacccgcggtaaaccctgggtaatatcctcaccggcaacaccaccggtatggaaggtccgcatggtaagctgggtacccggttctccgatactttgcgcggcaataattcctaccgcttcgccgatatctactatgctgttggtagcaagatttcgaccgtaacaccgggtgcaaaccccgtggcgagtgcgacaggttaatacggaacggattttaaccttcttaatatttgccgaaacaattttttcagcgatttcttcagtaatttcctggtttttcgcgaccagtaattcgcccgtttccggatggactacatcttccgcagccactctccccaaaattctatcttcaagtttttcaataacatcagtcccgtctttcacatcggttacataaataccatcttcggtaccgcaatcttcttcccggactataacatcctggcaaacgtcaaccagtcgccgggtaaggtaaccggagtcggcagttctaagcgccgtatccgccaatcctttccgtgctccgtgggtggaaataaagtattctaataccgttaacccttcccggaaattagctttaatcggcaggtcaatgattcttccggaaggatcggccatcaatccccgcattccggctaactggcgaatctgctgaatgttaccccgggcaccggatttggccatcatataaacgtggttaaactgggaagcttccagggtttccaccagttttttcgttaccttttcggttgccgcattccagatatctaccacccgctgataacgttcatcttcggtaattaaaccccggcggtacttgacttcaatgtccgccaccatccggtccgcttcttctaaaatttcctgcttttctttgggaacggtaatatctacgataccaatggtaagaccggcctttgttgcataatggaatccaagttttttaagaccgtctaacaagtagccggttttttcatagccaagctttctataggattcggtaacaatttttcccagggcttttttatcaactaagtgatttataaatcttaactcttcgggaattacctcattaaatattatccttcccggagtggtctctaactccactatttctccccgtatgggatagcgaacttttattttggtgtgaagctcgataaccccttcttcataagccattattacttcttccggatgggcaaatttcttgccttcacctttagccccgggcttttctaccgtcaggtagtaactgccaataaccatatcctgagtcggtacgactacaggctttccatctttagggttcaagatattgtgggaagaaagcattaaaagtcgagcttccgcctgggcttccgccgaaagaggcacgtgaaccgccatttggtcgccatcgaagtcagcgttgtaagcggtacaaaccagcgggtgaatttgtattgccctaccttccaccagaaccggttcaaaagcctgaattcccaaacggtgcaaggtaggcgcccggtttaaaagcaccggatgttctttaattacctcttccaggacatcccaaacctcgggtttgacccgctccaccatgcgcttggcacttttaatgttgtgagcaataccgtcggccactaattttttcataacaaacggtttaaacaactctaaagccatttcctttggcaaaccgcactggtgcaacttcaattccgggccaaccacgataaccgaacgaccggaatagtccacccgcttacccaataggttttggcggaaacgcccctgcttaccctttaacatatccgacagggactttaagggccggtttccgggtcccgttaccggacggccacgccggccattatcgataagagcatccaccgcttcctgcagcatgcgcttttcattccggacaatgatgtccggtgcccctaattccagaagcctttttaagcggttgttacggtttattacccgccggtacaggtcatttaagtccgacgtggcaaaccggccaccgtctaactggaccatcggccgcagttccggaggaataaccggaataacatctaaaatcatccattccggccggttgccggattttctaaacgactcgacaacttccaatcggcggagtgctctgatccgccgctgtccggttgattctttaatctccgccttgagctcggcggaaagttcatctaaatctatttccgccaaaagctcttttatcgcttctgctcccattcccgctttaaaagcattgccgtacttttcccgggcttcccgatactccgtttcggtcagcaactgctttttaagaaggggagtttccccggggtcaatcacgatgtacgaaacaaagtacaaaactttttccagggaacggggagacatatccagtaaaaggcccatccgactgggaatccctttaaaataccagatatgcgataccggagcagcaagctcaatatggccaagccgttcccgccgcacttttgaacgagttacttcgaccccgcagcggtcacagacgactcccttataacgaacccgtttatatttaccgcagtgacactcccagtctttggtagggccaaatattctttcgcaaaaaagtccatcccgttccggttttagagtccggtaatttattgtttccggctttttaacctctccatgggaccaggcacggatttgatccggagatgcaagaccaatcttaatacgctcaaagttatttagaaccagcaaggagcttctctcctttcaataatttaatcctccaggtcaccatcaaaatcatcattaatctcaaaatccgcttctacttcttcctcataatattcgttttttacttcgtctcgatccgcaatgcttgccgctaagccgtattcttcggctttttcacctatatcatcgtctatttccttaatttctacttcttcatcattatcggtgagaactttaacgtcaagccccaagctttgcagttccttgattaataccttgaacgattctggaacacccggttcagggatattctctcctttaacaattgcttcgtaggtttttacccgaccaaccacatcgtccgacttaatggtgagaatttcctgcagcgtataagcggcgccgtaggcctccaaagcccaaacctccatttccccgaaccgctgcccaccaaactgggcttttccacccagcggctgttgggtaaccagagaatacggaccggtagaccgggcatggattttgtcgtctaccaggtgagcaagtttcagcatataaacatagcctaccgttacgcggctgtcaaaaggctcaccggtacgtccatctcttacttctatcttgccgtcttccggaagtcccgcttttcgcagcgcctcaaaaatgtcttcttcggtagccccgttaaaaatcggagttgctacatttatcccaagagccttggcagcccaccccaggtgacactccagaatctgtccaatattcatccgggaaggaacacccagaggatttaaaacaatttccacgggggtgccgtcgggtaagaaaggcatatcttcttccggcaaaatccttgccacaacacccttattaccgtggcgaccagccatcttgtccccgacggaaattttccgtttctgggcaatgtaaacacggaccagcatatttactcccggagaaagctcgtcgccattttcccgggaaaaaactttaacatcgacaacttttccggattctccgtgaggaacccgcagggatgtatccctgacttcccgggccttttccccgaaaatagccctaagaagtctttcttcagcagtaagttccgtttctcctttgggagtgactttacctaccaggatatcccccggacggacttcagcccctatccggataattccccgttcatctaaatcttttaaggcatcttcaccaacattgggaatatcccgggtaatctcttcaggaccaagcttggtatcccgggcatcacattcgtattcttcaatgtgaatggaagtaaaaacatcttctttaaccagcttttcgcttatcaaaatagcgtcttcatagttataaccttcccagggcatgtaggccaccaaaacatttttacctaaagccagttcaccgtgatcggtagacggaccatcggcaataatttggtccttctccacccgttcacctttcctaacaatcggcttttgattgatacacgtcccctggttggaccgttgaaattttataagcttataccggtctatttgcccctggtcgtttcttatgacgatctcatccgcagtaactcgctccacaactccaggattcttggccagaaccacaacccccgagtctttagcagccttgtactcaataccggtgccaactaccggcgcttcggtccggataagcggcactgcctgccgttgcatgttagcacccatcaacgcccggttggcatcgtcatgttctaagaaaggaattagggaagttgccaccgagaaaacctgtttgggagaaacatcaacaaaatcaacttttgaaggctcgacgtgcaagatttcgctgccatgccgggcattgaccatttcatctaaaaattttccttccggagaaagcctgacgttagcctgagcaataatgtatttttcttcttcatcggcagttaagtaaacaatttcattggttacaactccccgctccttatcaaccttgcggtagggagtttcaataaaaccaaattcatttacccgggcataagtagtaagattaccgataagaccaatgttaggaccttccggcgtttcaatggggcacatccgcccgtaatgggagtggtgaacgtcccgcacttcgaaaccagccctttcccgggaaagtcctcccggtcccagagccgaaagccgccgtttatgggttaattcggccagaggattggtttggtccataaactgggaaagctggctggaaccaaagaattctttaatggcagctacaataggtcttgtatttattaaaacctgcggggttaatgaatcggcatcctgaatggtcatccgctcccgcacaacccgttccatccgggctaaaccgatcctaaattggttttgcagtaattcccctaccgaccggagccggcgattgcctaaatggtcaatatcgtctaccttcccctgtccccgcattaatcctaaaagatagcgaatggtataaattatatcttcgttagtaagttcccgaataaactcccttttaacgggaacatagtcatttaaatatttatcatattctttttcaccgtcttcctcgaggtaacggtataataccccgtgatttaattttttaaatagcttgtatcgtccaacattacccagatcgtaacgttttggatcaaaaaacattgaatctaaaagagttttcgcactctccaccgtaggcggttcacccgggcggagctttttatatatttcaattaacgcttcttcccgggaatcggtattgtctctttcgagggtagcgataattttatcatcatggtcaaataattccgcaatgcgcccttttgattcgtacccaagcgcctttaaaagcaccgttacgggaagcttacgggtacgatcgatacggacatatatatggtcatttacatccgtttcaaattctaaccaggccccccggtttgggataattgttgccaggtacatttttttaccgttagggtcgacctgttccgaaaagtaaacccccggggaacgaaccatttgactgattacaacccgttcagcaccgttaaaaataaaggtacctttttccgtcattaaggggaaatcccctaaaaatacttcctgctctttaatttctccggtttccttatttaaaagtcttacctttactcgaagaggggcagaatatgtaaaatcccgttctttgcactcctccacagagtatttgggtttaccaaggtagtaatctaaaaactctaaagataaattaccggtaaaatcggtaatcggggatatttcccgaaaaacttcccttaacccttcatctaaaaaccactggtacgattttttctgaatttcaatgagataaggaagttccaggatttcgggaaacttggcatagctataacggatttttttcccgacctgcaccggtatcattaaactatcacccctcagaaaaaattaaaagccaaaaaggtaaaaaggcaaaaagaagcccttttgcctttttacctaaaaatattcaaggcaatacttcacattaccatattgtatccaaagtcgcaagatattacacatcctccaatttaattataagatggcatttttaaatgatatcacaagtatttgtgattgtcaataaacggattacctcccggaggtaaaaactcatcacaacaaccgaaattttgttcagcaccaaaattaaccattccgagcgttcgattttcttgatttaattataccaaactccgggggttttgaattctttataatagtgggctaaacagcagcagaaaataaattctaccctaactatgtgccaaaccttgcttccacataaaaacccccggctttttgccgggggttttttggaaaagttactatttaatttcaacagtagcgccaacttcttcaagcttggccttgatagcttcggcatcagctttgctgactttttccttaacaggcttcggagcaccatccaccaaatccttggattctttgaggccaaggccggtgatttcccggacaactttaataacgttaactttttgtgccccggggctgacgagaattacatcaaattcggtcttttcttcctgagcaggtgccgcagcagcagctccggcagcaggagcagcagcaaccgctacaggagcagcagcgctgacaccaaactcttcttcaaaagcttttacaagctcagcaagttcgagaacagttaaacttttaacagcctctaaaatttcttgtactttggacatttatgccacctccaaaaatatttttttcgtatttatggttaagcccataggcttatacccgataaaattattcctcgcccgctttctgcttgcggattgcttcaagggcataaacaaattttctaagcataccggcaagagctccagcaaatccgtaaaggggagcttgcatgccaccaagaagctttgccaaaagaacgtttcgcggtggaagatcggcaatggctttgacctggtccttttccaaaacaatattttccaggattccaactttaatttctaaattaggatgatctttagcaaaatcaaataaaactttcgcagctgaagctggatcttctttggccacagccaaagcagttggcccttctaaataaggatccaatccggtaatacccaagttatgggcagcccgtttagctaacgtattttttacaactttaatttccgcacctttttccttgagtttccgccgaagttcggtcatttcagccacagtaagcccccggtagtcaaccagtattgccgcctgggagcttttaatcatttcctcaatctccgctactacctttgccttttgttcaataatcggtttcaactaacgatccacctcctcgaaagcaattaaggccgccgtagacacacggcggccttgggtttttcttccttaagccttgcctcggttggcggtttcccattaagcactcaggcaccaacggtctacggcaaataaatatttatttgccacaatggtcattttaacacatgtcaaacgatttgacaacactatttaactagctttaagtgatttattttaatgccaggccccatagttgatgaaactgttacaccttttaaatattgaccttttgcacctgcgggcttggcttttattaaagcatccattaaggtgttgaagttttccacaagcttttctaccgggaacgacacttttccaatcggcacgtggacaataccagctttatctacccggtactcaatcttaccggctttaatttcggcaatcgcttttgccacttcaaaggtaacggttccagttttcgggctgggcattaaccctttaggacccaaaattttacctaaacgccccacagctcccatcatatccggagtcgccaccactacgtcaaaatcgatccaaccctgagcaattttttcaatatattcttcggccccaacataatcagcaccggcagcttctgcttccttcgccttttccccttttgcaaaaaccaatacttttcgggttttaccggtaccgtgaggcagcactacggcacctcttacctgctgatcggcatgccggggatcaaccccaagttttacagccacttcaacggtttcatcaaacttagcaaaggaaagctcctttaccagactaaaagcttccgccggttcatataacttggttttatcaacttttttcgcagcttctaaatatttctttccatgttttggcatttttccttccctccttgtggtattagcggaaagacactcctcccactttttagcaaaattttaatatactaaaaaaattagtctacaacttcaattcccatactccgggcagtaccttcaatcattctcattgctgcctcaacatcgttggcatttaaatctttaagcttaagctcagcaatttcccgaattttagcccgggtaactttacccacttttttcttgttgggctggccagaacccgattctattccggcagctttcttaagaaggtccgaagccggcggagttttagttacaaaggtaaaggaccggtcttcgtaaactgtaatttcaacggggataatcataccagcctgttgagcagtacgctcattgtattctttaacaaaagccattatgttaaccccgtgctgaccaagggcaggaccaaccgggggagcaggcgtcgctttacctgctggaatttgtaatttcactactgcaactactttcttagccatcttttcacctccattcaaaaactatatcttagttacctgggaaaaatcaagttcaatgggagtttctctcccaaacatagaaaccaaaacctttactttccccttatccgggtaaatttcttcaacatttccaacaaacccttcaaaaggtccagcatttacccgaacaggttgcccaatttccaaatcaattttcgtccggggttcatcaatacccatctgcttcataatttgccgtacttcctgagcagtcaaaggaatgggcttggaccccccaacaaaaccggttactccgggagtatgtctaaccacattgtaagactcgtcagttaaaatcatttccactaaaacataaccggggaaaattttgcgtttagaaacctttttctttccgtctttaatttctaactcatcttccatggggaccaaaatgcgaaaaatgtgattccccatgtttaatgactcaattcttttttctaagttggcttttactttgttttcatgtccagaataggtatggacgacataccagtttttttccattacaagattcctgcctttacctatttaagaagtaagttcaggaaaaagcttaaaaacgagtcaaaaagccagatgataaggcctacaataataacggttaaaaaaacaactcccgtataaacaattgattcatttcgggtcggccagtggacttttttcacctcggcccaaacactccgaaaatactgctgagtttttacccaggctccctcacccgctttagaagctttccgggtctctttcccagcttcggttttagaaatttccttacccgcagctcccataaaaattccccatccttttattttgtttctttatgcaccgtatgagcattacagtaagggcaatacttctttaattcaagtctccccggatcgttctttttatttttggttgtagtatagttacggtgcttgcattgggtacattctaaagttattgttacgcgcatttcaaccatcctcctaaaaataaaaaaatcataggcagtttacaattttacctaatataatctatcacaataccccagccctgtcaatacaatgaaaattttaacctaaacaaaaaagggagggaaaccctccctttaaacttactcttcgatcgcggtaacaacgcccgcgcctacagttctgccaccttcccgaatagcaaatctcaatccttcttcaatagcaatcggtgtgataagctcaatatgaatctttacgttatccccgggcattaccatctctacaccttctggtaaatggattactcccgttacgtccgtcgtccggaagtaaaactgcggccggtatccattaaagaacggtgtgtgccgtcccccttcttccttcgtcaatacgtatacctccgcaaaaaacttccggtgcggctttatcgtaccaggcttcgccaatacctgcccccgctcgatttccttccggtctactccccgtaataacgctcctatgttgtcccctgctaccgcttcgtctaataccttccggaacatctccagtcccgttactaccgtcttccgcggagcatccatcaatcctactatctccacttcttctcctatggttatccgtccccgctctacccggccggtcgcaaccgtcccacgtccggtaatggtaaatacgtcctctaccggcattaagaacggcttatctacatcccgctgcggtgtcggaatgtattcgtctaccttgtccattaactccaatatcttcccacaccacggacaatcttctttcccgcaaccgcactccaatgccttcaatgccgaccccgctactaccggtacttcatcccccggaaactcgtacgtgcttaaaagatcccgcacttccatctctacaagctccattaactccggatcatctaccatgtccgctttgtttaaaaatactacaatatagggaactcctacctgacgggctaacaaaatgtgctcccgcgtctgcggcatcggaccatcggctgcagacacaaccaggatagctccgtccatctgcgccgctccagttatcatgttctttacgtagtcagcgtgtcccggacagtctacgtgggcatagtgccgcttctcggtctcatactccacatgcgctgtattaatggtaattcctctttccctttcttccggagcattgtcaatctcatcgtacctcttttgctgggctaatcccttcttcgccagcaccgtagtaattgctgcggtcaaggtggtcttcccgtggtctacgtgacctatcgtcccaatgtttacgtgcggttttacccgctcaaatttcgccttcgccatcgttactcctcctttttacgtagttttaaatatacacgtatacaagtcgctaatatgtaaatagttatgccaagatatctattctacatctttaccatttttcctgctgcttaaaaccataaagtcaataattttcacccaatctacaaaaattgctaaaaaacaaaaaccggtcaacgaccggccggtttccaaaaaaaatttggtggcggcgcagggactcgaaccccggacactgcgggtatgaaccgcatgctctagccagctgagctacgccgccataaataaaaatggagccactaaccgggattgaaccggtgacctcgtccttaccaaggacgcgctctaccgactgagctatagtggcctggttgcggggggaggatttgaacctccgaccttcgggttatgagcccgacgagctaccagctgctccaccccgcgtcgcaaaacctattatatcacaactaagtgaaaatgcaagatgcattttattggaatttgatggagctggcgacaggacttgaacctgcaaccctctgattacaagtcagatgctctaccaattgagctacgccagcacccgcaagtgatattttagcaaagatgttttttaactgtcaagaggataatcttagcacgttaataaagcgaaactccccggaaatcccggggatggttttttctattcagcctctctgcactccaaatatttctcaagctttctttttacccgctgtaatgcattatcaatggattttacatgccgatttaactcgcaagctatttcctggtatgactttccttccaggtaataaattaaaaccttccactccaaagaacttaatatttcgttcatctttccttcaatatccgcaaactcttcccgactaataatcaattcctccggatcagctacctttactcccgaaagtacatccattaaagttcgatccgagtcttcatcgtagattggtttatttaatgaaacatacgaatttaagggaatatgcttttgccgggtggcagttttaattgcagtaataatttgtcgggtaacgcaaagctcggcaaaggctcggaaggaagaaagcttgtccggcctaaagtcacgaacagccttatataaacctatcataccttcttgaataatatcttctcggtccgctccaattaaaaaataggcacgagctttggaccgaacaaaatttttatacttgttaatgatatattcgagggcttgctcatctcctgctcgagcccactccacaatctcttcatcgctcatgtaatcataacagtactccatttttttctcggcacttatactcaagcccatcgcccccgccctatatctttgcccaccaataattataaacttttcttaaagattaagtcaaggaagagtattccgaatttttattagaaaattcaacattttcttacattttcccttttcgtagtttttcaagttttgttttgacctgctggtcaattcgatcctccaaccgctgcggcaaaactttgttaagcaattctttagcttttttctcttcaattttgaggtcatttaaaagttccctcaaagatatccttaatgctccatagccgaaaattaatttttgctgtaattcatcctgggtcactacgtaaacccgattcccaggaagcagttcctggacttttttttcaataaaatgatctgccgtctcaccactttcggtaaagactaccgttattcccgcctcaaaaaattccctgcggctttccttttgctggtgagcatcataaactataattacttcccgccccgttaaagcccggtagtttattaacctctcttttaaaacttccctggcatgttctagggaagtttcatcttttaacttatttaattccggccaattaaataaaagattgtaaccatcaattaaaacatattcagccataattatccccttctctgcctcaccacttcggccattaaaagagctgcggctaccgaagcatttaaagaattaatcgttcccaccattggtatgcttacggtaaaatcacactctcttaatatatgcgaagttaaccccacattttctccaccaatcaccaaggctaaagggagcttaaaatcagtatcccacagagaagccttactttttgcatctgcccccaccacccaggctcccttttcttttaaataacgtaaagtttcggcaacattggtacaacgggcaacgggaactttcaaatacgctcctgcagaagctttagccacagctccggttacctgcaccgcccggcgttttggtattattactccgtgcaccccaaaagcttcagccgaacgtaaaattgcccctaaattctgggggtcttccaaatgatttaaaaccaaaataaaaagtggttctgctttgcgttcagcaattgccaaaatatcatcgatttccacatatttaactggagaaatatccgcttccacaccctgggatttggcatgaagtttttccctgggaacttccactaccggtactttattttcccgggccaaaagcagcaactccctgatatttttgtcttttgtctcccgggataaatacagtttattaacgattcctttcattagggcttctctaaccgggtttacaccgtaaatccgctccaactattaactacctccctcatcttgcaaattcagcctgccgcaggacataggtccttcaaaacatactccgcgggtttcacaaagcggcccagctttttcaaataaaatcggagctaccttccgcacctcttctaacattttccgggccaaagttcttatttcatgttgggcccggctacaaagccgaacctcaaaaaaatgcagaagttccctggcattcatggtaacaacgattttcgtctccgccgcattgggaagaaggtaacgggcatcttccgcgggaattcccatctctattaatttaagatacccttcctttatcgctcttaaaacctgctgataaatttctaaggcttggctactgttggcaatggtaggggggattaaaaaattaaagttttgttccaccacataacgctgactctgctgactgaaactagcaatccggtggcgaactaactggtgggttaaagcgcgacttaccccttcaatgccaaaggtgaaacttacgtgttcgaaaggcgaaaggtgatttaaatcccaaagtttttttataaaatttttttgcctctcctcatccattttttctaaaatttcctctacccctaccggagaataacaaagccgggcggccgctgccaccgtccgctccggctcttgggtataagtaagtaagctcaccttcatctggcttccccctgattttcaagtaactttactatcaatccaaaaagttctttaattcgaacaatattcccttttaagtacaaaaaaccaaagaccgcttctaaaccggtactccgacgataaaccaccacttctacattacgcggataatttcccttggcatttcgtccccgccggaatatttccctttcttcggaagttagatactcctcaattagttctccagctaaagcttgctgccgggcatttaccagagaaactgattttttgtgaacttcccccatttttccgccatatcgttccaaaacgtattcccgggttaatagttcataaaccgcatcgccaagatacgctaaagccagaggagaatattctttagcttccatctactaaaccctcttccagcgcacgcccttaggagtatcttctaaaatgattccctgtttttttagttcatccctgatgaaatcggccaggtcatactttttttcttttttaagtctggcccgaacttcaattaatagctccacaaacggcgttatatcttctccggctatcttttccaaaacaccaaattcgataccaaaaacctgggtataaacgtttaatgcttcttcaaatagttttttatctccggcggttagattcccgcttgctatttgcgtatttccaaaccttaccagctcaaacagtgatgccatagcctgggcggtattaaagtcgtcttccatagcttcattaaaatcgcgcaaaaaatttgtaattttttcctgaatttctatcctggcctctccgggcaaaggattaacttcttttaaattttgcacaaagttatcaactcgctccaaagccgctttagcttcattaagttttttatcatcaaaatccaaagggcttcgataatgagtcgagaggaggaaaaaacgcaccacccttcccggaaacttctccaggatttccctcaccaaaaagaaattacccagggatttactcattttttcctgatttacggttataaaaccgttatgcatccagtaacgagcaaaaggctttccggtaaaagcttcgctttgcgcaacttcgttttcatggtggggaaataccaaatcagctcccccgccgtggatatcaaaattttctcccaaatattttaaagacatcgcagaacattcgatatgccatcccggtcttcctggaccccaggggctttcccaatacggttcccccggttttgcttttttccagagggcaaaatccagaggatttttctttttctcatctacttccacccgggctccggcctttaattcttctaaatcccgaccagatagtttgccgtaatcggaaaaactatccaccgcaaaataaacatttccctctacttcataagcatatcctttttcaattaagccttttaccatttcaattatttccggtatatgctcggtaactttgggatgaaccgttgccctttttactccaaggcgatcagcatctttaaaatactcaataatgtatttttgcccaagttcaataggggaaattccttcctctaaagcccggttaataattttatcatcaatatccgtaaaattctggacataaattacttcaaagcctttatactcaaagtaccgccttacggtatcaaaaaaaactatggggcgggcattccctatatgaatgtagttataggtggtcggaccgcaaacgtacatatataccttccccggttcccggggaataaattcttctttggttttggtgagagtattataaattttcacgttttctttcctcctcaagctcggcaattctcttttccaacctttctatcttccggtgcatacacatcaacatctcagcaatcgggtccggtaacagatcgtggcgaaggtcgatttcctcatcaacccgtttgccgtccctaatcaccactttacccggaacacccaccactgtagagttgggaggaacttcttttaacactactgaaccagctccaattttagagttgtcacctactttgaaggagcctaaaatttttgctccggcactgatcaccacattatttccaatagttggatggcgcttacccttttccttaccagttccgcccagggtaacaccttgataaatggttacattatcaccaatctcagccgtttcaccaattactacacccatcccatgatcaataaacaatccttcgccaattttagcccccggatgaatttctattccggttaaaaatcttgaaatttgggaaataaatctggctaaaacaaaccagcgctttttataaaaaaagtgggctatacggtgaaactgaatggcatgaaaaccaggataacacaacaaaacttcccaaacgcttttaaccgctgggtccctttcaaaaaccacctgaatatctctttttagtcggcgataccacccaaacataaccatcaccttttttaattaaataaattcataatacgccgctctgcttccgctggcccaagaatggctataacttgatataactccggtccgtgagttttaccggttaaagccgcccgcaggggcatgtaaacttttttaccgccaaccccaagctcttttggaagtttctttaaaaatccttttatttcttcttcctccgaaccgggtatttcccttaatttatcagcaactttccttaagatattgcgtgcttcttcatcagccaataaagttttggcttcctcctcaaaggcaagttccttttggtaaaaaattgcagcatgttcgggaagttccgacaaagttacaacatattcccgggttgcttctactactttggttagcttacgcatttcctcttccgtggggttttgtgagacataaccacagctttggaaaaagggaagacttaattccacaatccgggaaagctccgaattgcgaatgtaataaccgtttatccagtttaacttatccaggtcaaaaatagctggatttttagctaccctatctaaagaaaagcgttcaattaactgttccatcgtaaaaatctcttcttccgtccccggcgaccaccctaataaagctaaaaagtttaccagagcttccggcaaataacccttttcccggtagttttccaccgaagtagccccgtgtcgcttggacattttcgtccggtctttcccaagaataagcgaaatatgggcaaattccggaatcttaaagcctaaagcttcataaatgagtatctgtcggggagtattggaaagatgctcttcgccccgcaaaacatgggtaatccccatggtcacatcatcaattaccacagcaaaattataagttggtataccgtccgattttacaataataaagtcaccaataccatcggtttcaaaacttacgacaccacgaacaaggtcgtttataactattgttcttccagcaggcactttaaagcgcaccgttggttttcgcccttcagctaaatatttctctttttgttcaggggttaagtttcgacattttccgagataacggggcatttccccttttgccaaaaggttctttcgttcttcttccaattcttcttcggtacaaaaacagtagtaagcgaaaccttcttcaataagcttctgggcatacttttgatagagatcaagcctttcggtctggcggtaagggccattttcaccccccacctcaattccttcatcccaggtaatcccaagccatttgagactttccaaaatatttttttcagactccctactggagcgttctaagtctgtatcttcaatccgtacgataaaaaccccgttatttttccgtgcaaagaggtagttaaaaagtgcggaccttgctcccccaatgtgtagaggtccggtaggacttggtgcaaaccgtactctaaccattttccaaaacctccttgactgtaattaccgcataagcagcaattccttcttcccgaccggcaaaccccaagccttcggtagtagtagctttaacgctaatgttttctattgcggtatttaacaataccgctaaattttcccgcattttttggataaacggtaaaagttttggcttttgggctacgattaccgcatcaagattgttcaggcagtaaccccgttctctaaccctgcgatatacttcctgtaaaagtaaaccgctatcaataccccggtaacgttcatcgttatcgggaaaaagctgaccaatatcacctaacgccagtgaccctaaaaaggcatcggcaatggcgtgatataaaacatccgcatcggagtgacccaaaaggcctttggtaaaagggatctccacgcccccaataatcagttttcgtccttccaccaaaggatgtacgtcataaccaaaacctattctaatcatcataataactcctttgcaaaatagcgggtaaataaaaactcagcaaattccaggtcttccggccaggtaatttttaaatttttataatccccgggaataaccgctaccgtttcaccgcaaagttccaccaaaatactatcatccactgcatctaaatgttgcttttcccctaaggcatgcccttttagcaaggcctctcgccgaaaaatctggggagtttgaaccgcataaagtcggctccggtctaaagtggagataacgacattatcctttacttctttaactgtatccctaaggggtacagccaaaattgcccctccataaccttcggatagttttttaaccccttcgctcaaagccccttttggaaaaaaaggccgtactccatcgtgcacggcaataatagaaaaatttcccgttaatgccctaattccccgcaataccgactccctacgggtagttcctcctgccgttaattttattcctgctaaattataccgagaaagcaaatcccctgcaacttctatgtagttttccggtaccgttaaaaccacctgtcctacaataggtaagttaaccattctctttaaagtaataattataaccggtatcccggaaagttcaagaaactgtttgggcttttcgccgccaaaacggcgccctgctcccccggcggtaacaattactcctattttctccacctggcaagcctcctactgcttttccttgggtttgccaaagataagtcttcccgcggcagtttgtaaaacggaagtaaccactatatttatttgttgccctatgtacttttttcctccttccaccacaatcatcgttccgtcatccaaatatcctactccttgtccctgttccttcccttctttaatcaccattacttccatttcttctccgggaattactaccggttttatggcattggccagttcattaatgtttaaaacttttactccctgtaactcggcaactttatttaaattataatcgtgagtcaaaattttggcttttaatttttgcgcaagctttactaatctaacatccacttcctcaccattgttttccggaatatcaacaatttctacaggaaaagagtttttcaactgatttaaaatatccagtcctcttcggccccgagtacgttttaaattatccgaagaatcagcgatatggcgcagttcatctatcacaaaagaaggtactattaagcttccttcaataaaaccgctgcggcataaatctaaaattctgccatcgataataacactggtatcaagaattttggcattttggttatttacccccagatcatcccccgattttttaattttgggaagaaagttcaaaaggccaaagagctcttccctttttttaaccgacacccttaaacccaagtagcataaaacaacggttaacataatccagatagtattggtaatccacggaattaaaggaatagataaaattacatttcttaaaaggttggcaataattaagccaacaataagtccaaaagtaccgctaacaatatccgcaaccggcattttggtaatttttacctcaagccactcggtcaaagccagtcctttatgccaaacaaaaggagcagttaaggctccaattataaggccaaaaatgcctaaaaccgtccagctaagatacatgccatagggcggtattgctaagatgtcagctaaaggtataacttcaaggtaatacccgatggttgcgaagattccgccaattactatggagaaaaaaattcgaaaaattttttccgccaaactttcccctcctataaaagaatttttaagtgatagtgatagcttcttcaatcatcgctaaaaccttttcctcgtcttcctctaacactagaataagctcacttactaaaatttgtcgagcactttctaaaagctttttttctcccgttgacaagcccttaactttttcccttcgacgtaagtctcgcactacatcggcaatggctaaaatatcgttgcttttaatcttatccacatgatttttatatcttttattccagttagaatgaattttttcctccccctctttcaataccgcaaaaaccttttccaccatatcttttccaatgaccggtctaagccctaccctttccactttttccaccggaagccatagaatcatgtttgtcgcccaaaaagagagcacatagtatttcattacccgatcagcggctaatcgttcttcaatttcccgaattataccggctccatgcataggataaacaaccttagctcccactttaaacatctaatccccccaaattgtaattattttcagtataacaaattttccctaacctgtcaaagaaaataaattattttatcacaacccttttaaaaatgtcaacaaggccgaatcatttgacaaggaggcagggcaaaattataatttatggtagtaaagggaggggacccgatgaaagatttattaattgaccatttccaggaaacggtgaacgaattgttaatacgacataaaagcattttggatgttttatcaaaattaaacgaagcctccgcacgcgttcaccgggctactgtcaaagcggtaacccaatgcggttgcttaaaaatagacgccaaaaaacctattattccggaagatgccaccatcctgcagcttaaagaaatttttgacacccacttaaaaggagaactctgtccaaactgcaaagacaccattgaaaaagaaatggggaggcttttattttacctgacggctctttgcaatcatttagacataaatctctatgatgtgtttataaaagaacaaaaagccctggataccttgaatatctttaactttacgtaaaaaaccgtagctttacgctacggttttatagtgtatagtttgtttgttctcttaattttttaagcccctctttaatcgaacgcgcccttacctcgccaatcccttccacatcatccagctcttcaatggaagcactcataatattttttaaatttccaaaagtttgcacaaggttttcaatcaccgctaccggcagtctaggaattttatccaaaatccggtatccccggggagaaaccggttggtctaaaatacttgcacttcccggataacctaaagcccgaacaattagcgaataatccaaaagatcttccgaagaccaggttctaattaagctcaaaattccttcgggagtcttttccggtcctaaaagggaataatcctgaattattaaaagtccttcatcttccacgttagcaataagttcctctaactgcatgcttattagtcttccttcacttcctaactcccatatatacctttcaatctcccgctcgattcttaagaccatctccactcgttgcagcgctttggccacatccagtaaggtcaccatatcatcaaactcaagattagttaaacgcattaaagttttatcaaggaccgcccggtatttctccagggtagctatggcttgattggctttatttaaaataacactgacctccgatagcgagtatttaaagttcccctgatataaagtaattaccgaacggcgctgggaaatagcaatcaccaaggcattagtttgttttgccaccctttcggcggtacgatggcgaatccccgtttccgacgagggtatcgccggatcgggaactaactgcgcgttagcatataaaatttttttcccatcctcacttaaaataattgctccatccattttggccagttcatacaaatacgccgggctataatcggtatttatggcaaatccgccttccactacctccataattttggcggtatccccaatcacaattaagcccccggtttttgctctaagaatctgttccaaaccttctcttaaaggagttcccggtgctacactttttaaagctaaaacaatccgctcgtccttcataaaatcctcctatatactaaaaagcttaaagattgcttctttaagattagcaaaagtggtaatttccatctcggttttaaagtttatgctttgttttggcaaaaatgcttttttaaaaccaagcctttcagcttcccttaaacgtttatcaacgccaagtaccggcctgatttccccggtcaagccaatttcacccaaaaacactccatcattgggtagcggttcttcccgaaaacttgaaaccaccgccagtagaactcccaggtccgctgccggttccgatattttcaggccacctactacatttaggtaagcatcgtgtaccgacatgcgaaaacctaatttcttttccaaaaccgccagcaacaacacaaaccgattgtagtcaaatccggtagcaacccgtcgcggagtgccaaaaccggtaggagccaccagcgcctgtacttccaccaaaaagggccgcgaaccttccaagctaaccaccacagccgaaccgatacaatcatgctggcgatccaaacttataaaaaactccgaaggattggaaacttcctttaaaccttcacccaccatttcaaaaattcccagttcgttagtggaaccaaagcggttttttaccgaccggagaaggcgaaaagtattgtgtctctccccctctaaatacaacaccacatcaaccatatgctccataacccgcggaccggctaaatagccatccttggttacatgcccaatcaaaaatatagttttatttttttcctttgataagcgcataaaacgccctgcactttccctcacctgagtaaccgtacccggcgctgaaccaagctcaggtaagtacatggtttgaatcgagtcaacaatgattagctcataacccccttttacggccacttcttcaatttcggctacattggtatggggcaaaagatctatttctccactgatgttaagacgctcggcccttaatttaatttgtgccggcgattcctcgccggaaacgtataaaaccttttgtttttggccaactttacctgctaactgcagtaaaagggttgatttccctattcccggatctccccctaagaggattaacgagccagcaacgatacctccacctaaaaccctatccagttccccaaagccagtggaaaacctatccgtttctccggttaagatttttgaaatccctaccggttctacttctccaaaaaccgccttccctttggccaaaaccttttcttccacaaaggtattccagctctcacaggccggacaacgacccaaccacttatatgtttcataaccgcaattttgacaaaagtagatttttttcaccatttaaactattccgctcccattaattgtcattactttcattatatcattgtttttctaccatgaaaaggaaaatcctcccgctcggggaggatttcctaagaaattaaatttttgctaccttgatttgcccatcttccgcatacagttttaccgtatctccttttttgatgtttcccaaaagaagctcttccgacaacttatcttctactatcttttgaatagcccgccgcagcggtcgagcaccaaaagcttcatcataaccttctttaagtattacttcaattaaggagtcgtcaaattctaccttcatctcctgttcttccaaacgtttgcctacttcttttagcatcaaccggactatttgctttaagtgttcttctgttaacgaatggaagacaataatctcatcaatccggtttaaaaattccggccggaaagtacgcttgagttccgccattaacttctccttgatatcctcttcttttttctcgtcggctacatttttaaagcctaaacgggcttctttctttattagatgtgctccgatgttggaggtcatgattattacggtatttttaaagtctaccgtacgccctttagagtcggtaagtcgcccatcttctaatacctgcaacaagatgttaaagacctcggggtgagctttctcaatttcgtcaagtaagatcaccgaataaggcttccgccttaccgcttcggtgagctgccctccttcttcataaccaacatagcccggcggtgcaccgattaggcgagctaccgtgtgtttttccatatactctgacatatctatccgaattaacgcatcttcatctccaaataaagcttcggctaatgcccgtgccagctcagttttcccaacacccgtcggacctaagaaaataaacgatccgatgggtcgcttgggatctttaagacccgcccgtgctcttctcactgcccgggctacagcttttactgcttcatcctggcctattacccgctggtgcaaaatttcctcaagcttaagtaatcgttccgattcttcttcggcaagttttttgaccggaataccggtccactgcgaaacaatctgggcaatatcgtcttcggtaaccgataataaatggtcgctttgctctttttcccactctttcttcttttcctcaagctctgctttaagcttttgctcctggtctcttaatttggctgctttttcaaactcctgagcagctaccgccgcttccttttccttgcggatttcgttaattttttcttctaactcttttaaattgggcggtgcagtaaaggcatttaaacgaactcttgatgccgcttcatcaatcaagtcaatagccttatccggtaggaagcgatcggtaatataccgatccgaaagctttgcagcggcaataatggcttcatcggtaatttttacccggtggtgagcttcgtaccggtcccttaagccttttaagatttcaactgtttcttcaaccgttggttcatctaccattattggctggaaccgccgttctaaagccgggtccttttctatatatttccgatattcatctaaagtggtcgcacctacacactgaatttcaccccgggcaaggctcggttttaagatattggcagcatcaatcgccccttcggcagcccctgccccaattaaggtatggatttcatcaataaatacgataacgtttccagcatttttaatttcttctaagacctttttaagcctttcctcaaattctccccgatatttagttccggcaaccattgatgctaaatcgagggtcacaacccgtttatcaattaaaatctcgggaactttcttttgcacaattctctgggcaagcccctccacaattgccgtcttacctactcccggctccccaattaaaaccggattgtttttggttctgcgggataaaacttgaattaccctttcaatttccttctcccggcctaccaccgggtctaatttattttcccgggctaaagccgttaaatcccggccatgctcatcaagggtgggagttctaacagctttcttctttgcttgtccaccggcctggccggaggttccgggaattgggccaccacttagcacctgggtaatttcagcccgtaccctttccaaatcagcaccgaggcttaccaaaactctggcggccaccccttctccttcccggattaaacccaaaagcaaatgttcagtaccaacatagttatggccaaaccgggccgcctcatctaccgatagttccaaaactctttttgcccttggggtaaaagcaatctccgccggcatcggcccttccccggggccaaccagttctaaaattttttcccgaactttctggccatcaataccaaggttttctaaaacttttgccgcaacactttctccttcatttataattcccaaaagcagatgttccgtagctacataaggataattcatttttcttgcttcttcctgagccattctaataactttttgggctctttgggtaaacttgtcaaacatcctctcactcctcctttaattactttttaatttttccctgataattttcgcccgttcccagtcccgttcagcaggatctaagggtctctgggccaaatttgtgagataagccggagctgtagctacaattaactcattaaatacactccgcttaatctccggaagtatctttaattccactcctaacctcacttttgatagtaagttcattgcctcatcggaagatatcatccgggcactagtcaaaataccgtatgaccgccacagttcatcctccaaagcatgccggttttcccggtataaagcttcccgtgccattcgctcctgatttattatttgccgggtaaccgaaataacattctcgataatttcctcctccgttaaaccaagggtaatctggttagatacctgatacaaatctccgcgggcttttgttccttcgccgtataatccccggaccgtaagtccaagtttggcagtattgtttaaaaggctgggaatttgattggtataggttaaacccgggaggtgcaacatagttgaagctcgaattcccgtaccggtattggtagggcaagcagttaagtaaccgtatttttcggagaaagcataaaacagcttttcttctaatttatcatcgaccatggtagcaatattatatgcttccctcagttccaatcccggcaagagaacctgtaagcgaatatggtcttcttcatttatcatcaaagctattcgctcatcttccgtacaggcaaaagcccgccggggatggccatcggcatggtcagggctaattaaatgtttttccaccagcacctgccgttcaataggcgctaacgtaactaatttaaaaaactcggtcttgccaaatttttgtttaaaccccctgctggtaacggccttttccacctcttttgtaacaaaacctgcggtttcttcgtccatcaaatggggaaacgggacatcttttaagttgcgggcaagtctgatacgacttgaaaccacgatatccgcatcagttccggtaccggccatccagggagaaaaactattggttaataaactcatttccccaccccctactctttaagagaagcttctaattcttttattttatcccgtaattccgccgctttttcaaactcttctttacttaccgcttcatttaaagctttttttaagttttcaatttcccgtagtatttttattttaccgccagtctttgctggaaatttgccacggtgttcggtacttccgtgtatttttcttaaagcttgttctactctgtctttaaaggtttcataacactggctgcatcccaagaaacctgaattaataaattggttttcggtaagtccgcagacaggacatcttttagtgacacctacatttcctccagaaatgccaaaatcccctaaaacatcatgccccataagtccttttaataagttttgaaaagttagttgaggtgaaaaattaaaagtatgacccaattcctgagcacattgagtacaaagattcatttccgttttttgcccatttattactctggtaatatgcatggtggctggattttgcccacagcgttcacataacatttaattcccctcctccgcattaagcactcccgctatcatactttttagaagaagtgctcttaattcatctcgatagggtaatggtacctgcaatactttacggtcaacagcaattgttaaaagcctcttttccctttcggtaatgcttccggcttcatataaagccttaataatttcccgggctttactttctgaaacggcatcaccaattgcctcaaatattctttgataaaatgcttcccggtcctggtcggcaatttttataatgcggatataaccgcccccaccacgtcggctttcaattaggtaaccatgttcgagagtaaaacgggttgctaaaacataatttatctgggaaggtacgcatcttaacttttcagcaagctcatttctttgaatttccaccacccggtcttcactttcttggattagttttttgatatactgctcaatcaaatcagcaagcgaaggcatcatccaccacctcgtctgactttgtttgacttttacttttatattagcataattggtgtattttgacaagggcttttaaattattttttcaaaaaaataaagcttttatcccggccgagataaaagcttcgattcatccaacatttccttgccataactaattttttatttttttattgatttatccctaccacttatcacctaataccaaccacataaaataaattggctcctcgagcaggattcgaacctgcaaccctccggttaacagccggatgctctaccgttgagctatcgaggagcgtttttaagtctatttaattttctacttctataagtaattttaaatactttttttcagcatttcaatagtttttttataccaaagtttttaagatcaaatatataaagattttaagattttttaccgaccacctaacacatacgacctaccactaaaaataaaatggctccccgagcaggattcgaacctgcaaccctccggttaacagccggatgctctaccgttgagctatcggggagtataaattttccggcagcgacctactctcccaggacctatcgtcccagtaccattggcgctggagggcttaactgccgtgttcggaatgggaacgggtgtttcccctccgctatggccaccggaaactttttttctgttccctcaaaactgcacagaggttgtttttttgaaggtcaagtcctcgacctattagtaccggtccgctcaaccgattgctcggcttacacgcccggcctatctaccggatcttctctccggggtcttactctggattgctccagatgggaaacctcatctcggggctggcttcgcgcttagatgctttcagcgcttatccattccgcacttggctacccagcggtgcccctggcgagacaactggttcaccagcggtgcgtccatcccggtcctctcgtactaaggacagcacccctcaagtttcctacgcccgcgatggatagggaccgaactgtctcacgacgttctgaacccagctcacgtaccgctttaatgggcgaacagcccaacccttgggacctacttcagccccaggatgcgatgagccgacatcgaggtgccaaaccccgccgtcgatgtggactcttgggcgggatcagcctgttatccccggggtagcttttatccgttgagcgatggcccttccactcggtaccaccggatcactaagcccgtgtttccacccagctcgacccgtcggtctcgctgtcaagcacccttatgcctttgcactcgccgcgcgatttccatccgcgctgagggtacctttgggcgcctccgttaccctttaggaggcgaccgccccagtcaaactgcccacctgacactgtccccacacccgttccagggcaccaggttagaacttcagtgtcgtaagggtggtatcccaccgccggctccacctgagctggcgcccaggtctctcagcctcccacctatcctgtacatacgccaccaaaattcaatgccaggctacagtaaagctccacggggtctttctgtcctatcgcgggtaacctgcatcttcacaggtactacaatttcaccgagcccctcgtcgagacagcgcccaagtcgttacgcctttcgtgcgggtcggaacttacccgacaaggaatttcgctaccttaggaccgttatagttacggccgccgtttactggggcttcggttcagagcttcgcctttcggctaacccttccccttaaccttccagcaccgggcaggcgtcagcccctatacttcagcttcccgctttagcagagacctgtgtttttggtaaacagtcgcttgggcctcttctctgcgaccccctcgggctccggtcgctcccaaccttcaccctaccggggcaccccttctcccgaagttacagggtcattttgccgagttccttaacgagggttctctcgcgcgcctgtggattctctcctcgcctacctgtgtcggtttgcggtacgggcaccctcgccctcggtagaggcttttctcggcagcttggattcggttgcttcggtactctatcttccctccccttcacctctcgggctttccgtgggacggatttgcctatcccacaccctaccggcttggacgcgcttttccagccgcgcgctcaacctatccttctgcgtcaccccttccctcaagcgggctcgggtggcaggggattctcaaccccttccccatcacctacgcctctcggcctcggcttaggtcccggcttaccctgggcggacgagccttccccaggaacccttaggcttccggcgggcaggattctcacctgccttctcgcttacttatgccggcattctcacttcctacctgtccacgtaacctcccggttacgcttcccccaggtaagaacgctcccctacccatactggaagtcggtacctccaactcccagcatgccgaagtttcggtggcgtgcttgagccccgctacattttcggcgcagagtcactcgactagtgagctattacgcactctttaaatgatggctgcttctaagccaacatcctagttgtcttcgcaactccacatccttccccacttagcacgccctttgggaccttaactgtcggtctgggctgttcccctctcgaccatgaagcttttcccccatggtctgactccctgcctctaagctacaggtattcggagtttaactgggttcggtaacccgtgaaggcccctagcccaatcagtgctctaccccctgtagccaccagcagaggctaggcctatacctatttcggggagaaccagctatctccgggttcgattggcatttcacccctacccacagctcatccgccgccttttcaacgacggtcggttcgggcctccagctggtcttacccagctttcaccctggccatgggtagatcacccggtttcgggtctgctgcacgcaacttccgccctcttcggactcgctttcgcttcggctccggcctccccagccttaacctcgctgcgtacagcaactcgccggcccgttctacaaaaagtacgccgtcaggctttcatcgccctccgactgcttgtaggcatacggtttcaggtcctatttcactcccctcccggggtgcttttcacctttccctcacggtactcgtcctctatcggtcgccagcgggtatttagccttggagggtggtcccccctgcttcccatagggttcctcgtgccccatggtactcaggctcgtacgctgcagctacgcgtaatttcggatacagggctttcaccttctatggcggagtttcccaactccttctcctattacgcttcactgccgggtacatggcagtgtacccacccgtacggcctcctaccccgcatacgcaacggctgccacctttcccacgtatgcggtttgggctcctcccctttcgctcgccgctactcagggaatctcttcttgatttcttctcctccgggtactaagatgtttcagttccccgggttccccccgtacacctatgtgttcagtgtacggtgaccggccattacgccggccgggttcccccattcggaaatccgcggatctacgctcgcttgcagctccccgcggcttttcgcagcttgccacgtccttcttcggcctctggcgccaaggcatccaccgtatgcccttactaacttgaccttctcctttttacccccaacctctgtgcagttttcaaagaacagctattaaatggtggagatgagcggactcgaaccgctgaccccctgcttgcaaggcaggtgctctcccagctgagctacacccccacactacatgtttttatattttaattttttatggtgggcctaagtggacttgaaccactgacctcacgcttatcaggcgtgcgctctaaccagctgagctataggcccatgttaataaattttatttacaaaacaacggcaagcggcttctctctccttagaaaggaggtgatccagccgcaccttccgatacggctaccttgttacgacttcaccccaatcaccggtcccaccttcggcagctccctccctttccgggttaggccactgacttcgggtgttaccggctttcgtggtgtgacgggcggtgtgtacaaggcccgggaacgtattcaccgcggcatgctgatccgcgattactagcaattccgacttcatgcaggcgagttgcagcctgcaatccgaactgagagcggctttttgggatttgctccaggtcgccccttcgcttccctttgtaccgcccattgtagcacgtgtgtagcccagggcataaaggccatgatgatttgacgtcatccccaccttcctccatcttatcgatggcagtccccttagagtgcccgtctttacgctggcaactaagggtaggggttgcgctcgttgcgggacttaacccaacatctcacgacacgagctgacgacaaccatgcagcacctgtctcgcggctcctacctttcggcaggcaccccggtgtttccaccaggttccgcggatgtcaagccctggtaaggttcttcgggttgcgtcgaattaaaccacatgctccactgcttgtgcgggcccccgtcaattcctttgagtttcaaccttgcggccgtactccccaggcggggtgcttattgggttacctccggcacggaacctctcaggccccacacctagcacccatcgtttacggccaggactacccgggtatctaatccggttcgctcccctggctttcgctcctcagcgtcaggttcagtccagagagccgccttcgccactggtgttcctcccgatatctacgcatttcaccgctacaccgggaattccactctcctctcctgccctcaagtccagcagtatcaggtgctcccccacggttgagccgtggccttttacacctgacttaccagaccgcctacgagctctttacgcccagtaattccggacaacgctcgccccctacgttttaccgcggctgctggcacgtagttagccggggcttcctcctccggtaccgtcatccactcacccttttcgaatgagtgaacttcgtcccggaagacaggggtttacaacccgaaggccttcttcccccacgcggcgtcgctccgtcaggctttcgcccattgcggaatatcccccactgctgcctcccgtaggagtctgggccgtgtctcagtcccagtgtggccggtcaccctctcaggccggctacccatcgtcgccttggtaggccattaccccaccaactagctaataggacgcgggcccatctgtaagcggtagcatgctaaagcctcagccaccctttcctatcaggcctctactcccgatagcgtatccggtattagccccggtttcccagggttatcccggtcttacaggtaggtcacccacgcgttactcacccgtccgccgctaaggaaacagctgagcaagctcaaccgcttcccccgctcgacttgcatgtgttaggcacgccgccagcgttcgtcctgagccaggatcaaaccctccatttatatccgtacaacccctcgcagggttataccccttggatagtttaatccttccttttatctgctctcgtactcttaccgagtacgggccgcttgccgttgttttgttttcaaagaacatgtcttgggattataatcttaacacagcttaattgctctgtcaagctttttctttttttgtcggcgcatcgccgacgtctaataatatagcataacctttttaccgaatcaagaccattttattaatttttttgttgtattttttggcaataatactaaattacaatattgtatttattttatccctggtttaaaacaggctgttaagtgtccgggttccacttctaatagttccggcgtctccttgcggcagcgttcgtccgcatactgacaccttgaagcaaaccggcatccttcgggtggattaattgggctcggaacatccccctttaagataattctctgacggcttgcttcaatccgaggatcggcaattggtacagctgaaagtagggctctggtatagggatgcaagggattttcgtaaagtcttctactttccgtaatttccacaatacggcctaaatacatgaccgcaattctatcgcttaaatatctaacggtggataagtcatgggaaataaataagtaagttaaaccaaattgctttcttaactcttctaacagattaattacctgcgcacgaatggaaacgtctaatgccgaagtcggttcatctaaaactataaattccggttttaccgccagtgctctggctatcccaattctctgcctctgtcccccggataattcatggggaaagcggttagcatgttcctcatttaatcccaccagttctaaaagctcaattacccggctgtttctttcctctccggtagccaaacgatggatgtcaattggttccgcaataatttcaccaatggtcatccggggatttagagatgcgtaagggtcctgaaatatcatctgaattttcctatgcaaaccgtatctctcttttttgctcatcttggcaatatcctggcctgcgtattcaatcgttccagcggttggttgataaagtccggctaatactcggccaagagttgttttaccacatcccgattctccaactaaccccaccgtttctccttttcgtatggctaaatttacccggtcaaccgcttttaatacctgaccatggcctaaattaaagtatttagaaagattttttgccactaagatattttctaccacttaatccaccgcctttgctgtaagctttttaacttcctcggcattaagccagcagctaacccggtgaccaggagaaacttcagtttccggtggttcgtacatagcacagattttcatggcatgttcgcagcgaggccaaaatgcacaacctttaggcggatttattaaatccggcggccgaccggtaatgggaaccaatggaactgaccggtcttggtctaaacgcggaaccgattttaaaagtccccaggtatagggatgtttcgcattgtaaaaaatttcttcggtatttccttcttccaccacttttccggcatacataaccacaactcgctcggaaaatccagctacaacacccaaatcgtgggttatgataataaccgacatatgcagtttattttgcagctcttttaaaagctccaaaatctgggcctgaatggtaacatctaaagctgtagtaggctcgtccgcgattaaaagctgtgggttgcaggcaagggctatggcaattaaaaccctctggcgcatcccaccggaaaactcatggggatattgctttaacctcttttccggctggttaattcctaccatctttaatagttcaatcatccgctcttttgctgcttcaccttttaatccctggtgaacccgcagtacctcacccagttgggttccaatggttaaagtgggatttaaggaagtcatggggtcttgcgagaccattccaatctctttaccccgtattttcgccatctgttcctgggttttggggaccaagtcctccccgttaaaaaggatttgcccgctgacaattttccccggaggtgtagggattaacttcattatcgtgtgggctgtaacagatttgccacaccccgattccccgacgatggcaacaacttcaccttttttgacactaaaggttacaccgcggacagcttggacatcgccggcaaaagttttaaagtttaccctgaggtcttttacttctaaaatgtttgccactttaaaacctcctatcttctggcccgcgggtctaaggcatctcttaacccgtcaccaacaaagttaaaagccagcatggttatactgataaagaacgccgggaaaaataattgccacggataaacttgaattgattcaagcccttcgcttgctaagctaccccaacttgccattggggctgaaacccctaaccctaaaaaactcaaccaggcttcagtaaaaatagcttctggaatcattaaggtcatggcaacaataatcggacccattgtattcggaattatgtgtctaactaaaattcgaagcgggcttgctcctaacaccttcgctgcaagaacaaattcttgttcttttaaagatagaacttgtcctcttactattctcgccatatttagccagtaaacagctcctaacgctacaaatattgtttttaatcctggcccaagcacaaccatcagtaaaattacataaagcaagaagggtatactcgaaaggatttcaactatcctcatcattacttcatctaattttcctccaaagtatcctgaaataccaccatacaataccccaataacaaaacaaattatggtagtaataacgccaattgttaaggatatccttgcaccataccatattctcgtaaacaaatctcgtcccaaataatcagtaccaaaataataattgctgtttggaggttgatttgcatcaattacactttgttcataataggtatgaccagaaatactaggaccaataatcgccataattataagtaacattattattgtaagacctaataccgcaagtttatttttcctaaaacttcttacaacatcttgccagtaagtagtttttggtcttgttattgcttcagcatttttttcttctgttcttatcttttctaccatttcttttgttatatccatttttcttactctcctttgcctaacttaattctaggatcaataaagccataagatatatcaactaataaattcataaatattaataatacactgtaaaaaatcgtaagacccataattaccgtgtaatcccgattcgtaatacttgtaacaaaatctctacctaatccggggataacaaatattttttcaataacaaagcttccggtaaaaatacccgcagccattggtcctaaatatgttacaacaggtaaaatagcatttttcagggcatgtttaaatatcactgttttttcacttaaaccttttgcccttgcagtttttatataatctttttctaactcttccagtagattcgcccgcaccattctagtaataaaagccattggtaaaaaggcaagtgaaatagacggaagtatagcatttgccggtgtttcccataatgctgctggtaaaagattcaatttaagagcaaaaatatacattaataacgtagctagaataaaacttggaactgaaaaaccaatagtagctattataacacttatataatccaaaatactattttttttcaatgctgaaattatgcccaaaagcactccaaatgtaactgcaattaataatgcaataaaccctaaagacgccgaaaccggaaaaccatctttaattatttcattaaccgttctaccttcatattttatcgaaaccccaagatcaccttttagtaaattgagcatataatattcatactgttttaataatggttgatctaaatgatattttgccattaaatttttctcaacctctggtgggagtttttttgcatccgtaaaaggtcctccaggtatggaatgcattaaaaaaaacgtaattgttgcaatcaaccaaactgcaataattccactaaaaattctttgtcttattatcgcaaacaaattaaacactcctttaaaaacaatagtagttttatattcaagtagtctatcataaaatcgaggtatgtgttaataacacatacctcgattctttaaaattctactctatataagcatttttaagatcaaccaaacttgtaggcaatactaatacgcccttaactttatctttaatttgaatatgaatatctctgaatgtgaggggtattataggtgcatcgtttattaaaatactttctgcttcatgtaatgctttaaagtgctcctcaaaactttttgcgttaatcgcttctctaatttttgcatcatagtttttattatcatagcccggtgtattgttgccattacctgtcatgaacatatcaaggaaagtcatagggtttacataatctgccgcccaagcataagcaacaatatgatacggcgatttaacaaaatttggatttgagagatactttccagctaaaaccttccattacataacttccagtttagtagaaatatttaaattctttctccattgttcttggagatattgagcaatttttttactagtttcccgatctgcagttaaataacgaagttctgggaatcctttaccatcaggatatcctgcttctgcaagtaatttctttgcttcttctacattatactcaattaaactgccacctttttctctaaagtctttgccatccggttccttaatcccaaacggaacaaaagcatatgccgccttttgtcgtggtaaaatcttcgttaagccctctctatcaatagccattgctaaagcttttctaacttttggattatttaatggagctagtttggtatttaaagcggcgaagtttgtatttaaaccagaaatttctttggcctttccttgagacatatactgttctaaaagagctggtggaattaagtctacagttaaatccaatttaccttgttcaaaaagagttgttgcagtttgctggtcagatacaaaattaaattctacttgttcaagtttaacatttttagcatcccaataattggggtttttaaccagtaccactttttccttcggcttatactccttatacataaaaggaccattacaaataatatttaaattatcctttacaagaaaatccggattctcttttaccgttttttcattgataggtaccaattggggcatagtcacaatactcaaaaagtttaaagagggagatacaagtttaactttaatcgtcttatcatttaccactgtaataccaactgcatctgctttagcctttccactattaaactcttttgctccttttattggtgctgaatcagttaatagataagcatatggtgcagctgtcttgggatctaatagtcttagccatgaaaattttacatccttagctgttaccggggtaccatcagaccattttgcatctctcaaataaaaagtatattctgttccatcaggagacacttcccatttttctgctaacgcaggaacaattttaccattagcatcaaacttcacgagagtttcaaaagtttggttaactacatccgcagcatataaatctgacattttgttagggtctaatgttgagccctcatcacctactgccaaaactaatttttgttctggcttctccccggttttgttctcctcggtcttcttcgcgcagccggtaaagaccaaagagaaactcaacactaccgctaaaagcgccagtaaaccgtttctttttctcaatgcacacaacctcctttaaatttttaatattttgcccccaggtaacagtattaatagttcgacaggctctcgtactttcctgccgaaattttgtgtatacaaaatattttattcataatatactctatattttcaaaattttcaatattaatacaaaaagcaaatttcccctctgcccccttttaatcccggggacgcatcaaagggaataaaataacatcccgaatcgaagcttggtcagttaaaagcataaccaaacggtcaataccgattcccagtcctccggcaggcggcattccgtactctaaagcagtgatataatcttcatccatcatgtgcgcttcttcatttccttttgcccgagcttctaactgttttaaaaagcgttctttttgatcaatggggtcgtttagttcggaaaaagcattggccatttcccgcccatagataaacagctcaaaccggtaagttaaatcaggattttccttctggcgtttagccaaaggtgatacttctactggataatcaatcacaaaagtcggattaataagggtaggttccaccttttcctcaaaaactgctgtaatgatttcaccccagcccatgccttcttccaccggaactcccagctctttggccttagcataggcttgaaccgggtctttaacaccggcaaaatccactccggtagcttcttcaattgcctttaacatgggaatccgcttccagggtctatgtaaattaattggtgtcccctggtaagttatctctaaggttcccagtaccttttcagcaacatgggttattaattcttcggtgatatccatcatatcatggtagtcggcataggcctgatataattctaacattgtaaactcgggattatgtttggtagaaataccttcatttctaaagtttctgttaatctcataaaccttctcaaagccaccaaccaaaaggcgctttaaatacaattccggggcaatacgtaagtataacttcatatctaaggcattgtggtgggtaataaacggccttgccgctgcccctccggcaataggatgcatcattggggtttccacttctaagaaacctttctggtccaaaaactcccgaatagtcttgacaatacggcttcttaagataaatgtttcccggacttcagggttgacaattaaatcaacgtagcgttgccggtagcgaagttccacatcggtaagcccatgccacttttccgggagtggtcttaaggatttggctaatatttcaaaactggagagccagacggtgatttcacccttttgagttttaaaaacatggccggtaacgccaatgatatcacctatatccagtttttcaaataatttataagcatcgatacctaattcgttctgtcgggcataaatttgaattttaccggacatatcctggatatgagcaaaagaagctttcccgtggccccttttagccataatgcgcccggctattttcaccgttttatcaaccaattgttcaaagttatcgagaatttctttagcagtatgggttcgctcaaacttgccgccgtacggttcaatacccattttccgtaactcagaaagtttttctaaccgcactttaacaagttcgtttagttcctggtgctccaacttggctcccccttattctaaaatatcgactatctcgtattttaaagtacccgcaggtactttcacctctaccacagttccttttttctttcctaaaatagcactcccaacgggcgattcgttggaaattttattggctgaaggatcagcttccgccgaccctacaagataatactcttctaccactccatattcgaggtcttttaaaaccacttttgagcccaaggtaaccacatctttttgctggtcattttcaataattttagcattccttaacattttttctaaagtaattatccgtccttcgataaaagcctgcgcatttttggcatcttcgtattcggagttttcacttatatccccaaattctattgcctgcttaatcctttcggccacttcccgccgtttaaccgatttcaactcttctaattcctgttctaattttttaagcccctctcgggttaagataacctctttttccttcatatttctctctccttcaagcttaataacttccataaattataccgaaagcactgctggtaacagcagtgcttcatttctttaaacgcagtttattataaaagaggaactaaagcttgtcaagaaattttaagtagcaaaaacagactttttcagagcattttttctaattttttctatttcttcggaagatattgctctctcaaagcttctaaagcctccaaccttaaaaccatgtttctgagccaacctgcttatttcttccaccttttctaattccatgtcccgccccaaagaaaagttttcaaagcgcccctctaaagttaaaatcatcgtctccgccatacaggcataagaagttttgggaggaaaaccaaagtttaagttaaactccacatctcccggaacttccaccactccaccctcaataactaaaacatcatcccgcagcttggctacctccttcgaaacatcccgggggcgtgaaacatcgcataccaccgctcccggttttaaatcttcgggctcgataatagtatccaccgaacttgtaacggttattactatgtctgcttcctttaaactttttttcacattatcggtaatggcaaccgccaaccccgattcttttaaaattaggtccgccaccggctcaagcttcgcaaggtttcgtcctactaaagtaagattttttacctcctttgccataaaacgcgctgctactttgcctatggaaccggccgctcctattaccaccacattggccttttttaaatcgtgtcccataatcgccgcagcttttttagttccttccagagcagtcgcaacggtgtaactgtttccggtagtcaccgcaatattgaggtttttcgccacagtaatccctgcatcacccactaccgaagtaaaagctccaaggccaacaattttggcccctaacttttccgcaacttttcccgcttcaattattttccccagaacaaactcttcgggtaattcaaccatctgccgggtagttagcggacaggtgataaaataaccttccacttcattatatggtgatttcaccccggttatgtgggaagctttaaaggccggcagtttttttaagccccattcaattagccgatccggaagatatttggcaaagccaaactttttggctacatccttggcttctaaaggatgtatgataaaagcaaatttgtccacctttacttacctccccgcaccgatttaattgcttcccttaaaacctctggatcaagataaacatcttcttcaatgggcgtatgcccaatagtaatcccaatcacttcccggtcaacaatcgcctgggctacctttactcgcatatccgaaccaatcatgatcaccgtatcaaactgctgcgccgccgcaattaattccattaaaaggtttaccagctccgccgcactcttcccctcaataaattcccagcgttctttatcggtcatcaataaggtaaaatctaccccttcttcttcacaaacctttttgagctcctctacatttttaagggggaagccaaagacggcaatttttgtacccttgcgtatttctccaatcccttccaatcttgaaataaatgtccgctctaaccccagaatattggctgtttcctgctgggaataaccctgcgagcgcagccttaaaatttcatccaccatccggtcaatcttatccctggaaataactttatccccaattctaacaattttcataaccgctaccccttaaaaactatctcataaaaaaagaaaaatatgtacacaattttgtgtacatattttaacacttttattctgtcaatgcaaccattttaatttttctccatcattaaaagtgcttctcttacttcctctggagttttcgcccggtttaatatttcccttaacctagaagcaccgggaagacctttaaaataccagcccccgtgctttctcatttcccgcactgctatgtactcgcctttaaattttaaaagatactcaaaatgccttaaagcaacttccgccttttcttggggcgaaggcttgggtaaaatttctccccgttcaagataaaaaacgatctgctgaataagccagggattgcccataaccgcccgccctatcatcacaaaatctactccagtaagttctaacatttcctttgccttctgaggagaatccacatccccattccccgcaacttttacttttaccgcctgcttaacccggcgaattatctcccagtccgcctttcccgaatagaattgttcccgggtgcgtccgtgaaccgtaatcagatcagcccctgccgcttccattctttgggcaaattcaatggcatttacagtattatcatcaaacccctttcttatttttaccgacaccggaacggaaacggcattttttaccgccataacaatcttttccgccaattctggctttaacattaaagccgcaccttcaccgttcttcacaattttgggagcagggcaacccatgttgatgtcaatcatgctggccccagcttcctcaactatacgggccgcttccgccattttttccggtgaactaccaaaaatctggactgccaccggcattgcttccccttgtaaatcaatcatctgccgggttttagagtttccgtgcagcaaagctaagtcgttaatcatttcggtaacggtaaggcctgcaccaaaactttggcaaataagccgaaaagctttatcggtaactcccgccattggtgctacaatcaccgggtttttaagcttaatttcccgcctggttgcgctcataaataagtctaataccctccagtgttaagttctgatctaccttctctatttgccgggaatcggttgcaataagttcagccaagccaccggtagcaataacttttgccgctccgcccagttcttttttcatccgggcacaaatctcatccacctggccgataaaaccgtaaattatgccggcctgcatcgccgaaacggtatttttaccgattacgctcaacggttttacaagctcaatccgcggcagtttagaagcccgagcaaagagcgcctcggtagaaattcctatccccgggctaatagcaccgccaatatactcacctttatcattaatagcatcaaaagtagtagcagttccaaaatcaactacgattaatgggccaccgtaaatatgataacccgccaccgcatttactatcctatccgcccctacttcccggggattttcaaacttaatttttaacccggttctcactccgggacctattactaaaggcttaactttaaaatagttataacacagctgctcaaaaatgggagttaacggcggtaccacagaagcaattccaattccctcaatatctttaaagctaaggtttataaaagaaaagaaattatgtattaaaaccgcatattcatcaacggtcttgtttctatccgctgccattctccaggttttgataagtttccccttatcgtaaatccctaaaactatattggtattaccaatatcaattgctaagaacatgctccccctcttttcttcttaagcttatttctcctgccgcaaaccgtttaacggtatttccatcgtttattattaaacttccgtcttctccaaggtcgtggagtacccctatatattcccggtcgccggtaattatcatcacttcttcccctaaaaaagccagtcgctttttatattccgtcaaactttgggcaaattctccctttttaaactcctcatacagtttctcaaatctttctaaaaacatagctaataagctttgccgggaaactcccggcagatgttctttcaaggcagtagcgggataggcaaagctactttttacctcttcatctaaaggttcgatatttatacctatgcccaccaccgcataaattgttctctccgcttccgcagctatttcggtaagtataccggcaaccttctgcccattaattaaaaggtcattgggccatttaatttgcacattaacccccagattttctaaggcttgagcaagggctaagccagctaacagcgttaacctgggaagctccacaggaggtaagctgggataaaggaccaaactaaaatacaatccctgtcccggaggcgaattccagctgcgcccaagcctgccgcggccagcggtctgaccgttagccgacaccaaaaagccttcaggaaccttattggcggccagctccttggcccggtcgtttgttgaacctattaaatcgtgatattccccggtatgccccaaatagcgggttttaaggaacggttttaataaataatacgccggtatgtcaggataacgctccagcttgtaacccttcctgggatgggcggttatctcatacccttcccgtttaagctccttgatatgcttccagatagccgtccttgtcactccaagtttttgagaaatttcttcaccggatacataatcctgacttttaactaacatggagataatttcctctttcattggccggtctcctttaaactttttaaatcaaggcttatatccaaagctttgaccgaatgagtaagggttcccagagaaattacgtcaattcccgcccgggcatactccaaaatattttcttcatttattcctccggaagcttccaataaaactttatctccggcaattttccttgcttcttttaccctttggggagacatgttgtcaagcattactatatccgctcccgccgcaatagcttcttttaaaccttcaaggctttccacttctatttctatttttaacgtatggggagcatacttccgcgctcttttaatcgcttcttctattcctcccgcagccttaatatgattatcttttaataaaatcccatcactcaagttaaaccggtggttatggcctccacccacccgcacggcatatttagaaagccagcgaagaccgggaacggttttccgggtatccactaccctaaccgggtaatccttcaccttgttaatgatccggcgggttttggtagcaattcccgataaaaactgcaggtaatttaaagctacccgttcacccattaaaattaccgccgccgggccataaattttggcaataacctgtcccgaagcaacttcttccccatcttttaccatatactcaacgcgcacgttgcccgaaagaacccggtaaatttcctccagcacaaaaagcccggcaaccaccccgggctctttgacctttacaaatcccacagtatgctcatcaccaaccgcaatcgcttcagtagtaatatctcccattccgatatcttcctcaagagcaaggcggatatgttcccgtacgtaaaaaggtagcaccttatcacctcgataaaacaatgtgtttctgccagagaaaatcatccctttggggataatcggaacgaaaatgcgctccccggctttcctcccggattaaagcagccagagcaattaaaatagctgtttggtataaatttgcagccaccgcttcttcaatatttttcaccggataagaaagtttgagtttacgtaaattttccaatagcacccttaatccctgtccgttacgaataattccggcattctcccacatcaaatctttaatctgggcaatagcttccctggctccaataccttccctattttccccctggtaaattgagatctccggataattaatccgggtagattttaaaatatttttcgttcgttcaactatccggtaaccaaaaaccagcccatctaaaagggaattggaagccagacggttagctccgtgtaccccctggcacgctacttcaccgcaggcataaagccgggctaaatccgtttccccccaaatgttggtcctcaccccacccataaagtaatgggcagccggtaaaaccggtatcaaatcttttctggggtctaaaccgttttcctttaaagtttttactattcgcggtattccggccaattgttcgtcggtaaagcttctgatatccaaatatacctggcctttttgcgcctggtcccaaatggcccgggccaccacatcccgcggtgcaaggtcagcaagctcatggtagtttttcatgaaatactcgccggcagcgtttaccagccttgccccttccccgcgcaccgcttcactgatcagaaacttctgccgtccgggcaaatttaaagcggtcggatgaaactggaaaaattccatgtccataactcccgctcccgcccggtaggccatggctattccgtcaccggtagccacatccggattggtggtctcccggaatacttgcccagcaccaccggtagccaatatcgtaaacttacttaaaaataaacgtaaatttccattttcatcccaagctagagcacccaagcattcccggtcctcggtaattaaatctaaggcaaagtgattctccatcacccggatattagaatgattttttacggctgcagataaaaccctttgaatttcttctccggtagtatcgccccggtacagaattctccggcggcggtgggcaccttccatcctcagggccaatttaccatctttgcggttaaaatcagcccctaactccaccaggtggtggaccctctcgatgccatcctccaccaaaactcttaccgcttccggattgcacagtcctgctcccgctgcaatcgtatcctgataatgaagttccggtgagtcttcttcggtatctaccgctgccgcaattccaccctgggccaaatcggtattggtatcccctaaatttttcttggttaagacgattacctcaccgtagcgggcagcatttaaagcagcataaagcccagcaattccgctaccgattaccaggtaatcggatttataaaccggaacgccggataaatcaaagtcaattaaataccggcgcaacttcttctccccctaaccaatagccaacattctctctaaagcctgaagagcttttttagcaatttccggatcaacctcaatttgcggctccagagtttccaaggctaattttactttttcgatagtagtaagcttcatattaggacaaattagtttctttgaagcaagataacactttttatgaggagccttttttgttaactgatgcataatacccgcttccgttccgataataaattcatccccagggtcatttaccacgtagtttataataccggtagtgctaaatacaccatcggctaaagccaccacctccgggcggcactcgggatgaaccaatactttagcattaggatgctcggcttttgcctgccgaatatcatcgggagtaagcctttgatgggtgttgcaatagccgtcccacaatattaacttgcgccccgttttcttagccacgtaatcacctaaattgcggtccggagtaaaaataatttccctctccggaggaatgctttctatgacttttaccgcatttgccgaagtacaaataatgtcactttcagccttaacttcggctgaagaattaacataggtaaccacaatagccccgggatgttcagctttcttttttcttaaactttccgcggtaatggtatcggctaaaggacatcccgcttcaatttccggaagcaaaacgattttatccggtgaaaggattttggcactttcagccataaaatgaacaccggcaaaaacaataacttcagcatcggtattagctgcagttcgggcaagccccagagaatcaccaacgtaatcggctacttcctgaacttcgggacgttgatagaggtgggcaaggataatagcatttttttctttcttaagtctcaccacctcatccataatcttttgggttttttcatcaaacattcgtttcactcctattctgtttggccatgaatctctttttcttttattttaactattttattgtattcatcaacaaaaactactttgggttgccattgttttgcttctttttcttccattaacgcatacgcaataataataaccttatcccctatctggcaaagtctggccgccgccccgtttaaacttataattccgctacccctcggtccgggtatagtataagtttccagccgagccccgttatttatgtttaccacctgtactttttcgttgggtaaaattccggaagcatctaacagctcttcatcaatggtaatgctacccacataatttaaattagcttcggtaacggtagcccggtgaattttccccttcatcatggtcaaaaacactttaatctacctccagaataaaattatctatcaaacgggtactaccaatataaactgccagagctattataaatttacctttaattacatccatggcttttaaatcgggaaccgaacgtacctctacataatcaattcgcgctaaaggttctgtttttataaattcctctataagtttttttaacctttcggggttcctctcccccgccaggaccagctcctccccgcgctttaaagctcgatacaaaatagtggcagcttttcgttcttcgggatttaaataagtattccttgaactcattgccagtccatcttcttcccgtcgggtaggaacactgacaatttccacattaagatttaagtcccggactaatttttctatgataaaaagctgctgggcatctttctggccaaaaaaagctaaatccggagtcacaatattaaacagcttagtaactacggtagcaacacctttaaagtgtcctggccgagatttaccgcacattacttccgtaatctcgccatttacttctacaaaagtcgaaaagccttctttatacatctcttctgctgaaggggcaaagacacaatctaccccctcttcctgcaatagggctaaatcccgctctaaatcccgggggtatttagcaaaatcttcattgggaccgaattgcaaaggatttacaaatatcgatacaattactacatccgcttgcaactttgctttgcggactaaagaaaggtgaccgtcatgcaaataacccatagttggcacaaatccgataatttttccttcccgcttttgttcggcaacgtaggttttaagaggttttatttccgtaaaaaaacgcacattattccctcctcactacggcaactaatagattctttctaatatctccggagccatggtaaaactgtgtttttcttccgggaattgttgctccttcacttcctgcacatattgtcttattgcttctttaattaagcttgaaagatcggcatatctttttacaaacttaggtaacatccggggatacatccccaaaacatcgtggtaaaccagaacctgtccatcgcagtttactcccgagccaattcctattgttggaattggtatgctttcggttatttttgccgctaaagccgccggcacgcattccaaaactatggcaaatgcccccgcatctgccaaagctttagcatcatccaaaagtttttgggcagtctttaagtccttaccttgaactttataacccccaagggcattaaccgactggggagttaggccaatatgtcccattaccggtattcctgcagttacaagcttcgccaccagttcagctatttcaccgcccccttcaagttttaccgcctgagctcctccttcttttaaaaagcggccggcattataaagggcatcggtgtaacttgcctgataagacatgaaaggcatgtctgcaactaccatgctccttttgctcccccgtaccaccgccttgacgtgatggagcatctcctccatggtaacggggacagtactgtcgtaacccaaaaccaccatccctaacgaatcccctactaaaagcacttccgcgccagcttcctcggcaaagagggcggaaggataatcataagccgttatcatggcaatcttctgacccgcttctttcatctcttttaaactgctaacggtaaccctatccattagatttttccccctcaaaaagttttaaaatctcctgtcctttttccggattataatcttcgcgcttttgggccatttccaaagtgtgcctacccagaaccaggtaaaattcccttagtttcggatattcccgcaatttctccaagtgctgttctatggttaccgtatctccccgggcaatagggccggttaatgcatttaccgtgccatacttttcaatattatttagcgttcccaaaattaaaggttttaatgctctataaccctcttcccgagcaattcccgaaatttctaaaagctctaaagctatatcaataagggtaacgaggtaattggaagccactaccgctccggcgtgatacaagcttttttgattttcttttaggtaaagcaccttggctcctaacacccgcaccaaataagcccctaattcaactccttccggatccccttccaaagaaaaataagcctcgggcatgacctgtcgacccatctccggagaagctatggcctgaagaggatgcatggtaaaagtaatcccgcctttttcctttatagggcttaaaattttgtaacactgggagccgctggtatgagcaaaatactttccctttaaattgggaattttagcaatttcccgagcaacccgggctatttctcgatcgggagtggtgataaaaataagttccgactccgcaaccaaactttccaggtcccggtaaacaaagctgtttatttttaaagcaagcttctcagcagaagatagacttttactgtaaaccccactgatattaaaccctttttcgcgcaggagtaaacttaatgctcccccaactcgccctgccccgataattccaatggaattaatcataaaatccccctctgttgggttgtgataaaaaaagccttccgaacggaaggcctttgttttaactcccgtctcggtcctctggatccaagcggtcatattgattttttaaaaaataaatcgactctgtaggacccataacggtgtcctcaaggttataataacaagaccaagaaatctttacaataaattttcctacaggaagataaaataattttttcacaaatttttgaatttttttatgccttgctcctgccttaatttttcagcaatactttttaaaactaccccatttatctccgcctcgggccagagctccagaaggggtagcactacaaaagccctttcggtgatgcggggatgaggcagggttagtttctcctcctgcctcttttccccttcataccacaaaaggtccaaatcgataacccgcgggccataacgtatgcttcttaccctacccattttattttctatttgtaaaagagcttccaacaaactttctggcgtaagagcagtttctatttcgcataccgtatttaaaaaccagtcctgctcagcgtatccccagggctccgtttcgtataaagctgcaactttattaatcctagtatcgggaagggatttaatttcctttaaagcagtttttatattttcttctttttttcccaggttagtaccgattccaatatatgctaaagccacgctatctgcccctttttacttccacataaacatcggaaagtttctgcctcaaaggtgccccaggtttgtgaacccgcaccattacttcttttatcaaagaaaatttgtttaaaattccccctgctacttcttccgccagagcttcgattaaatcaaagcggttttttgtaacaatctcctcggtgaaatctaaaacttctttatagctaacggttttacttaaatcatcgctgcgccccgcatcccttaaatcaataccaagctcaaggtcaagaatgaatttttgccccaaagctttttcttccggtaaaactccgtgaaaagcataaaattcaacaccttttatgacaatcttatccatcttttcacctaccgtaccatggcatcggtcattttagcaacccgcaccatttctttcacatcgtgaacccgcacgatatctacacctttagctattcccaaagttacggtagcagccgtcccttccacccgttcgttcaccggcaaatccagagttttaccaatcattgacttccgcgaagtacccaataaaatcggctggccaaggctatttagttcgtttaagcgcttcattaataaaagattgtgctctaacgttttgccaaaaccaattcccggatcaataataatcttttcccgcggtatccctgctttaacaccgatcttaatactttctttcaagaaagctatgacctctgccattaaatcatcgtactcggcctcggttttattgtgcatcactaccaccggtgccccatagcgagctgctacttcagccattcggggatctttttgtagcccccatacatcattaatgatatgagctcccgcttccaaagctttttccgccacctctgctttgtaagtatccaccgaaatgggaacatttatttcccgcaccaaagcttccactaccggcaatacccggcgcagttcctcttccgccggaacatattccgctcccggccgggttgattccccgccgacatcgataatatccgctccctcggcaaccatttgccgcgctcgctttaccgccgcttcaatatcgttgtactgtccaccatccgaaaaggaatcgggagtcacatttaaaatccccataatgagggttctctcgccaagggtaatttttcggccccggcaatccagttcgtattttggccgtccatttaaattttttaaaacttcttcaatttcttccgccagactctttaggccaaagggctgcatttttaacttgggtattacctgccgccatactttttcggtagcaaaacacaaaacatcggttgtgggagcagttaaatccaaactcccccaggaagtagcacaatcccctcctttggccagaagctcctgttttaaaatattggcagctttcgtcgaaagctctttaactttaatacatcttaaaacccctttaggggccatcaaatttaccccagccaaagtactaccgatcaaagaaatttccttttttacctcatcaatattggaaaactccattgaccataagatatgctccatagcataaacccccattaataaaacttctcctggtgaagtaataacatttcttcttttttgtggcatttatctataaccctacaggtaagacacggccgggaaagcttatcggcaaggtataataaacgggtaaaaccttccgagtcttgttcccggtgaccccttattgcttccgttatcaggaaaatttcctcttgaacaaactcctgatacttttctaatatctcccgggcaacttcagccccaaccagcgcgtgatttaaaccgtaaagatactcttctaccctccctaaatcgtggagaagggcagtaagatagataagttcccttggaaaggaaaatttattttcaaaacacaaaatagttaaaattcttgccacatctaaaaagtgctggaagtcgtgcctgcaaaactcccggtctttctccaaataatttatctctttaaaacgcctaaccacttcttcatccctataaacccgccagaatctctgcataggttaccccaaactttctttaactataataaggaaaaagggggatttctccccctttagcccccttagaataagccggtaattttaccgtcagcatcgatatcaatgacctctgctgccggtcgtttgggaagcccaggcatagtcatgatatcgccggtaatggccacgataaagcctgcccccaccgaagcccgcagctcccgcaccgtaatgttaaagccggtcggtcttccaagtttgttcgggtcatcggataacgagtactgggttttggccataattaccggcatattgccaaagcccatttcttcaaacttggccaaggtcttttccgcatctgcggtaaagacaaccccatcggcaccgtaaatttcccgggcaatggtttcaatcttctgcttaatcggcatttctaaatcgtagaggtaacggaaattggctggtttttcttcaatcactttaagcaccttttgagctaattcgattccaccttcaccgcccttggcccaaacttccgataaagcaaactcagcaccggtagcttcaatgagctcccggagcttgttgagctcggcatcggtgtcggtggggaagcggttaatggcaactaccgccggtaaaccaaacttaccgatattttcaatgtgcttttctaaattagcaaaacctttttctaatgcttcaagattttctttattgagttcggcccgcggtacaccaccgttgtattttaaggcccgaaccgttgcaacgataactactgccgaaggtttaaatccggcaaaccggcaaacaacgttgaagaacttttcagcgccaaggtcagcaccgaaacctgcttcggttaccaggtaatcggcaagttttaaagcaatcttatcggccaaaatagagttagtaccatgagcgatattagcaaacggaccaccatgcacaaaagccggggtgtgttctaaggtttgcactaaattaggtttaattgcatctttcattaaaacagtcattgcgccagcggctttcaaatctctggcataaaccggcttttggtcgtatgtatatccaattaaaatccggttaaatctttcttttaagtccatgaggtcggaagctaagcaaaggatagccataatttcggaagcaacggtaatatcaaagcccgtttcccggggtaccccttgagccggaccgccaagaccgattactaccttgcgaagagcccggtcgtttaagtctaccacccggcgccaaacaactctcctggggtcaatccccaattcgtttccttgatggatgtggttatcaatcatcgctgctaaaaggttatgcgctgtagtaattgcgtgcaggtccccggtaaaatggaggttaatatcttccatcggcacgacctgagcataaccaccaccggcggcaccaccctttaccccaaagcttgggcctaaggatggttcccgtaaagcaataacagttttctttcctaagcgggacaaagcatcccccaggccaacggttgttgtagtttttccttccccggcgggtgtcgggttaattgccgttaccaaaattaatttgccgtccggacggtccttgatcctgtcccaaacgtgagctgcaatttttgctttgtacttaccatacagttcaatgtcatcttcggtgagccctaacttttccgctatttttactatgggctctaattttgcctcctgggcaatttcgatatcacttttcatatcctttcccttcctttcccttaaatttcttttatatttaacctttactaaactattttgagcatcaatataatagattattctcttcttcgagccaaattcctgcttatattttgaaatttttaaattttcctaaaaggattgtaggaactttcattaactttatttttccttcaatatcccttttatttttctctggaacttaccttttctaaaaatttctcaatgttcacccgtaccctttcatgccgtccttcccctattttcccctgctcatcaaaagcttccaccaaaaacgtaagctttcgcccttcaacggaaatcaatttggctttagcttcaaccaaagcaccgacgggcgatgcttttatgtgagaaacctcaatttttgtccccacggtagtttctcccggagataacgcaacagcaacagcatttaccgccgctttttccatcaaagctaccatcattggagtggcaaaaacttctaaacttccactccccactgccttggccgttttttccagggaaacggtagttttagccgtcccttccaggccttcggtaaggctttccgccatcctatcaccccacttttccacgtgtttattattttattctttccttcctttaaatttcctcttcctatttttaatccttaaaaaaaatattgttaagattaagtaaattaagctgtatactgcattggtatacaaacctctttatatgcgctttttgtcacaataaacaaaaaaatattttctcatattttcgccattttcttaattttcacaagataaaaacttctaaatttgtcgaaaaaattaaatttttgtagcaggacttgtgtaaattgtcacgaatgtatataatagaaattgaaaagttaagaaaaacttttcattctccccctgcatatttttactccatccccccaaaaattaataatgaaattttccggatgaaggttgtgggagagacccgtaatcgggcgccgaaggagcaagggcaaccgaaactctcaggcaaaaggaccgcaaccggacggaactctggagagtccgcaaactgcggcaccgaaggagaaacccgtagccttgggcacgggaatctctcaggttgtaaggacagaggccggaaagttattcggcctctgtttttcttttaggaggaatttttcatgctggtgattacaaataatccgaaagtcaaagactatattcaaagatttactttagaaccccgctttacgattatctgggtggatggatataccgaagatgtgttagcaaaagtgcgtgatctctgccatttaggttataaacttttaacccatcccttgaccggcagcattaagccaaaccaaacaccttataaaaccgtagttttagaaaagctcgagcaagaatccgattacgattccatcctaacggctgaaattagctatttaaaaaccaaagagctattagaaaaacggtctcgtcccaaggaaatcgagctctttctggaagattttgctgtaatagacctggatttttttaaaagtttcctttacagcatgggtcttattacataagtttataactttaatttataacttttccctttaaaaggaggaatatcgtatggaaagatacgatgtaatcatcatcggcgccggtcctgctggactttccgcagctctttacagcgcccggagtaagctttccaccctttatattgaaaagctttccaccggcggacaggctgccactaccgatgaaattgaaaattatccgggatttgcccatgggatttccggcccggaacttaccgcccaaatggaggaacaagcaaagcgttttggtgccaaaaaacttttggccgaagtaaaggggattgagcttgcgggggctgaccggatcgtcaaaaccaccaaaggtaactttgttgcgaaagtggtaattatcgcttccggtgctgcacctaaacttcttggctgtccgggagagcaagaattcagatcccggggggtttcctactgtgctacctgtgacgccgctttttacgaaggcgccaacgtcatggtcgtagggggtggcgattcagcggttgaggaagcctgttaccttaccaagtttgctgataaggtaacccttgtccatcgccgcgataccttgagagccaccaaagttctccaggaaagggcttttgccaacgaaaagctggaaatcctttggaacaccgtggtggaagaaattatcggcaccgacgttgtggaaaaagtgcgcttaaaaaacgtggtcaccggtgaagtttttgaaagggaaattgacggaatctttatctatgttggccttaagcccaataccgagtttgtcaaaggcttagtaaacctggacgaacaggggtacattattaccgatgaaaacatgcgcaccaacattcccggaatctacgccgccggcgatgtccggcaaaaactgttacggcaggtagtaactgccgctgctgacggtgctattgctgcttaccatgcggaaaaatatcttgaagaatgtaccgagtaaaggaggtgataaacatggcgggaaacataattgagctaaacaaagacaattttgaagaagaagttttaaaaagcgagcttccggttctggtggacttctggggtccccggtgcgtaccctgcatgggtttaatgccggtagtagaagaattggccgaaatctatgcgggtaaaatgaagtttaccaaattaaacactgccgaaaaccggaggcttgccattcagcttaaagttatgagccttcctactttccagttttataaaaacggcgaacttgtagaccagctacaaggtaattttggccgcgaagaaattgaagaaaaaattcgggccattatcggctaaggagggataaaatgcggcttacccttgggaaaattaacattaaagggctggaatttggccccagtacccgggtcgaaaacggagttctttacgttaataaagacgaattaacagccttattgaaagaggataaccggattagctccgttgaggttttcttagcccgcccgggcgaatcggtacgaattgtaccggtaaaagacgtcattgaaccccgggtgaaggtggaaggcccaggaaatattttccccggttttctcggtaaagtagaaatggtgggcagcggccggacccacgttttaaaaggtgctgctgtggtcactaccggaaagattgtaggattccaggaaggaattattgacatgaccggtcctggagccgagtatactcctttttccaaaacctataacgttgtagttaaaatcgaaccggtagatggattaagtcaacatgaacacgaaagtgtggtccggttagccggacttaaagcagcggcctaccttggggaagctggtaaaaacattacccccgatgaagaggtaacttatgaagttgctccgctcttagaagccgcttcaaagtaccccggacttccaaaagtagcttatgtttacatgctccaaactcagggtttactgcacgatacttacgtttacggggtagatgccaagcgtattttacccaccctcatctcccctaccgaagtatttgacggcgctatagttagcggtaactgtgtttcggcctgtgacaaaaacactacttacgtgcacatgaataaccctgtaattgaagaattatttgcccgtcacggcacggatataaactttgttggcgttattatcaccaacgaaaacgttaccttagccgataaagaacgttcctccagctacaccgctaaacttgctgaaatgcttggaattgacgctgcaatcgtttccgaagaaggcttcggtaaccctgatgccgacctggttatgaactgccggaagttagagcaaaaaggtatcaaaaccgtccttatcaccgacgaatacgccggtagagacggcagctcgcaatcgctggccgacaccactccagaagccaatgccgtggttaccgccggtaacgccaacgaaaccattgtgctgcccaagttagatactgtcattggccatgtgggagttgtcgatgttattgccggaggttttgccgggtcactacggcccgatggcagcatcgaagtggaaattcaagcaataaccggcgctacctcggaagttggcttcaataaactatccgcaaaaggatattaacgacagcccactaaacaccgtgattgctgtccctactataaaaacgaaaggaggagtttagtatggcaattttggccggtaaaaaagttattgctgtaggtgaccgtgacggtgtccccggtcccgctatagcagagtgtgccaagagtgccggagcggaagtagtatttgccactaccgagtgttttgtctgaactgctgccggcaccatggacctgcaaaaccaggcccgtattaaggaacttgctgaagaactcggcggtgaaaatatcgttgtccttttaggtgcagccgaaccggacaccgcatcactggcagcagaaaccgtaactctgggcgatcctactttcgcaggtccattagctggagtctcgttgggactcaaggtttatcacattttggaacccgaaattaaggctgaaattgacccggccgtttatgaagagcaggcagccatgatggaaatggttttagatgttgatgccttagccgccgaagtatccaaaatgagaaaagagggaagcaaatattagtccttgcttggcaaaggaggtaattttgtggctaaattccgtgtagtccattatttaaaccagtttttcggtcaaataggcggcgaagaaaaagcagatactgctcccctgaaaaaagacggtcccgtaggccctggtaccgctttaaatggtgcttttaaaggagaagcggaagttgtcggtaccgttatctgcggtgatagctattttgccgaaaacatggaagaagcccttaagcaaattctatcaatgatcaaggaatataatcctgacctggtggtcgccggtcccgcttttaacgccggccgttacggtaccgcctgcggggcggttgccgaagcggtagtaaaaaatcttggcatccctgcggtaaccggcatgtacccggaaaacccaggtgtagaaatgtataaaaaatccgtttacatcatagctaccgccgattcggccatcggtatgcgcaatgccatccccaaaatggccgctctgggtcttaagctcttaaagaaagaagaaatcggtactcccgaacaggaaggctacattgcccggggaattcggaaaaattactttgcggaagaaagaggagccaagcgggcagtagacatgcttatcgccaaaatcaagggagaaaattttactaccgaacttcctatgcctgcttttgaccgggttccccctaatcccgccataaaagaccttagcaaagccaccatagctctggtaacttccggcggtattgttcccaagggcaatcccgaccggattgaatcgtcgtcagcttcaaagttcggtaaatactctatcgctggcgtaaaagacttaaccagcgatacctttgagaccgcccatggcggctatgatccggtttacgccaatcaagacgccgacagagttttaccggttgacgttttaagggaaatggaagcggaaggtaaaattggcaaactgcacgattactactatgctaccgttggtaacggtacttctgtggccaatgctgctaaattcggtcaggccattgctgccgatttaaaagcttccggagtagatgcggtcattcttacctccacctgaggtacctgcactcgctgcggtgcagcgatggtcaaggagattgaacgggccggtattcccgtagttcacatgtgcaccatcgttcccatcagtaaaaccgttggtgctaaccgaattgtaccaaccgttgctattcctcaccccctcggcaatcctgcccttccggcggatgaggaaaaagctttaagaagaaaactcgtggaaaaagcattaaaggctcttaccaccgaagtggaagggcaaacggtatttgactaaaaaatcccgggagcaggtcataagcctgctccccaaaatttagaaagcaagcccattatccgggcttaagatacaaaaacaattttgacaaacggaggttataattatgccggtcttaaaaggtgttggccagtgcctcattcatgcccctgaccttttgtaccacaacggaaccacccagacggttgaaaggctaaaaaaccctgactctgaatacctgaaaaaacttcccgaacatttgcggaagtatgacgatgctgtagcttacgccccaaaccaagcatacatcggtaatatcggtcttgaagagttaaaaaccattccccgcccctggtacacaaactccattaatggagcttcccgttttggcaagtacggtgaaataatgcccgaagacgaattttacggactcttaaaaatagccgacgcctttgacctcgttatcctggaagaaagttttcaggaagaggtcaaggaaaaacttgccaaacataagctaataaacgaacaactgcttgcccgccttacaaacgccaaacccccgggggaaattgaaaagttggtaacctcccacacagcggaaggtttatacctcggggaaaaattagtaggttgcgtgcggcaggcccatgaaattgacgaaaacttatcggcccatattatgttagaaaaccttgtggtaaaagcatcgggcattttagcagtcctccatcttttagccaataccggaattaatcctgaggaagtagattacattatcgaatgttccgaagaagcctgcggtgacatgaaccaaagaggtggcggtaactttgctaaagctattggtgaaattgccggtttggtaaacgccaacggctccgacgtgcgcggcttttgtgccggtcctgcccatgcccttttacatgctgcatccctggtaaaatccggtacctttaaaaacgttgtagttgtaggtggcggtgccgttgccaaactcggaatgaacggcaaagaccacgtcaataaaggaatgccggttttagaagacatgctgggagcttttgcgatactggtctcggaaaacgatggccttaacccaatcatccgcctggatgttattggcaaacacaatattggtagcggcgcttctccgcaacaggtaatgaaagccctggtggccgaacctcttgccaaacttggccggaaaatcaccgaaattgattactattcggtagaaatgcaaaacccggaacttaccgaaccggccggcgccggcaacgtaccggaagctaattacaagatgatcggtgctttggcggttatggcaggagaaatcggccgggccgatatccacaagttcgtggaaaaacacggattacccggctttgctcccactcaaggtcacattccttccggagttccggcccttgggttctttagggatgctctcttggaaggcaaaatttcttcggccatggttattggcaaggggagtctgttcctggcccggatgaccaacctgtttgacggtttatcgcttttaattgagaagaaccccggtaaggtggaggaaactaccggccttacaaaagaagccgttcgggaaatggttgccgagtacttaagggaaatggccaaaggccttctttcctaagggggtacaaataaatggagcaggtaaaaagattaattgcggaagtgttaaatgaagcagcggatgttattgccaccggacgggctcttaaaaacatccgggtaggtatcacccttctgggcagtgaacacggtgtgcttgaagtgttaaaaggtgccgagatggccgcccaaaaccttcctaacgttgaagtcgtagtaattggtccggaagatgtcgaaaccaggctcactaaagtcgttgtcaccgatgaaaaagaaggccaccgggtaatggaaaagatgttagactccggtgaattaaatgcggccgttaccatgcattacaacttccctatcggcacctctactgtaggtttggtagtaacccccgctcagggccggaaaatgtttattgccactaccaccggtacctcttcccccgaccgggtggaaggaatggttaaaaacgctatttacggcattgccgctgccaaagcttacggaattaaaaatcctaaagttggtatcttaaatgttgacggcgcccggcaggtagaaagaattttaaaagaactccaaagtcgcggctacccaattgattttagcgaatcaaagcgttccgacggcggtgtagtaatgcggggtaacgacttacttgccggtactcccgacgtcatgatttgcgatagcttaaccggcaacctcttaattaaaatcttctccgcctacaccaccggtggaagttacgaggctttaggctacggctacggtccgggaattggagaaggctttaacaaaataattaatatcatttcccgggcctcgggcgccccggtaattgccggtgctattgaatacgccgccgccatggcccagggtagacttgtagaagttgcacaggcagaaatcgcagctgctaaaaacgcagggcttcttgaattggtaaaacctttagagaaaaaagaaacagtcgaagaagtaaaaatgcccccgaaaaaaccggtagacaaagaaattgccggaattgatgttttagaattggaaaatgcccagaagcttttatggaaacacggtatttatgccgaaaccggcatgggttgcaccggtcccattattcttgtagctccggacgacttaagtcaggcccttaaagtcttaaaggaaaataaagtattgtagggtccggtttagaggtttgaggttggcagtaaaacccctgcaggcataagatgcagtcttaagcccgccctacattaaacaaaaagccgcagaggttttggcctctgcggctttcttcttactcctccattttaataaaattttcccaggactgaaaataattttttaaaatctcatcggccatttcattaccataatactcggataacatgtgcaccgtcgattctcggttgatgaggccctgcttaaagctatccatcaggttatgcacccggtcgtcataatccataaaaccgcctcccgttttttttattttttccggaaagggagggtttttattactttttccgggaaaacagccgcattaaaaagccttcttttaattccaccgcattggccgggcagagttcctggcagcaataacagcgaatacacttattataatccactatcgcccgtcgattctcaatcttaacggctttaggcggacaatgacgggcacagcgaccacaaccgacacaccgttcgttcattaccggccgggcggtaaactggttttgaaagaagcgaactaaaaaagccggaatccttccgtccaaagactcgatgttgttaggcggcgcaaaattaaacgttaaacctttcccgctgccggtaacttctatttcctttaacggcaccactaccccccagtttaaagctactctggctaccggcattttttccgcctcaaatcccatcatttgcgtcatcaccatatccaccgcaaagccgctatctccaccgataataacccctgcttttttaggattcccgtttcggggtccatttccttccatccccactaccccatcgataatgaaaaacaccggttttattaaaagagccaagtcgcagagcatggccgcaaaatcatcccttttttgcattcgtaaatgatattgtgccttggtagtcgcaacattaaacccaaataaattttttatgcccccggttatccccataaacgagtgggttttcattttagctaccgatataaccttatccacttcggaaagttccctggccagagaaaacctttttacggtacgcccttcaggatgcggataatctttagcctcggcaaaaggtaataactctgccccttcttcctggcacacccgggcaatgccacaccgggcggctacccgttcggtattaccggtccccggcgaatcccccaccagcggaatagccccggctttttttaccatacgaactaccgcccgcaccacttccggatgggtcgtcaccgccctttccggcggaagcccttccagcatattgggcttaatcaagacccgctccccgggcttaataaacgtctcgattccaccaaactctgaaaacacttctgctactgccgcttctacctccgcatagttataactactacattttgccgcacaaactttcatcccttttcctcccaagtataattttggggacagtccctaatttaatacttcaagcctttggccccttcttttattcttctttaattatacagttatctttttcccgctttaaagttaaatcctgcaacaaagccaaaaaaagaccggggattaacccggtcttatttgttttaaacaggttgaacgtaatcgcaaatgtcctggcttatcagcttagctacaagctcattatttcttaaaagatttataaaaagttgcttttgcttctcgtgggcagtgcttttcgtcaaaacaaaggataaaggccttctaatcggtgcttccagtatacttagtttcttaaacattttcaaatcacaatcccgccgcactgtaagctcggaaattatggttacacctaagcctgctgctacaacttccttgatagcctgcgtactgctaaattccatggtaacgtttaagtcattaagatcaagccccagttcctttaaggctatttccagcacctttctcgttcccgaaccttcttcccgtaaaattatccgttctttcaacaattccgctaccggcagtctttctttactgccccagatatgatgataaggcactacaactactaactcgtcttcccaaaacttttctactttaagctcctcatcgtcaattgttccctcaatgagtccaatatcaatagttttttccaccaattcatgataaatggtatcggtattggcaatcttcacccgcatttcaatctcaggatacagtttataaaaatacgctaaaagcttgggtaggacatattccccaatagtcagcgtagctccgatgtaaagttttcctttactttctcccccggcatctcgagccaactcgtatgcttcgtggattttatcaataatatcctgaactttctggtaaaaaatctctccagcttttgtaagacgtactcctttattcgaccgctcaaacagctttactcctacttcattttccagggattgaatttgcaggctaattgccggctgactcatgtgcaatcttttcgccgccgtggaaatatttttggtttcagctaccactttaaaaattacaagctgcgagtgaagcattaaaacccccaccttttacccggaagtttttagctgcgttaacaaaattctcggaccatttggggtatgttaacacgtgaaaatgggtgtaagcagcaaacacatttttatagcaaaagccatcctgacctttagtgatcccctgacctttatgaagcttaagaccaaaggttaattcctcagttaaatttagcctggaataatgaaactcatgtccttttaggcaatatcctaccggaaaatacggattttccctgacaatttccccttcggtataaccatgcccctggggcttaggggtcatctggcattccgccggaattacgccggccatataatattcgctcccgttatacttaattttatcgcataaatacataagaccgccgcactcggcataaatcggcatccccaattgcgcatatttttttacctgagttaataatttccggttccgggcaagttcttctaaataaagttccggaaacccgcctccaatatataacccacctaactcttcgggtaactcatcataaaaaggatttataaaaactatttcagcccctgctttctccagcatctctaaattttcaggataataaaagcaaaacgcttcatttttaaaaaccccaatttttacttcgcctcttcccaatggctttggccctactgttacaatgtttttactggctaaactaataatcggctctaaatcaatatgctcctctaccatccgggaaagataatctaacaggtcattagaggtcttaacttctccagaagtgataagcccaaggtgccgttccactattgcccctttttccccaattttgggcatataacctaaaattctaaccggacagtaaccggcaaatacctcttctaaaagcttaatctgacggcggcttcccactttattaaaaattacgccaaaaacttttaaatcccggtcaaactccattaaaccttttaccaccgcagccaaggttctggtggttctggtagcatctaccaccagtaataccggtaaatttaataactttgccagctcggcggtgctatttgttcccagggcatcaacaccatcaaaaatccccatatttccttccacaaccgaaagcatagcagtttttgcataatacctgtaatggttaaccacttcctcccggctgtgtaaaaaaaggtccagatttcggctctgctctcctgcagccaaagtatgccagcccgggtcaatatagtccggaccttttttaaacggctgaaccttaattcctctccgcgaaagggcccgtaaaattcccagggtcaaagtggtttttccgcttcttccacttgccgctgctacaactataccatttggattcattttttctcccatcctttaaaaagggtaaatgagggccgcatattagcagccctcacttttagagtttgctccagtaatcgcctaaaatgtgcaccgagaaagtataacccagtaaaacgttaacaataacacctataacaaatgccgccagcggtttccatccaaaagacgatagttctctaaacctcgtagtaaagccaatactcaagaagcaaaatacaaaggcccaggtacgtaatgtttttatgggttttattaccaagggtgttaatacttctttcgatacttgaggtgttaaactcgcatcaacaatactaattaagatagtagctataaagaatccaataacaaatttagggaatcgtacccatacttccttagccgaaacggatgcaccctcagcgcgcttttcccatttggttgctgccaccacagctaaaattaaacaccagatcccaatccaaatgtcacggccaattaccttcattaatgtgaacgctttaatggcagcctcatcacctattgcagaagccgctgcaagaccagcagcatcagcaaattcggaagaaccaatccatgccccggcctgccccggtgggagtcctaaagccttacaaacaaacggaagaaggaagatcataatcactgcaaaaatagttaccagagcaatagaaatggaaacatgttcttttttggcattaacagcaccacctacagcaattgaagcagaaactccacaaatcgaaccaccggcacctaatgttgcgccaaagggtttttctaagccaaagagacgggtagcagcaaagaaaatggtcaaaaaagtagtcaccgatataacagtggcctgtaaaagagcgatgggaccagctttaacaattaaggtaaagggtaaagttgcaccaagtaatacaatacctgttttaatgtaaaactcggttctaaagctagtatcaagccattttggaagtttaaatacattactgactattaaacccaataaaagtgccaacagcggaggttcaagattatattgctcagcaactttagacgaaccaagcaccaaaactataaccgtaagcaagtatataattgtgaaacctttaataaactcgccaacattaaatcccataaacttaacactgatgctaaatagtacaaggaacattaaataaagatacacgtaaatcataccgttttcggcaaagtgtttagttacttccgaaaacgattcccatttaggtggcgctacagcaattggcttaattgaaagccccattttgtacaaaattagcgccaccaaaacaataccaattccaaggtataccgcccaccagtcttcctttttgaggaattcagagccttgcttgttgctcatcattgacctcccccttttcgtcataaatttttcttatagccttattgtctgaatcccttgactctcgcgccttcaaacccctcctttcttgttgtttgtggttactttcacattttaagattttttataaagcattagggaaaccctaatgctttataacgccccttttaccaaactcaaaaccaaagaagtaacggctgaagaaaaagtagataaaatgggtaattttactaaagggcaggtagaaaaacattaaccctgttacgaaataaaaccagttttgcccctggaaatttaaaacatagccgaaggctccagcaatgaataacgttaccagtaaaactgaaagataatcatcgggggtatttaacttctgcatttccgatttcgttaaccgctcaaaaatcccaacaatgccagccaagaggcccgctccggtcagcactaccaatatatccctgacaagaccggcaaactctacttcaaatacagataggataagggtgacaaaggaagcaaagattccaagatgaaagattaccccccgcaaataagatatagcatgtttgcgggtactttctttggcccagggagccattcctaaggtatatgcgtataaaactccataggaactatccccccggggacgggctaaatcccgggggggattggcctttaaaagcccggccattttaacaataatgcccgctaccgttacaaaaaacgccaccagcaaaaaagttttcatttacacgcaccccgtaggtttaggcagaccagcaattttgcaagcccctttagcaggaccggatgggaacagttcgtaaatctctttcaggctaaacccggtatctttgcaaagctttctgatcatcggagcgatttggtactgaagataatagttgcggatgtagttaaccactttccagtgagcttcggtaagctccgtaaccccctcggtcttcgctaaagccttagctatctcctcattccaaattgaagggtcttcaatgaaaccatcctcatccacatttaaaaccaacccatcaatttcaatttgcggcatatttacctacctccttaaaaaatttttttataagataatagcttttccaaccaaatccataagcccggacatttccacaggcagattatagtactcaaaaaccaatggcaattgagctttgcagatggaacagggagccactacatagtccgctccggtcttttttacctgctcggccttgactttcccaagcttcatccgggtttccaaaatttcttccatcaatagccccgacccagcaccgcagcagaaattttcctcccggttaggagtcatttctacaaaatttttaactacatggcgcagaataaagcgcggttcttcaataatatcccctgctcgggctaaattacaggggtcatggtaagtgtaaactatatcgccatttctctccggatcaacttttattattcctttagcaattaagtacgccgcttcttcgtgaatatggcgaatttccacatcaacgggaccgtttagcccatcggtatacatccgggctgcccgccagccatgaccacattcaccctgaacaatctttttagctttcaattttttggcgcaatctaaaagccggcgattgtgttctttcatcactttttcatcaaagaaaaggccaaagttggcagcttcaattatttcactgggaatggtccacttaataccggctgcatgatacatcttggccacaccaatcatcgtgttggtattgacgaaaaagtccgctgaggaaggcacatacatgacatccgcttcttcatctacgggtatgcggatttttatacccgtctcttcgtacatttcttcttcaaggaattcacaactatctaacagggccggtttggtaatccccatgttgttgccggtattggccatatttttgacaataccgacagtaaatcgtggcaccattccgagctctgctaatatttgcctgaccatgatggtaacttcggccgtatcgattccaaaggggcaaactaaagcgcaacgccggcactggttgcactggtaaaaatatgtaaaccatttttccaaaagttcggcacttattccaatgcctccggccacttttcctaaaacccctgatagtggcattacttcctgcttataaacacttcggactaaatcggctcgtttggtcggtatattataaggatcctccgttcccagatacgagtggcaggcatttatacacgcaccgcatttggtgcaacattccatagcgagtttaaacattcgactttcggcggctttttcgcgaattaaggctaccgctttgcgcactttttcctcatcgtccaaaatgcgatatggcagcggggcgaggtcttttgctttctgcggggcattcattatatgcttccccctttctaaagccttaaaagctttgccttgccatcaccggttaacgtaattgctttatttattaacccgcccgctaagtgtaaaagcttagaaaacggaaggtacatcaataagatttgtccaaagaaataatgaaggacaaaagcatcaggaagctcataattaattggccttaaactaaataaatccgcaaaatatttcttcacggtagaaagttctaccggtgccaaagtccgcatcgcatttccggtggtgacaattaccaaaattaaaagtaaatcaatgtaatcccaggggtcggaaacctgtttaatctggccggagagccgcctaagaagaagggctaatgcacccaaaaaggccagagtacctgccagcatcccaaaagcaaaggacagcttttcgctctgttccggagttgcaccaaacagcgtaaactggtgcccggcaaaggctattccggctatatgcccgataactatcaagaatatccccaggtgaaatccgtaagacatcacccaaagcgggcgctcaaaccgatacagggttttaaagaataggatttctttcagaatttcaccaccgggcgtatcgggtaccggaaaaaggtttaattgatacttcacttttgaggcataccaacctcttatccggtagataagcccaaacaccagtattaaaaatgttagataaggaagtacgccaacaacaaaatgtttcaagggttcttccccctattatagttcttgaatggtaacggccccggttgggcaggaagtagtgcaggtttcacaacccatacactccgagggatccgaaactaattccaccttatcgccttttaattcgaacaatcttgccggacaagcttcggcacaggtcccgcaaccggtgcatttatccagatctaaattaaccatgtacatcgctttcactccctttgtagttatttgttttctgccccgggcaataccagagcattagcaacgatttccgataaagcagtgatattcacgggcattttataatgctttttaaggtcttgaagctgtaccaaacagttgtggcatggtgccactacttctttagcttcggtagccagtatttggtctgcctttggtttacccgccgctatcctggatttggcataatcggtcatggccagcatcccaccgccaccaccgcagcaaaggttttcaacacctgaagggctcatttctctaaaatcacttacagccctcgccaggatttctcttggctctttataaatgccaccgtttctggctaaattacacgggtcatggtaggtcaccggcttgttattgcgcgaaggatcaagttttatgcggccggacgtgacgtattcatggattaattccaccacatgccttacttcaaaggggaatttttcgcccagccagttttcagcttcccagcgcatagccctaaagccatgcccacattcggtcatcgccagcactttcaccccgagctctacagtggcatcccttaacctttgggcatgaagtcttgccaagtcgtcttccccggaaaataatgctaaattggttgcatcaaacattttgctggaaacggtccaatcctcgccggcagcatagaagatttttgccagagcaataaaggaaagaggataaaccttaacttccaggggtatcgtcatgtataacacccgggcaccttttttatccaccgggatttttgctttggagtccccaacttcgtcctgaagttgttcttccagccactctatcgtttctaaaaactcctcccgggtaacccccatgttattccccgattcaatggttaaatccactccagcctttaaactggccggaaccatattaattgctgccagcatggcccgggccgttctgacaattaacccggtatctatacccatgggacagttaatggtacaccgccggcacatggtacagctaccaaaggcaatatcctttaactcccgggcgtactcctcatcaaaatcccgagctcctacaaggccgggaaacaattttcccgtcggcgtaaaatacctccggtagatttttctaagtttttccgctttataagccggcgtatgaacgggatcctgggtagccctatagtagtggcaactatccttgcagatgccacagtgagcacacacttccaggctggcaattaattttttatttaatctgcttttaagaaactccaccgctttttgggtactcatcgctttacccctttaatctcgagcatttttttcttttttcaatttaaccgtaacacttactgctttctgtgtaaaattcgcgttttttatttcactatttgcaatttaaattgctgcttctaatatcttttctaaaatgccatcaactccaggccgtttagcctcaagaatctcaaagtcaccatattttttaatctccgccgttgtgcttagccccatcgaaaccatttttatttccgctaacctctctcgcttttcgtccgttaagctttcaaaaaaattatttactgctgccgggcttacaaaggtaataaaatcaattttccgaccatcaattaactcaaaaagatggtctgcctcaacctttgccctgacagccttgtacaccggtaggtactttaccggtaaacgctcctcacggagttttaattctaaaattgtagccttttcgcttttgggaaagagaattttttccccatcttgaaggcgcccggcaatgaattttaccacttcacggggcaaaaaccggtcagttttatgggctacatttatccctgaattttccaaagctttcttagttttttctccgatagcaattatttcgggcaaagcatctattgatagctccaaacactttaaacggttcaaaaaaaactccacaccgtttggacttgtaaataagatatacttgtattcattaagcctctggagttcccggtctacttcccggtagctctcgggttttaaatattccacctggggcaaatgccaaacttcagctccaagttcttttaaccggcaagccaaaagtttaccggagttactgctttgagtaaccagtatgcgcttgcccattagccttttcgtttcaaaccagttaagctgctcccggagcttaaccgtctcccccaccacaataattaccggatgctttaagtcggcctttcttaccttttcctcaatatcctgaagacacccggttaccgtcctttgttccgctcgggtcccaagcctgattacggcaacaggggtttggggcgagcggccatacttcagcaaattggctacaatttgcggcagatttttcctccccattaaaaagaccaatgtatccgcagctaaagctactttttcccagttaatttgactttcttttttggtcgggtcctcgttaccggttattacgcaaaaggaagccgctacttcccggtgggttaccggaatccctgcatacgccggaacggcaatagccgaagttattcccggaaccacctcaaaaggaatcccgtgccgggtaagctccaatgcttcttcgccaccacgcccgaaaacgaagggatctcccccttttaacctcaccaccgttttccccgctaacgctttttccaccaaaagcttgttaatctcttcctgcaaatactcgtgacgttcaggagcttttccggcatagataagttcggcatcttttcgggcataggttaagagtaccgggtttaccaagcggtcgtaaactatcacatccgcttttttgattagatttaaacctttaacggtaatcaaatccggatctcccgggccggcacccacgaggtacacaaaaccaggcatagacttcatcctttgcttaatttcttagggccgcccagggcgggcggcccagggcaggggagaaaaggggagtaatgttatgtttttagcttgatataagaagtcccaagataaagaaactcaattttatcttccttggccaattcggtaactgctttatctacttctcctttggaaacacctaaagcttgagccacttctttgtttttggccttatcgaccgtttttaagtaatcaatgattttttgttttaactcttccaccctaccgacccccttaccagttaaactgagtagtggttctaaaggtggtcggcgcaaagataaagtcatcaatatgtttttccgtaaatggaagacccgtcagtttaaagaaccgctcccagccaatccgctcaatccattcgccatatctttcacccggcagagcattttcagcatatacttctaaaaggtgctttactgcctccaccgtctccgtccaccggggcggattgttgggaagatacggtattgccagccgggaaaacttaggagcggtccgggcgttggaaaccttaccgcccacaaaaatggctaccccgtcgttttccggatcggcaattggcatggccggacaaacggtatagcagttgccgcagtacatacacttatccggattcacttccaccgattttagcttgggatttggcttaatggcaccggtcggacagctctgaataaccgagggaatctcacaaaccttatgcagcttttcgtgatcgattctcggcggtttgcggtgaataccaacgatagcaatatccgaacagtgcacggccccgcacatattaagacagcaggccacagcaatccggaccatgttgggaagcttgttttccacaaagtaatcgtaaagcccatccattaaactttttaccaggccggaagcgtcggtagccgcagaatgacagtgcacccagccctgagtatgcacaatgttggaaaccgagtgtccggtacctcctaccggcaagcctcttcgggcaagctcctccaaaagcggctccaccatttccttatcatccagtaaaaactcaatattatggcgactggtaaagcgcaaatgccctttgctgtatttatcggcaatttcgcaaatttcccggataaaatcaatgctggcaagtcttggcgaccctacccgaaccgtatacagctcggccccggtttccgaaacatgctttaaaaccccgggacgaatttgttcgtggtacagccacttgccataattttctttaataatatcaggaataagcgtactgtagtggggaggtccaaaatcagtcctcgccattttacttcacctcctctgggtaccagaagtagtaggggttagcacgaggagctgtaaccatttgcggcaccggtttaattccggtatcccgtaagaacttcggcatacccagacggtaaatggtttcgccaatccgctcccgggtcttgccgttttcatcccaccaatcggtaatggtccggataaaatccttaagttcggtataaggcggtttcatttccataaacggtatgataacccaggacataaatgccgacttaacaatcggagccttggcacctatgagtaatgtggcaccgccttctttgccaacccttaatgcccggggcatttcgttaatacaatgcatgcagcgggtgcaggactcattatcgataacaatttcccgggtttcagcattgtatttcaccgcttttttcgggcatttatccacgaccattccctgaatgtcaaaaccggcctcggcatatgcttttacttcctcctgatttacccggatttcatccctccaggtaccaattaccgagagatcagcccgggcaatagaagctacgcaatcgttggggcagccggcaatcttgatcttaaacttatagggccacatcggccggtgaagctcattttgaaactccatggtaatctcatggcaaacatcaagggtatcgaagcaagcaaactcgcaacgggccggaccaacgcaacagctcggcgttcttaggtccgaaccggaacctcccaggtcaaagccggcttctgccagttcatcaaagcaagcctgcagtttatcggtgtcggtacccaggagaattgcatcaccggtcgaaccatggaagttagttaaaccgctgccatatttttcccagatatcgcaaagtttccgcaatgcttcggtagtgtaaaaccaaccggctggctggtttacccgaatagtgtgaaattccgctgcatcgggaaactgctccggaacatcggagtaacggccaataactccgccaccgtaaccttttacccccacaattccgccgtgtttccagtgaactttcttttcccgataagaaagctcaagctgtcctaacagcgcttcggcttttttgtttttggccgcagcttttttaatttccttgacaaagctgggccaacgcccctcctctaactggtccaaaagaggagtctttttttcctcgttggccattaattcggcacctcctgcttgtgataatattctcatgtgttctctactaaaatcataatttttctaacattttcggtcaattaggtttattatttgataaacttatggcgttattttaatttattaatttttactctatttttctctttaaatccccttccacatttcaaaatcatcctaaacatcccggtttttcccgcttttatttgtgatatcggtaactatctataaaaaaaataaataccgctatttgtgatatttataattttagggacagtccctaaagttatccttaaagtatggtaaaagggactgtccctactttattacttccgtaattcttcttctcttaattgccgccgcagaatcttacctacagcagtcttgggaagttcctctctaaattcaactttcttcggcaccttataagccgcaagtctttccttacaaaaagctattatttcctcagcggtagcggtctctccatcctttaacaccacaaaagcttttaccgtttctccccggtattcatcgggaacgccaactactaccgcttccttaattttgggatgctcaaacaacacttcttcaacttcccggggataaatgttatagccgctggcaataatcatatcttttttccggtcaacgatataaaaatatccatcctcatccatacgggcaatatcaccggtgtaaagccagccgtcttttaacacccgggccgtctcctcgggcatattccagtaacctttcattacctgcgggcctttaactgccagctctccaatttcaccaatcggaagttcccgttcgtaattttcggggtccacaattttagcttcggtatccgggaagggaagcccaatagaccctacttttcttttaccccctaaaggattacagtgggtaaccggcgatgcttcggacaatccgtagccttcgaccagatggccgccggtaagctcctcaaactttaaagcaacctccaccggaaggggagcagaaccggatatgcactctttaatgctgtctatcccgtagcttccggcattgggataattgttgatagcaatatacatcgttggaacaccggggaaaacggtcggccggtattttttaatggtattcattacttcatttatttcaaagcgaggtaaaagcaccagcgttcctgcatttataagggaaaagttcatggccacactcatgccgtaagagtggaaaaagggtaaaactcctaacactacttccttgccaaattcacaggaagtcatccaggccgtaacctgcatggggtttgccaagatgttacggtgggttaaaattgcccctttagcaattcctgtggtaccaccggtatactgcaataccgccgggtcattaagatagtcaatgggaggatactccacagtataacctgccgccgattttacataagcttcaaaatccaccgcatcatcaggaacatcataagggctaaaatcaaataatataattttttctaaattcgtctggttttgcaccgcctttatccgggggtaaaggttacgcattgccacaataactttagccccggaatcgtttaaaatgtgcaaaagttccctttccacgtacatcgggtttacctgaactaaaatagctccaattttttgaaccgcaagataagtaatcacatactgcggagtgttgggagacattaaagccacgcggtcaccctttttcactccatcccgggcaagagctgctgccaaaagatcggtgtaaagctttaactccccgtaagtaatctctttctggtaaaaaattagcgctttgtgattcggcattttagccgcaatttcatcaactatttgggctatcgtcttatcagggtaatttaaagaatgcggtaccccttcttcataagacttaagccagataggttctcccatcccttttctcctcctttttacttttctctctttttttaatatttcgaatttttgtattgttcgataaatattataacgcatccccctccaatatttaacccatcaactgaatgaacgctcatttttttatcgacatgaatcgacttctaaaatcccaaaaaataaaaaaccgggaaatctcccggtaataacaatcaccttttctcccgtaaaaccatccgcttgccgcagcacgcaagctgcccttttccactctccaaaatttccacttattaccgcaaatctcacataaatacatcgttttaatttaccacactaaataagtggcaataccaatggccaaaagttcttgtttatcattatacacctctacttcaccaactacaaccctgtttcccgtacttactctccgggcacgagccacaatatcgccgccaaggccgggttttaagtaatttactttcagttcaatagtcgccgttttttgtccctcggtcatttgcgccaccaccatcgcacctaccgccgcatcaataattgaagcaaaaacacccccatgtaccactccaaaagtttgaaagtggtgcggttttaaactaatctttaattccgcttcctggggcgttaccttcaccggttccatccccataaagctccaaaaagtgtcgtcccgcaaaagttttaacaaatctccctgcattttccccctcttttctctatttttttgctaacctaaaattcgccgctgaacttaattcaccttcttgactattccgatttttttacttataattaaattgaaaatgattttcaatttcaaggaggtttttctatggttaaaagattttctttaatagtcgttattgttaccctgcttacttttgtctttacctttccctcttttgccgaaaaccctatcggagagtaccaaaatctcttaaaaagcctttatcaagaagccaaagaaggtgaatggggggaggctcaggaacttgcttctaaactccaaactttttttgaaaacgaggaaaaagaaattaaagaattaagcccaaaactttatgaagaatcggaagaatatttgccaaaaattatcaagtacgcttctaaaaaagacttcgaagagctttccgagtactatgagaaattaacaggagcttttccctccagtgaaaagaaagaaggttttgccggtctttttgatagcgctttgataattctcagggaaggatttgaagcttttctaatcataggcgcgctctgggcgtttttgcaaaaagccggacaggaaaaccttaaaggaagtcttatcctgggtgcagttacaggagtagccggtagcattgctgttgcttttttcctcctatccgctgccggtaaagctctacctccagcggcattagaaggtttatcctcgattattgcagcagctcttcttttttatgtaagtttctggcttctttccaaagcaagcacccacaggtgggaagagttcattaaaaataccgcaaaccaggctttaatcaggaaaagctactggtcctttttcggcgtctcatttttggcggtatttcgggagggttttgaaactgtattattttacaccgctctctaccaccaggtaagcccctcaggcttctggagcgggcttatttccggtgcccttggtcttgtagtattagtttttgccatcgttaagctcggggtaaagataccccttcgtccctttttcctggctaccggaatcctcctctattatctaaccattaaatttgccggttacggcgttcatgagctggcagaaataggctggatttcggaaaccaagctgggtaattttagcttaagcttgcttggtttttaccccactttagaaaatttaattgttcagggaattctgttagtaataggtatttatggaattggtaaaatcttaaccaatcccccacaagccacttaaataattttgaaaggcggccaatgccgccttttttctttgcaaaggtgaaatttaaagaaatttttagcaataattcattttttagttttaaccattatttttggcgcttttctcttatttttgactatttttgacttttgcatattggtcaggaaaggtcaataattataggtgaaaggtcaaggaaagttaaaataaaatataaaaaagatacccggaggtggttggtatgctcatgagatttgatcccttcaaagaaatctttgatttaaatcgctggtttgccgaagcctttactccaattaacagaagcctttctctaccaagagttgacatcttagataacggagatgagcttttagttaaagcagagcttccaggtattgaagataagaaccaaatcgaactctacgtccaaaacgattatttaatcattaaaggtcaggttcaggatgaaaccgaagccaaaaccgacagatactatcgcaaagaaagattcaccggtagctttgaaagggtagtttacctgccggtggaagtggaacctgccaaagccactgctgaatataaaaacggcattttaaacatcaagcttaaaaaagcccaaggtaacccccagggatttaaagtagatatcaactaatcccccctccctccttccccgaagatttaccgcttcggggttttttctttttaaaaaatatgttttaatagtaatgttggacgggagggagaatatttgaattataattataacaaaattcgttatgcgattgcttttggccatttctggatagatttttacgccaacgtcttagcttctaccatgtaccttttagcccgggacttacacttaagccttacccgccagggaattctggtagcggttgtttcgtttgccggttcggtcatgcaaccgtacctgggttatctggtggataaaaaaggaaaaagcacccatctcttattcagccttttgctaatgggattacttactaccgccaccggactgtttcaaaatttttatcccgttttaatcctttttaccctcggcgccttaggctcagccctttatcaccccttagggtctgtgcttacaaccagcatcagcgaaaagaaaaacaccgctgtttctttttacgtcacctggggaaatatcggctactccatagccccggtaattctggtgccggtggtagaagctttgggacgaaaagggcttttacttttttctctgcctatgtttttagcactaatattcctctatttatcaaaaagccaccagctaccccttccccacgaagagcgtaaagaaactctaccctcctttcgggccacgattaaaagcgcctttaccggccttctgcttttaaacttaatcgtttggggccgtgcctggatccaggtagcccttggcaactattccattcagtatttcctgcatcaggggctttcggccaaccagagcagtatccttctttcggcttatcttttggccggaacagcaggggtggtagcgggtggttttgtaagtgaaaagcacggagaaaggtttaccctgcttgctactttccttttgtccggagctacgttaataatgatgtttttcactccaccacctttttcttatcttggcatgcttataaccggctttcttttaaacatgtccttcccggccaccatcgttatggggcaaaacttaatcccggaaaacgccggaatggtttccgggatgatgatggggctggcttttggtcttggcggtatgggtgctatgcttaccggtacggtggctgattataccagtcttgctttttctttaaaactgttggtggtgattccctttattatctccgctttaacgttagtttattttcaaaaaatttccctgcctaaacccaaaataaaataatttttgacatatttagatttttcctgtatatttaagttaaatttatttttttggaggttttgcgatttgcgcaagtttaagattttcaccgatagtaccctggatttacccgaagaaattttaaacgaagagggaattgagattattcctctttccgttcattttcccgacggcaagagctatcttgatcgcctggaaatttccgctaaagagtttttagccaggatgaaagaatacgtcgaattacctaaaaccagtcaaccatccccccatcactttttagaagcttttaaaaatgccgtacaccaattggaaaacgtcggcgaggtagtttttttaggggtttcgtcccggctttccggaacctttcaaactgctaaaatggctgcagaaatggtcagcaaaaaaatcaccgttattgattcaaaaactgggtccctgggacttgggattttagccttaaaggttgcggaatggttaaaagaagggataaaccgggaagaacttttacaccggatagaaaaatttaaagaagagcatcggctcttttttaccgtggaaaccatggaaaacctggtcaaaggcgggcggatttcccggatgaaagaaaaggtagctaattttttaaatataaaacctatctttcaccggacacctgaaggcgaaatagctcatttagaaaatgtccgggggcgaaaaagagccatccagagactaattgagcttgccgaacaacatgggaaagattttgaacaaaaaattgtcggtataactcacgccggcgctttggaagaggcgcttttgttgaaggaaaaacttctggaacggttaaagccgaaaaaaattatcctttccgaattaagtccagcactggccacccatggcggagaaggtactttactggtgacttattaaaaataaggggacggttcagagcagcaaaatggatgctttaagaaccgtcccttccgtttactgtatttctatgcggcgggcccggggattgtttttgccggattttttcatccgcacctctaaaatgccgttttggtaagaagcccgggcatgatccggttcaacttccgccggtaaagcgatagttcttgaaaatttgccgtaataacgttcactccggtaaaaccgctcttgctttctctcccgttcatcccggatctcgcctcttaaggtaaggctttccggctccacgattacttcaaggtcttctttggcatttagtcccggtatttccgcccgaacaactacgtctgccccttcttcaaaaatttccacccgcgggctaaagagtcttgcagggttaaagggttccaaaaaatctccccgttcaaaaaaccgttccatctggtttttaaaatttaacatttcccgccagggatcaaaaggtataagcattttctcacctccatttaattagcatggaggcttttttattttttatacgaaattaatttaaaggcaccaccgcaccattgtatttttcattgataaacttcttgatttcttcggactttaaagcttccgacagttttttaatttcttcgcgattttcatcgcctttgcgcacagccaaaacgttgccaaaagtctcggccgcttccgaattggcatcttcggcaattaacgcatctttaggagtaagcttagcttcctgggcatagttgccgttaatcaccgctccatcaaggtcatccagggaccgcggcagctgggctgcttctaattccaccacttccactttcttggaagttatatcctttaccgttgctttgatccccacacccggttttaaggtaataagccctgctttttccaagagagccaaagcccgcccaccgttggtaggatcgttcggaataccaattttggctcccggtttaaactcgtcaatactctttacctttttggaataaagccccatcggctcaaaatggacttttaccgtccaggtaaggttaagcccccggtctttattaaattgctctaaatacgggacgtgctgaaaatagttggcatccagctctttttccgccaaagcgatattgggctttacatagtcggtaaactcgataatctccagtttgatgccttccttttctaaaatcggctgcacctgccgtaaaatttccgcgtgaggtaccggggtcgccccaacttttaaaactttttcggtagctttttggcttccgcagccaaaaaggcccagagttaaaattagcactaaggctaccaaaacttttttcattttaactcctcctccttaattattttgttttatatttacgggccaaaaaattgcccgtagcctgcacaatctccaccagagctaccaaaatagccacggttatgagcatcacatccgtttgaaagcgcatataaccataccggacaccgaggtcgcccagccctcctccaccaatggctccggccatggccgaatacccgattatagctattgcagtattggttaaactcaaaataattccggctcgggcttccggcaaaagtactttgaaaattacctgccggttatttgcccccatggcccgggccgcttctaccactccggggtcaacttccctgagattggcctcaattaaccgggcaacaaaaggcgccgcccctattgttaagggtactatcgctgcgctgctaccgatagaggtcccggcaataagccgggttaaaggagttaccgccagcatcagaattacaaaaggcgccgaacgcaggacatttactaccgaacccagaatgctgtaaattaccggattgggcattatcccaccatttgaaacggcatttaagagaactcccaccggaataccaattaccgctgcaaagaaaagagatactccggtcatataaagggtttcataggtagccttcaggatttccggccagtattccacttctacaccacctccagcttcaccgaaagctcgtgcaaaatttgccggaccttgtctcgtctgttttcatccccgaaaatctctaccgccaaaattccgtagggaacgtcttttaaatgtccgatattgccgtaaaggatgcttaactccacacccgtttctttgattatcctggataccaccggctcattggcggtattgccggcaaagcgcagcaagagcacttcccggtcaggtcttctggtccgggcatgggctaaaacctcttccggtaattccttgctgattacggtgttaacaaactctttggtaatgggatgccagggatttaaaaagacatcggttactaccccttcttctaccacccggccgttgtccattaccgccacccgatcgcagatttcggtaatcacccgcatttcatgggtaatgataactatagtaatccccagcttttggttaatttctgccagtaactttagaatttgtcccgtcgtttgcggatccaaagcagaagtgggttcatcacagagaagaattttcgggtttgcggcaatcgcccgggcaatccccacccgttgtttttgtccgccggaaagttctcttggatagctctccgctttatccaaaagccccaccagctccaggacttccataacccgcttctttatctgttccctgggatagccccctatctccaggggaaaagctacgttcccaaaaacggtgcgggaatccaagaggttaaaatgctgaaagatcatcccgattttttgccgcaaatttagaagttctttacttgatagccgtgtgatttccacgccatccacccaaacttcaccggaagtaggccggacaagcccgtttattgcccgcagtaacgatgactttccggcgcccgataagccgatgatgccaaaaatttcacctttttttatttctaaactgacattatccaccgcttttacctttcttttccccggatacgtaatttccaggtttttaataataatcactgttaccacctcttttgcaaaaaaataacccccttccggttagaagagggttttactcctcctcttatctcccggaatttaatccgcaggaattggcaccattgccaaaaatatggccggttgccgggcttcattgggccagtccctccgccactcttgataagaggcgatctatgtcatcgccgctatttagttcgcattaaactgagtttgattttaaattcgaaactaccacctgtcaagtccctctgaaaaagttttaattttttaaattttctacgctgcctcccgtttattaaaaagatatattcccagaattactacccccaccaggtaaagaagggtatatccgagaaagtacaagctcggggggttggcactgccaaataaggttaaaggtccagcaaagttgctaactccagaaaaaatataagacacccctttgcggtaaatagcgtcggtaggaagggtaatactggttaaaaggccgatttcttgcaaaattttcgtttgtccgggaaagaagcttgccacctgctccatcatccctcccaccagcgaagccatatacagggtaaaagcaaaaaaaccgttagccgccggcgacaaccgcaccgacccggtcaacgtcaccgccgttaaaataagcggcattccgcttaagataagtcctgcaagccagacattctgtgggataaaaccggtaataacgtaaaactcggctaccagcgccaatattaaaattatcgccgcaataatgcctaaaagaccgtaaccaataaattttcccaaaaatacctcccactttttaacgggacgtaccagtagcggctgtaaaagccacgcttctaattctccggaaatcgccccaaccgcgctaaataccgctatcacgtttactgcaaaggaggcgaaaaacaagccaaaggaaaagaaaaaatttaaaagaatataatgctgtaacaccatatcaggagtagggcttttatatatttttaaattatcgctgataaaataaaggccggtaccgaaaagaataaggtaaaccaccgctaaaatgacaattaccaaaagagtttttctgcgcaccgcttcccttaaggtataactaattatctgccccatttttgccctccaccgcctggataaataattcctcgagcgccgccttaaacggccgaacctcataaatattagctcccccgaggaccaattcccgcattattgccggtacttcttcttcgcttacccccaaaagctttaacccatttggggcttccccggtttgataccgggattttagtttattaagaagagcttcgggaatttccccgcggattaaaatcccgcgtccggataaaagttccgcaagttttccccgggcttttatttccccgcggttaataatcgctacactatcggctaccatttccacctcagataaaagatggctgtttaaaaataccgctactccttgtcttttaaggtcggtgataatttcccggacttcaatccggcctaccggatccagagccgaagttggctcatccaaaaataaaagttccggttcccctaataaggccaccgccagggccagtcgctggcgcatcccctggctgtaggtcttgattctactatcttttcgctcccagagtttggtccgggttaaaacctcttctattcttcgttttaactttttctctggaaggtagagaagcttcccgtgaaagcgcaaaagctcttctgccgtcatccattccggcaggcgaatattttccgggagatagcctaccttacgacggacatgcaagtcttccgggcttttcccaaaaagccgtatcgtccccgaggtaggctttaataagcccagagcagttttcacaaaggtacttttcccggcaccgtttggccctaaaaaagcaaagatttctccgggggaaacccccagagaaatgttccggcaccctatttcccggccataatattttgttaaatcgacactttctaataccatgttaccagctaagcccccttgctacttctaaaagggtttctttatcaagagagctttcaattacggtaagaattcccccctttaaaaacaccagcacccgatagcttccccccgattgttcaagcatctttccggttacaccggcgattttaacatcttccaccgatgttcccttgtaaaccggtatcaccagggcgctgtttaaatcaccggcaagtcctgccagagagctttttaggtctccggggatccccggcagctctaagagaacttcggcaatttcttccggcgtaatcctggcccgggtttttatttccggtactgcctgacgggtaatgctaagaaaaccaccattattaccgccacctgtcaggttgtaattggcccggtaaccagggtttacgctgatgttaaactcttttccctccaaggtttccggaaatagcttcttggctcccaaaaacttcagctgcctattcatctccttaacattaactttcactgttaatttaaatccttccccttggtataaattattcaattgcgcatatttttctaaagttgaaggtaaattttccggaacgggatttaaagatgccggaatatttttaatatcattgggagccaaatcccgcggttttaaagtcacctctcttttaacctcgataagtccttctatcttgctttcccccaccttattaaaaatatcggaaagtttctccaggtccgccgcattaatcgagactatttcgaccttttcagcccggaaaaaggtgtaaagttcatcggctatcgttggcgccccgatcaggattaaagcggccgccgctaccgctgccacccggggtaaaattgcattttgccagaattttctcctaaggcttgccgcattaaccttttcgccgtcagtcaaaagcgaaagctttgtcgcggtaaattttctggtagctttaatttcgtttaacttttcccggcacttcaagcactcttcaaggtgttcctctacctttctcatttcccctaaatttagctcatcatccacataagccattaaaatcccctcatccaaacaacggcccttcaaattactcacctccggataattttaaataactttttttaaaccgggcctgcgcccggcagagtttctggcccaccgagctttccttaatccctaatttttgggctatctccttgtatttatagcccttctcccgtaaaagtaatagtttttgttcttcctcggtaagggttgccagagcttctttcaccagttccacctcatcaataaaattaattccggaagttttcgctccttctaacagcggaatctcccgagcactcctgagataatcataggcaagattttctcccactttaaaaagccaaccgacaggattatttatactgcttatatcttccctaagtagcctggcaaaacactcctgagccagttcttcggctatatctaccctttttacaatactattaatcctgaaggtaagtttggtatacatttccttataaagggtttcaactatactgtgctccaccctctccctcctttaccgctttttctacctctaagacgattttaacccctaatttgtgacagccaaagaaatattttctccgttaatctgcaataaacacgaaacactttggtaacaattaggttttataataaacttaaaaggaggcgatattaatgatgtggagatttttcccgggatttggctacggttacggttattaccccggcagtttactaataaacctgcttttgtttttagctgttatagcggtagcagccctgattttccgccggtttggcatcttttttcccatgggcggctgcggccatcatatttcccatacaaaccaccgctcttcggcagaagaaattttaagagagcggtacgctcgcggggaaataaccagggaagattatttaaaagctttagaagatcttaaaaaataaggggtgataacgatgatgtggtatttctgggatcggctaactccatggaacatgcttggaggtatctttatgatgatcctaatgtttctcttttgggcggtagtgatttatttcatcttcaaacttcttaccagaaacgatattataaataaagttacctccggaaaatctccggaagaacttttaaaggaaagatacgcccggggagaaataaccaaagaacaatacgaagaaatgcttcaagatttacgaaaatagcgggtgattgtcatgttctggtattgctggaatcaagctttaggcccctggaatatgataggaggttttattatgatgatcttcggcttgcttttcttggctttgattatttacatcgcctttcagctattagctaaaaacaacggaattactaaattaagtataaccaaatcaccagaagatttgttaaaagagcggtatgccaagggtgaaattagcaaagaaaaatacgaagaaatgttgcacgacttacgaaaatagcgggaaacccccgctatttttgttataatttaagaaaaaagtattttacgaaaagctatataatgtatacggaaggtttccaattgaccaaattcaacccattagtcggtagtttaatcccacccaagcccactgactactctgttttatttatcggtttataccgaccaccaaccacttacgacatatcacattaaaggaggtccaagatggacaacctgacccacggacttattggttatgccctggccaaagccgttttgccggcaggtaccgacccagctttagccaaagcaataactattgcttctgtactggcttccgaagcgccggacatagactttgtcacccgggctttcggccctttaaaatattttgaataccaccgtaccctgacccatgccccctagggagtagcgaccttatctttgctggcagccgttattgcctactttttaaaccccaaagcaaattttggctatctctttggtatggccctcgtttccggctttattcatgttggcatggatttacttacttcctacggaacagctttgttctggcctctatcaaaaaagctctactcctacgatattttaatgattatcgatctgtatatattgttaatatttgccggcggttttcttttcttttggctgggaaagtcaccccagaaggtatttctcaccacgcttttaatagttcttctttatatcggtgcccgctggcaaatccagcaccatctctggcaaaaggtagcttttctctaccctgaagcaaaaataaccgtttatcccgatcccctcgactttttctcctggcgttatattgcccaggagggcaaaacaatccatcaaggagaagctaaatttttaagcggtaacataattgaaacaaaaacccttgaatcctctgaaatcccagaagaatcaagggttgccctttccactcccgaagcaaaagcatttttaaattttgccaagtttacttacgttaaagttaaagatacaccccaggggagaaaaatttatcttttagaaccccgttaccattttcgagggcattatgtatttggagtattaattgaacttgacaggcaaaacaaagtagttaaaacttatttaaaccagtctttagctgactaaccccttacgacaaaatagataaacactaaatataaaagaccatttatcagtaaaagcctggctgatagtttcttttgccaccggtaaccaaggtaagccagcaaacctgccgttaatgccagtattcccgatagcccggcataaaaatccaggtgccagtcggaaaacacgataccaaaagctggaattaaagtgctctgaaaaaccatcgccccggtaatatttccaagagcataggtatctttttggtcccgaatccagattattgagttaaacttttccggaagttcggtggcaataggagcaattaccagtgacagtaccagcggtggaatccctgctgctttcgctgccgtttcaatccctttcacaaattcatcggcccccaatacaatcattgttaatgccaccagcacctgagcaataatcgccagggtgggtgggtcatcatgacggggagcaaaataacaccggtccaactcgtggcagttttcttcaccggcaggggcagttattgttatctttaaataataagcataagctcccaccaatacaagggctactatgactttgccggcataaggtaaaaaagaggccaagagagctaaagcataaaaaggtaaaaagaacgttaaatcccgtttaaacacctcaccgtttaccgcaagttccaggcggttttcccttcttttaaaggcaagggctgataaccccgctaaaaacattgctatagtacttaacataaacggtgcccctaagatagcccccaccccgatggcatgggcatcggcaccggttccaaagagaatggctataatgggtatcatcgtttccggtagggccgttcccaccgccgccaggacacttcctaccgtgccttcatttaaattaaacttttttccaagccattccacgccattggtgaataaaaccgctccccctaaaataaacagcaagctgccaaaaagtaagagtacagtcatccgtcccacctctttctctaacaatttttagtttacaaaaaaataagacctttatacctaaaaaataacttcttaggtacaaaggtcttgcctttcgtgaaagaaccgggctcttcgccgggtttgtcggctctttctcccggaaaaccgggcggctactcccctttgcgtcatttaattacttttttgcgacatttaatcactttttattatagtaattctaccttattttgacaagtcctttagattcggtaattcttttccctgtagatgcgataccgtaaaagctccgctatttctgtgcccgccgccgctatcaatccaccgtttttcctcgccttcataattttttgataatttgttataatattattaacactcctcaagaggtggttaatcatgtcttttgtttcctatatccgccaaccccgggcggctatgcaaaagctgttactttatcccggaagcaaaaaagcattttataattattttatagcatcctttctcttactaattggccttatgtttttccccttttcccagagttcagactacttctaccaaattctttcttttaaacagccagcaataattttaacttttttaggtatctttatcttatttttttctcttataggtatagttaatcttatcgtagcttaccttaccgcccttattgtcagcaaaaatattacaaaaatcgatcaggacttactgtttcagcggtttttactgggttattcggaacttatcttgttttctgccttaccccagggattggcctggctcaatctgcttaaattagatcttatttttgccgtattaacctgggccgcccaactatacgccctttatcttgcttatctcatgataactaccgccattaatttgtttaaataaagccggggtctacccccggcttaacactttctttttcacattttcgtaatccttacggtgaacgtatttcattcccgactcatctaaacttgctacccgaaaccagccgctggcaattaaaattttaagacgtgccatgctgatttttaagtttacagcaacttcgtttaacgacaaaatttcatcattgtcaataaatctttttaaaacctccggcttgggcttaaaattctggcaaaaacttccttccggcagtaccgcaaatttctctatatcgaaatccggatcaaaaaactcatcggtttcatcaaataaaccgtaaacttcccggcaaagaccgatggtttttgcggaaacggtagttaaatcctccccctgatacgagtaaaacgtcattttacttaagaaatcctctcttacttctaccggcatctcccgttcaaaatgaatgcagtttttacaggaaaaagcccgtttttttggcaggtctctccttgttggccgccggtactcctgataaaacttccctaaaccgtcattaatatattcggctaaaaggtgagcgttatcgagatatagttcttcatcctctaccagatgttcatacaccgctccttcttgaggttcgaaaatttcaatcaccctgccgttaaatttgcctttttcctttaagttcttcaaccactgaagaaaattttgcgcttcccgctcatcatcaaaaaggagtaagaactcgcgcagaggaaaataatttttcaataatttctcctggtcatccaaactgtgcaaaactacacaagtctggaaggctgggctatttatagtccgccctttcagagagtgcccattcccagcaggcggtatttaagcactcccatagcccctgccccaagaagcaggaactcgtgcccttaaccgggtctccccgcttgtcctgaaaagattaccctcttcaggacagagatgtctcttaaaactttcccaggggagagtggcgttaccaccgctaccttgagaactcgccagagtttatagctttcgctacagacgctaatacttgttccacccagaggtattagtgccttctccggctcactcccaaggctttctatcagttttatcgctctgtctatctcctttagttgctttttctttagttgtttgttcttaaccgtcctctttacatgctcttttaattcctccaattcgtcagcatctaaattttttagaattgccatatacccttcgggaatttgctcttttaacccaagtcctcttcttgctataacatacgctgctgccacgtcctttcatctacgtacctcgaatttaaattaaaaattccttgcaattctcgtttgagttcatttctgcttttaccttctaaaagcctgttatatgcaaatctcatgcaggatgaccatcttctcataagttctaatactttctgcttatcttcgtggttagcaaagctcagcttagcctgtattgttatcaagctatttaccacctctttgcccgtaaatcctggctgcaaatgatgtaactattgctatttcgataccttcttctgccctttggagttctcacaggagtgattaacccttcttttcccagtttataagtgttcttcgactgattgagtacatttattttattttttgcatacttaataacatccattaccacaagggtaaaattataccattttgcactgctattaccgactgttgttatcctcctttaacaaaaataaaaccattaattatcactttattgtactattatattcttcaactgtcaattattgcttgacttttaaaatttcatccttgccaaaggcaaaatgtcctgactcgtaccctttcccttctacattgatgattaccccttcggtaccaaacgcccggccaaaggtattaacaatactatctatttttaaaccttcaaaggcagaaccggcgtttagctccgagattaactctcgggaaaagtttaaccttaaattttggtcggtacgcacgtaatttagtagttttacgtctttacctaataccttatatttttcttcttttaaaatagatgttaatttgtcagccagttcttctcctgtcttaaatcttacagttcgctcttcacttaaaagcttatccacattagccgaagggtagtaaagcgtcaaggtttttgccggaagattcccatccttctccccatccccgtattttttcaggttgtcttcaatggtggctcccccagtagcaataaaccgctgtttaacaaggcctaccccattagcaaaatacctttcgatagtgttatctttagactttcctacaaccttcaggcaggtaaattctcccgccggaacttttactttttctgaaagactttcaatgctccaggtaatatctccggttttccaggtagtacctacttttaagggagctttcaaatagtactgttccatgcttggagcttcatctaaatgatttatccgccagtaactttcttcctttgcataaataagttttaccccattttcacttacctcaaaaacttctgccacatccgtaccgccattttgctgaagaagctgcactcgattaccttctatgaactccgtatctacccggccgccggcaaattcgttgccttccccttcatattcccagtaccagttcgcttttaccggaaagtaatcggtaaccgttaactgtactggtttttccgctggcttgggtgaaggagacggggtaggctcggttaactcttttttagcacaacctcccgcccccagcaaaagcaagaaaattaaacttcccaacacaaaaaactttttcaccggaaaacctcctcagcataagatgcacaaaaaaatcctgtattgctacaggattaagtttgccctaatatctggctaaaatgtatctttccggtttttgtccggggaatttgttctaaaaggattacgttattggccggtaccggctgctccgccaacttgttggcaaactccacaaatttagttttgtcaaacccgttttccggtacaataaagatttttagttcatcgtccaccagtaaaacggcaatatctttaattcccggaaaatcatccaggtatccttctaactcccgatagggaatgatatttttggtaacctgaaagaatttctttagataatattcaaaagtatttcgggtctggcgcaatttttcatccaggcgttttgcttccgcttcattttctacaatatgaaaaaccgtatacgggcaagtttttaaacattcaccgcaaaaattgcatatatctttattaacattaatttttcgggtttcggcattatatgtgatcgccccggttgggcagcactccgccgctttacagcttggttcatgctggcaggcatcgtaatcaacgtataaaaacattgtttctctccccctattttagactccaccgtcaaaataatattgctttagtgaaaagtttatttaaatttattatatgcaaatttcccaaaaaaataaagggataacagaattattttttgaaaatttttatttttttgtttaaaaaacagaaacatttttctaaagaagaatttgtattacatctccgtctttaagctcatcggtaaacccggcttcgcggtcatttaagaagattttcaaggaactaaccttcggtggaatttcttccaagtagggtaatacatcggctaaaatgtagcttgattttccgccaagtttcaccgtcctgccgtttaaggtaatttttattgccaaagaatcattattcggaaaaaagacctcttcccctaaaactacctcatctcccgggaaaaagcggtactctaaatctacttcccttccgtttactaaaatttttccggtttgagcaaacaacgtccccaccgtttcccgggaacagataatgaggttatccccttctttgatcaaataatcgtcggctaaaacctcattatttaaggttaccaagggatttagagctatctcttctccatttactttaatgacaatacttctatactcgtttaaaaggtcttttaccgtaagctttgcatcaccaccatcccgggccggtacaaattttatggaatctccagccccaacggctgtttttaaggatgcagtttgtccattcacataaatttcacaaacccggggtaattctccttttacttctcgcctctttccgttaagataaaacattaagctttttccttcctggccaaagatttctgccggtgttactccggaaagctttaatacctcgccgacatttaaattttgccgatgtaaaagccgaacctctctcccgtttaaaaagacggtaataaaaccgtggtcgtattttttcagtgcagttagcagtatgccaagaaccgtaactccctcgggtccctttagcctttccggtaccgttaaaaatttttgctcccttaagtcacatcctttaaccgccacccggctaacgtcaagccctaaaagctcggaaagctttttggcaaggccgggagtcttcgctcctcctcccactaaaaataccgctttgggagtccccccgttaagccgtttaatttcttcggctatttttcccgctatccgctccaccgtcggctcaattctggaaattatttcttccgccggtaatttaacctcctgtcccagaatatcgtaaaaggctatctctttgtttaaagccaattgctttttgatattttccgcatcgggaaaatccacgagaaactgccgcataatttcttcggttacctcatcgcccgcttccggtaccatcccgtaagctaccgccgcaccatcccgggcaatagcaatatccgaagtaccggcccctatatccaccagggctatgttgagtaacctcaggctttcgggaacagtagccgctatggccgcgataggctccagggttaggcttaacggttctaaccccgaccgtataagaaccgcttgcaggctggcagtaaccgtttccggcaaaaatgtggccaccagctcaacgctcatctttttcccccggtgtccttccagtgctttaaaaggatagccgtctaaataataattaatgatgctgtaacccaccagttcgtaccttacatccccttgattgctcagcgcttcggttgccgcttccaaagcctggctttccaattcaaaaacctgccgggcgctcacctcgcccccggcaatttctttttcggcataagcggtggcagtataaagggctcgtccggccgctgctatcgccgctttggtaagttttattccgagctccttttctaactcttccttgatttccgttacaacccccgctactttagctatatcgtgaatttgcccgtctaacatggagcgttcgttatgctcccgcatggtttcttttaaaatttttatttttccatcttccaaaacttccgcgacaaccccgataaccgtccgcgttcctatatctaaagcaaaaattatatttttttcatccataccaatcccgcccgtattttttttataccttattattcgctatttttcggtattctcctttaagaattaacgtttattaaactttcttcgcatataatccagtgcctctccgctattccttatctcaccccgggcccaggcttttaaaagataatttttaatgtgccccaccgcaggagattcgggaagatttaaagttttcataatctcttttcccgatagcccttccttaaattccaggtatccgtaataaaaatttattaacccccttaaaaattctaaatcgtcccgggctttttcccctttatccgcaagatacagaagaattaactctaaaaacaaatctccggtatcatgtacgagccgtaaaattgcctcaccgcttacttttgccgccgtttttagagataaaagccgcatgtggttttgaattaaaacagttaaaacccttttttcccggtgggaaaagttaagataatcaagaaaaggtttaagcctgtttacactttccttttcatggccaaaaaagcgggttcgcccctctttgtcataagataatgtcccgggtttaccgatatcgtgaaaaaacgccaccatttttaaaagatacggcggataatcgctcctgatccccaaagggttatcttccaaaagctcttccattcgatttaacgtatctattaaatgccggtaaaccgtctccgagtggtgataattttggtaaagctcatacccttccttcaatccaagattaaacacttcaaaaaaccccgtatgaaacagcatatctaccattggtacggcaggttttaaggtgaaaatttttttaagctcctccgctacccgctccccgggcattttctttatatattgtatatattgtttaaatacaaccattgtttcctgctctacggcaaaaccaagctctcccgccaggcgtattccccgtaaaattcgtaccgggtcttctaagatgttttccgcactaatcatccggataatcctggcctgtaaatcgtttctacctccgaaaaggtcgataacctctcggggaaattcaccgttaaccggcaaagccagggcatttaccgtaaaatcccggcgtcttaggtcttcttccaagctttccccaaaaaccggcagaatatccacctggtaagtttcgcccccatccttaaagaccagccggtaaattaaaagttcttcctttagaggaaaaaagtttcccccaaaagcttttaaaagtttctcgcccacttcccgcggcttttgaaaagtagccaggtctacgtctttgaccgggcgggaaagcagcatatcccgtacactaccgcccacaaagtaagttttggagtctttgatgacttctcttaccttttgtaaaatatccatttaagtcgcctctactttcttctcttttcggaatcctcaaagctttgtcctttcaataaattgtcgaagtatggtataattacgtcggttttaaattattctaattatttttatcaacgggggggtggtaagtgatgtatgagatagatttaaccgacgtcgttatagctttaaccaaagctttagaatttaccaatgaagacctgggatatcaccacgaacgggttgcctacatagccgcttcgatcgggaaaaaactcaatctttcggaaaaggattatgaaactttgttttgggctgcctacttacacgatttgggcgccggagcaaaattagtcgacagggaaattcataatttagataaatacgacactgcccatgccaactttggctatgaacttttaaaagatgtaccgttttttaccgaagtagctcaggtaataaaacatcaccataccaaatatattaattttacttccgctgaaaaaaattccccccttgctttcttaagccaaattatctttgctgccgaccaggtagatttatatttaaaaccaaacaaacttgcccttttacaacgaagtgaaattgaacggttttttaggaaaaatgttcaaatcctctttaatgaagatgtagttgaagctttcctggatttatctcaaaaagaaagtttctggcttgaccttactacatattatattgaagatagattaaaggctttaagaccaaaaaccaaaattttagccggtgaacaggggctaaagcttttaaccgtgccttttgcccggattatcgacgcgaaaagcccttttacggaaaggcattctttaaaagttgcagccctaagcggccagcttgccgaaattgccggccttcccgggcaaaaatctttaattgaaatcgccggtctcctgcacgatatcggaaaactttccgtttccaataagattttagaaaaaaacggcccgctaaacgatgaagagtatgcactaattaaaacccatccttattatacctattacttactaatacaagtcacaggttttgaaaaagtcgcccagtgggccggttaccaccatgaacagcccaacggccagggttatccttttaagcttaccaaagaccagcttgaccttccttcccgcattctggcggtagccgataaatgggtcgctttaagggaaaaccggccttaccgggatgctttaagtattgaaaatgctctcgatatcttggaaaacatggcccaaaaggaaatagtagaccctgaggtagtaaagcttttaaaagaaaatatcgattatctggaaaaatctcaggaagaagaaattggtcagattaccgggaaaactaacgaaccgctccttagctaaggagcaatttcccctgcccaaaataaatgccctctatcggaaattttggtagagggcatttttgttaaaagcattttgacaaaaattaaccttttcctgcaatatttaaaaaaaatttttgtccgacaatattaaacgtccgccggataacatcggtgcaagcttctttttcacccctttaaaccccgtcatggtttaaatacctttttttaaactcaacaaagctaagcttttcttttatttctccccggtccattaccagaatttcatccatcttttctaaacccctcaaacggtgggttatataaacaagggttttatcccccgctacttcccaaatattatctaaaatctctttttccgttatactatcaaggccggtagttggctcatctaaaagccagataggagcattttttaaaagcagccgggctattaaaagcctctggcgctccccgcccgacaaacgttccccccgctctcctacttcaaaggaaagctttaaatgagaaagcctaactttttcgagtaccgccaaaagctcttcttcctgagcttcaggtttggcaatccgtaaattttcctcaagagtactgttaaaaataaagctttcctggcttaccaccccaaaaagggtccgcaccgcttccggagaaaaggtcttaagttcttcacccccgaggaaaatttcccctttataatcataaaagcgcaaaagaagctttaaaatactgcttttccctgagccgctggggcccaccacggctatcttttgcccctcctttagaaaaaagctcacttcttttaaggaaggctcaacatttcctgggtaaatcaacgtcacctttttaaactctaaagaaaagtcgccgggtaaatcagtccgcccggctccctcaataacctgcgggggctcgtttaatatggaaaaaatccttctggcactttccttgctttcctcccagtactgccgggccgcagctgccggtaaaactgcttcaaaagaagtttgcaccactaaaaccacaagagcaataagcactccggaaagttttccctgggaacttaagtagactgccagaagtaacgctaaaaagccggaaaaatgacttaaaaagaaaacagtgctctccgagaaagcagttaaatttgccgccatcttacgtaaagctataagtttttgggaaagcttttggacccctaaaaccttttcctccaaactattgttggtttttaaatcaatatacccgaggattagttccccaatgccgtcggctaaaaaagctcgctccgtgcgaagtttttgggtaaattccaagcgcttctttcccagaaaggcgggtaaaaaaatggttgcaattataaatcctgaaaagaggagtaaggaaaaccaaaaagaaaatctccataaaaaaatcccggctaaaattaaaacccacaatatcacaaggtacggataaaccgcccgtaagaaaaagttttgtaagctttccacatccgccaccatccgggacagtaaatcggtgctgcgggctttttggaaaattgccggagctttgggttctactttttcgtaaaaaaacttacggatttcggctaaaaaattaaaagtggtcttatgggaaaaataccgttccaaataccgaaagaccgcccgggaaagtccgaaaaatctcacgcctacaatggtcagggtcaaagtatacgcccagggcttaagcgctgctttggaaataagataagccgatgtggcaaataagccaacactgcttaccacggtaagcgtcccgagaaataccgccaacaaaactcccctaagatcgttttgtaaaattttaaataattgtttcatacttccccccggtaagctgtaattaattgccggtataattcattttccgctaaaagctgttcgtgccttcccataccccggatctctccccggtctatcaaaatgattttatccgcccggtagagactcgaaaggcgatgggctatgatgattaccgtccggttttggaaaagctcatcaaaggctttttccaaaagtttttcggtatgagcatcaagacctgcggttggctcatctaaaattacaatttttgcgtcttttaaaaacacccgggctaaagcaattcgctggcgttccccaccggataacccccgccctccttcgccaaccttggtgtcataaccctgcggaagttcggcaataaattgatgggccccggctaaactcgccgcccgtttaatttcttcgccctttgctccttttttcccaagggcaatattttccgctatacttcccggaaaaataaagggcgtctgatgaagataacccacctggtcataccagtctttttccttaagttcccagaggggaaccccatttattaatatttctccttctgccggtcgcataagccccagcagaagctttaccagggtagacttaccagccccgctgggtccaacaatcgcaaccttttccaaaggctttatcgtaagattaatatttttaagaacttctttacccggtatataactatgacttacctgtttaaggataatttccggtggagaatcccaggtaatagaccgcttatttaaaaagacccggctttctttttcctctattattgtccacagtttttgcgaaaacgctatcgccgttctgcccgcatgaaaactgcttccaagattccttaaaggtaaataaagttccggtgctaacagtaaaacaaaaaacgcctgtaaaaactccatttttccgtataaaagccttaaccccacttctaccgccaccatcgcggtgctgatggtagctaaaacttccagggcaagggctgaaagaaaagcaacccttaacacctccatggtggcatcccggaacattaaaccgctttttttaagctcattaacctgctctttactccggccaaaggcctttaagtccgctatcccctgtaaaagctcgaaaaacttgccgctcaagcgggataagctgctccactgtttttgggccagtttctcggcaaaacttccaatcagcatcataaaaacgggaattaacggagcggttagcagcataattattccggaaataaggtctaaagctaaaaccactaccaaaatcattaaaggtatgatcccggcacttattagttgcggaagataccgggcatagtaaacctcgagactttctaccccttctaaaatcagagttaaaagctctcccgttttttccggcagtaaaacttttgtccccaatgctgctattttttccaaaagcacattccgtatttcgccggtaactttagaagcaagattggcccctaccttttctccaaaataacccaaactaaatcttaaggtaacgataagaaataatgccgggaaaaacggccaaagttccccaagcccttttttagctaaaaaggccccgttgatgatatacgctattaaataagcctgggcaataatcgcaccgccgcttataaacgacgttaaagcgattttaactaaataccctttatattttagcgcttcttgatttaatcttttttcgatcatagctaccctcggttttttctttaaattttaccataataaaggaaaagcggcagctttacagctaccgcaatatttttaatatccgttccgctccggtgaagctttaccccgaaacacccggtaagtatagatagtgtataaaaggacgatcggtaccccgattaacgcgacaatgagcattacctttaaagttaagggcgaggaggaagcattgtaaattgtaagatttttgaccgggtcagtagcaattacccagttgggataaagccccgccgccacggttaaaatcatcgtggcaaaagctatagatgaagcggtaaacaccttctggtaagcgtttttccgcacccagcccgggataaggataagggatactaaggttataagcggtaaaacatataaaaggggcaatttttgataattttcccacaaatgcggtgctgccattttgctgtaaatcccgccaattagccacagtaccagtaaaatcacggcaaaatttttgcttaagtcccgagctcgtttttgctggtccccttcggtttttaacgctgcataggccgccccctgcagcagaaaggcaaaaagcccaacaataccaaagcacagggcaaaaggttttaaaaggccaaaaaaggtaccggcgtaattttgctcagcatctaaaggtataccgtaaaccacattgcctaccgccactccaaaaagaagggccggtaagaaacttcccaggaaaaataagccgcccatcagcttttgcagtcccggagtatctactttaaagtagtactccaccgctaccgcccggaaaatcaacgcaaacagtaccagcatcatcgccaggtaaaaaccgctgaacaccgacgcataaaccagaggaaaagcggcaaaaagcgctccaccgccggttaaaagccaaacttcgttgccatcccacaccggaccaatggcattgattaaaatttttctttccttatcggttttcccaaggacgtaaaataaactacccacgcccagatcaaagccgtctaaaagggcatagccgataatcaatacccccaccagcaaaaaccagacggtatttaaatccaccctacgccacctccctttccgctacacccaaagcattttcattatgggtcttaacggtccgcaccatcaggtaaagcatcaaaccgcccaggaaaaggtacacagctatgaataataaattggtcaacactaactgccctgggtcaagcttcgagaccgcatcggaagtttttaaaagaccgtaaacaatccagggctgacgcccgacctcggcggttatccaccccaattcattggcaatatagggcaggggaataaagtaaaggaggagttttaaaagcaaccggttattgtaaattttgccccggataagctccaccaccgcccacaaaagggccaatgccattaaaatcccgagacctaccattaaatggaatgaaaggaaagttggtaatatcggcggccgttcctcccggggaaactctttaataccctttacaggctgatttacatcaccgtgagcaagatagcttaaaagacccggaactcctatttcaaagacatttttctcgtttttggtatccggccaacctaaaataaggaggggagctttttcctgggtctcccagaggccttcaaaggcagctaacttagccggttgagttaccgccacctgtttggcatgaatatcgccaaaataaatctgcaaaagggcaaagataagtccaaagattatcccaactcgtaaagacggcctggcaatttccacatttttcttgcgtaagagatagtaagcgcttatacccataacaaagaaggccgcagttacataagctccatccaaagtgtgcaaaaagcgcggcaaggtagacgggctaaataccgcttctttaaagcttgtaagaattgcccggcccccttccagcttataacccgccggcgtttgctgccaggagttagcagcgataatccaaaaagctgaaaggtttgtgccaaaagcaaccaagaccgcacttaaaaaccgcattccccgggaaatcttatcccgaccaaagagcagaagaccgataaacgtggactctaagaaaaaggcaaaaactccttccgccgccagaggtgctccaaaaatatcccccacaaaccgggaatagtcagcccagttggtgccaaattgaaattccatggtaatcccggaagctactccaaccgcaaaattaatggcaaaaagtttagtccaaaaccgggccattttatcccaaacctcgtcgttagtcctccagtacttgtactccatgtaagcgatcagcactgctaaacccaaggtaaggggtacgtagaaaaagtggaaaatagcggttatggtaaactgcaaacgggataacgccgtgagatccatcatccaccctccttaaaaatatacttttttagtatagttttgggcaaaattttttaaaggttttgctccctttccaaaatttttttaaaactcaccgttcccagccgggcaatgatatcattttggattaaggaaagctcttggtgaatggcacaccggccaccccgctgactggtgcaatactggggatcgattaagcagcggttaatctttaccggtccctccaccgcttccaccacatctaaaagtgttatttcttccggatctttagctaaactaaaaccgccccccaccccgcggtaagattttacaatccccgcttgtcccagctgccgcaggatttttagcaaaaaccttaaggggatattttcccgcccggcaatttcctgggcttctaccacctccccattcccttttctcgccaagtacaataccgcccgaaatgcataatcggttgcctgagttagattcatctcttcctccaaagtatactaaaatagtattgttttctttaaaataaaccatttatatcccttttgtcaagtagtaatttgggaatagtccccatttttatactttactataactcagaaccgtccctcctggggtagttcttgaacctgggaaagctttttctcgatatttctggttttctttacggcattgtcgatttcattggtggcagcttcaagttttttccgggttttatccagagcttccccgaaacgggcaaattcggtttttacttcccccaggagggtccagacttcaagagagcgcttttcaatagccagggttctaaagcccatctgcaggctatttaaaaaagccgctaacgtagtaggtccggctacggcaacgcgatattcccgctgaagcctttctaccaaaccatttcttcttaagacctcggcatataaaccttccgaaggcaaaaacataatagcaaaatcggtggtatggggaggatctaagtatttttcccggattttcctggcttcatccttaattctattttccaacgctttggcggcttcttcggctaaaagcgcatctcctttatcgatagcatccagtaatcgctggtaatcctcggtaggaaactttgcatcaatggggagccacaccgggccatccttttgcccgggaagcttaatggcaaattctacccgctcctccgaaccttttttcgtggcgatgtttttctcgtactgctccggggcaaaaatctgctctaaaattgccccaagctgaatttcaccaagggttcccctggttttaacgttggttaaaactttctttaagtctcccactcccgccgctaaagcctgcatttctcccaagccccgttgtacctgctctaaccgctcgctaataagccgaaaggattccgaaagccgtcgctccagcgtgccctgaagcttttcatcgacggtagcccgcatttcctccagctttttagcgttatcctcctgcaagcgatgaagattatcctctaccgttttccgcaccgcttccaaccgctgctcggtttgcagcataagcccggaaagctgtctttctaccgcctctaactgatttttctgtaaaatcccgatctgacttaaagacccaagcatggtatcgcgaaaatctcttaagctgtcgcttaggtcttttcggttttgggcagcttcctcccgcagggtactattaagactgcttaaaagttccttgagaaagttaatgccggtaagaaggctttctctttccggaaaacgaattttcataaaaaggatgatttggaaaataaggatgataaaaagcagaataaaaataaatatttccaagattatgtctcctttcatttattattccagtttctaacttccaacctcaaacctctaaaagggacggctctccaaaaaaactgtaatcagtcgtccatcggtaatagatggcaggtaagaaaaaagaatttgcagaccaccgaccacctaccactgaccacctatataattgttctccctatgctctcgattctccttttcaggcagggaaggcaggcgtcgggatcttcgtttacgcagattttaccgggataaagctggtagagaggtcggtacggttgcggggtcatattgggcataaccacattggcccccacttttaagccaagctcccggccctcgggatggatggtaccaagggccgtagtggcagggatattggctttagggagtataatccgggtcagggcaatcattgtaagggtttgctctaaagttccgcccttttccttggccagcggtgtatccggatggggaataaagggaccaatccccaccatctccggttgcagcttctccataaacaataaatcctcccagagcatatcgtccgtctgccccggaaggcctaccatattccccgcacctacctcgtaaccaaggtcttttaaagcataaaggcagcgcacccggttaaaaaaacttccgtccggatggagtacttcataaagtttacggtttgccgtctcatgccgcaagaggtaacgatccgccccggctttttttaattcccggtacgcatgagtagaaagttccccgatacttaaagtaacgtagaccccaagttctttaatccgggaaactatccctaccaggtccttcagtttgtaataggggtcctcaccgctctggagtaccacggtttttatcccaagagcagcaacttctttcgctcgcttaattatctcctcggggctcatccggtaacggccaagctttgtattatcccggcgaagaccgcagtaaaggcagtttcgccggcagtagttggaaaactcaatgattccccgaagatatactacatcccctttttcccgggctcgaatgctatcggccaaggcatagagtttatcttgataaatttccaaagattaaacctcccagaaactttcctcaatcaccttatttaaattatacagcctttcctcggcttcctgcagggggattggtttaaagaaaattttctctttggaagttttctggatcaatcgggaaaggctttctccagcgactacacctatcaggggataaccaccggtggtctgccggtcggcaagtaagacaatgagttccccattttttgttacctgcatcccacccagaggcaccggagcggaaataatttccttttcagcaagagttagcgttggacccgaaaaacggtagcccatccggttaaacgctgggtttaaggtaaaaggttgcgatgctaaccgttcagcgctatccttggaaagatattcccattccggcccctgaataaaataaatttggtcattttcgtacagggcaaaacgtccttcgggtaaaaaatagcgttttttaaagttcccttcaaattcggcaaagggtatttcatcgtccttttttaaagcccggcccaaaaaacctccgaaccccgctaaaagattggttcctctccctcccagtacttcgggtactataaaaccgccctttaccgcgagatatccccagttacccccgtaggggccggtaatctccagaacgcttccggcaggtgcaaaataggattgccagaagtgaacaggtcctccgtctaaaaaagcccggtatttaccaccggttagagcaaaaaccgtactctggcaaaatttcaccgaaattcccgcgttaaactctataaccgcctttaaatcatcgttaccgcacagcttgttggcaatcgaaaatgcatttaaatccattgcccctccgggaccaaggccgtatcgctgatagccaaaacgcccaccatcctggatcgtagttaaatttccgggttttagtattttaagcacgctttttcctccaggcctgaacgtaaatatttttgtttaacaattcccggttaattttttgggcaagttttaccgcctcgatattgtcaccatgtacacaaatggtatccacttccgcttttataaccgtaccatccacagcttttacccagccctcggctaacgctatagcctgagcgaccgcttcatctcccgtctttttggccccttcctgatttcttggaaccagccgaccatcaggtaaatagccccggtcggcaaacccttcccggataacagtaagtcccatctcactggctatttcaaaaagtctgccgtagggtaaagtcacaatagctatttccgcatcaaaaacccaaaccgccctggccaccgcttcggccacttcaacttttaccaccgcatcgttataaagggctccgtgaggctttacatgggtaatttttaccccttccgccctggcaaaagccgaaagagccccgagctgatataaaagcatattggttatttcttctttagtataaggaatgctccggcggccaaacccccagaggtccgggtagccgggatgagctcccaggtttacgccatattcccgggcaagcttacaacattcagccataaccataaaatccccggcatgaaagccgcaggctacatttatactggaaaccagcggcaagatggcttcatcttcacctactttaaaattaccgtaactttctcctatatcggcgtttagatcaatatacttcaacttctccccctcccagccggaagtattcctcaacgcttatcggataaaactctatatatcctccgggctccagtaaaaagggagcctcagggttttccggattaaacagtcgcagaggggttcttccgataatttgccagccaccgggagatgccaccggataaatccccgtttgcatccccgcaatccctaccgagcccgcttccacccgtggccgcggtgatgatttacggggggcagcaattcgcgggtccaaccccccaagataaggaaagcctggcgtaaagccaagcatgtaaatataatagcggtttttcgtatgaatagctataacttcttcgggagttaaattattaagccttgccacttcctcaaggtcgggaccaaactccccgccataagctaccggtatccggtataagcggggagtttcttcttgcccaccgccgtctttaagattttccgctaatctttccaccaatttttttagctcccaaaagcttattaccgccggctcaaaatataccgctaaagcccggtaggtgggtaccgtttccaggattccgggaattccctgcaatttccggtctaaagctataaccttctggtttacttcccggcttatttcctttgcaaaataaatcccaagacaacgctctcccagggagtaaattttatacatatttcctccttttaacttaaaagctttaaaaactggtctttaaagctaactataccaaagtaacctaccgccagagctaccaccaccccaaaaatagtaagccataccggatggcgatagttcccaaaaagttctttcttgcgtaaaactaaaagcatggccgttaaagtaataggtaaaatcaaaccgttaaaagctccggctaaaattaaaagctttacaggtttaccaaactttacgaacaccgccagggataaaagcacaaaaaggataatggcaatattgtagttttcgcgtactttcttgctgtaagtttttaagaatgacatggaggtataagcagaaccaattaccgaagtaatcgctgccgcccatagtaccaggccaaaaagtttataacccaaggtaccggcagcgattttaaaagccgaagcgggcgggttattgggatctaaagtatgccctttagccaccacacccaaaaccgccagaaacaataaaatccgcattaatccggcaattattataccagaaagtgaactttttgttacctccggtaaattttcctctcccacaatgccggcatccaaaagcctgtggcctcccgcaaaagttatgtaaccgcccaccgtccccccgaccaaagtcactatcgctaaaaagtcaactttagccgggacaaaagtccggtaaagcgcttcacctaccggcggcctggtagttaccgccacataagctgttagcaaaatcataagcccgcctaaaatcttggccgttaaatcaattttactccctaaatccttggataagaaaattaaaatggcaaaagccgcagaaatcaccgctccccattccggactaagaccggttaagacattaaccgcaaggcctgtgccggcaatgttaccgatattaaaggcaaaaccccctaaaacaattaaaaaagtaacaactacccccagtccgggcagtacctcatcggctaactcctgtcccggttttctggtcatggtaataattctccagatgttaagctgcgctccaatatccagtaaaatggacattaaaataacaaaaccaaaacttgtgagaagttgctcggtaaataccgctgtttgggttaaaaagccgggaccgatggcggaagttgccattaaaaaagcagcccctaaaactgctcctgcactaacgtcttttttccccataatctcaccctttctctatttttccctttaaaaagtatatatttctactttagttaataaaagtaccgtttttaatgtatattgtattcccaccggcattttgtgggatatatcacagaattttcttaaattttgaagtttaatagtggtaaggaaaggagtgggattatgggtatgtggaaatgtcccgggcaagaccggagtttctggaaaatcgatgatatttttgaagctccctgcccgcactgcggagaaatgattgagttctggaaagatgacattaccataaaatgcccgcactgcaaaaactttgtcaccaatcctaaatttaatcccggttgcgccgcctggtgtaattacgccgataaatgtttaggagcagttgctcatgaaatccaaagtcagccggaaatagttaaaacaagagtagaagttaacgttcgaaagtacctgcttaaccagccggaacttctgggtttatctttaaaagccggggaatatgccgaaaagctggccgaaaagcttcaggtttctcccctggtaccggtagtagcggcttactttcacaaaattgctgaaaaaagcacccgccaggaacttgcccggaaggcaaaacttcctgaggaagcctatgcggcggtggaaaagcttttggcaggggaaggcaaccagcaagaaatggccatttacaacgattccgtaaaattagcaagcctacaccataaaaccttagaggaaattgaagaaaattatcaacagtttttaaatgaattttctttggaggcatccagggagtatgctcagaaggtttttgatgtaaagaaaaagcttgcaagaaaaaaataaacgtagggtcgactcctgtcgacgttattttgatgtagggtcgactcctgtcgaccaaataatggcagcaggagctgcccctacagttataaaaccccctgcagggtaaaccgcagggggttagttattttcttatttcttagcttttcccgcctgaaccttagcttttatttctgcctgaaccttggcttttagtgctgctactgttttagccgtatcccgcttcatcttcattaaatcctgcatttcttttttattcacaatcccaccaactacttttacttcctttaaagtcccctgagcatcgtacttgaccaccacttttgcccctaccgggattgaagccaagtcttttaccgtatacttaacaaatttcggaacagagatagtcttttttccagcttttttctctactaaagtaaaaatttttagcccttttatgccggttacctttaccgctgccgggtcaggaacggtaaagcttttagacatggtaacgttcttgtttaatttggctacggtaaacaccccatctttgttataagttactactccggcataagtgtaaaccgccatacatactgctggttgtgagtaagtagtatcagttaccgaatttgtattatacgtagtatcagttaccgtattattataagtagcatcagtaactgtagtgttagttaccgtagtgtatgtagtagcggtaaccgtcggagtagtcccttcttcggccaaagcaaacccggcaaaggccactaccagggataaagttaatactactgctaagagctttctcatggtatctacctccttttaatttttggtttcactataatattcgtaagcttttaaaattttaagggggtcataaaaaaattttgcaaaaaaagagtattaggcataaaataaagttatcagatagaaagaggggatgcgcatggtggaaaaaattttagaaacagagatttaccgggttaaaattccggtgccttttcctttaaagtatattaactgctatttaacttttgatgaaaaaggctggtatgttatcgataccggaatcaactatcctgatgctcaagccgcctgggaaaaagtagttactgatttagggcttaagtgggaaaatttaaaaaccatttacttaacccactaccacccggaccattacggccttgccggctacatgcagcagaaatcccgggcccgggtttacatggcaccgcaggagtttaccgcagccctgggcttttttgtaaaagacccgcaagagatttattccaaatttgccgagttttacttacaagctggagtacccgaagaaaaaagccgggaaatacttttccacacaaccagaaaccgggaaatgaccgctcctcatccggaagtaactttcctggcccccgggcaaaaagtaccctttggtaaatacctgttaaccacttactttcatccggggcattcaccctcccatcttaccctgcacttagaggagttggggcttttattttccggagaccatctcttagaaagaatatcatctaacatcagctactggccgatgtacaccggtcaaaatcctttgcaagattatttaaagagcttagaagccttaaaaaatctcaaggtagatttagtcctccccggtcacggcaataccttttctaatatgttaggaagaattgatgaactttttgctcaccatgaggaaagacttaaggaaattaaaaaattaactgctgaaggactaaatccttatgaaataacccttaaaattttcggggaaaatcttagcccccatgaactccgctttgccgtggctgaggtaattgctcaccagatttatcttaaaaattaaaggacttagggcttaatgccataagtcctttttatatatttttatcaggcgaagcttttttgtccccctgcctgaaatcaacgaccttgaatcttttaaccgggaacttttgcaaaaatccttgaaatacctggaaaaacccactatgaaaaacagcaataaatccgggatttatttgccgaagaccaacagcagttaaaaatgttaccgctactaatgcccctccacctccactaattccccgttgatatgccgtttaaggtaacggtatgtcttgccacccctatatttatcttaataaaggaatcacccttgttgtattaataaaaaatcaccgcaagaaaattcctgcggtgacttagatagcttcttcttttattttttttacttctggaacttgttttttatctattccaaaaacataataacttataataattaatgccataaatgccgctccaatgattagcgatagtctggtatcgctatttaaccacatgccaactaatactagtaccaagaagataatcgtaaggtaattgctgtaaggtgaaagtggagctttaaatgggtgatcttttatttcattatctttaagttttctaaatttaagttgactgataagtattacaaaccaaggcatcatacccggtaatacgctagcactataaatatatacaaaaagtttttgtggagctatatagtttaaagctactccaattagcaagcacgctattgttactaaaaggctattgacaggtaccccagaaggagataccttggctaaaaattttggagcttggccattttggcttaatgtatataacattcttgcagaactataaataccactgttacaaccagataaggcagcagttaaaactacaaagtttatgatacttgctgcagcaggaatacctactttagcaaaggtcaaaacaaatgggctaccaatggtccccaacttattccatggataaagggcgacaattacaaaaatggccccaatataaaagattagtattcgccatgtgatattttgaactgcccttcttagagttctttgtggatcttttgcttcgccggctgtaacaccgaccaattcaaccccttggaaagctgcaactacaagacaaagggcaaacaggaatccttttataccatttgggaagaagccgccatgaatatataaattttctaatccaatggggcgaccatggttgccaaatccgaaaaagatcattcctatccccaaaataatcattactactattgtcaccactttaataagcgcaaaccagaattcaaattctccatagtacttaactgcagctaagtttgccgtacctactatcaaaattgctattaggcctggtacccattgaggcaatgttggaaaccaaaatttcatataaatgcctacggctgttacctccgacattcctaccgctacccacataaaccagtaactccaagcagtaagataaccccataaaggaccgatgtacttgtgggcataagttgcaaaggagccggtgattggttcaatgtaaagcatttcacctatagtacgcattatgaaaaatatgaagatacccgctataatgtaagctaaaattacagacggacctgcccatttcaaggtacttgctgaacccatgaataaacctactccaatggtccctcctaaagcaattaactcaatgtgccttgcctctaaacctctttttaattctttttcagtttctaccatttatacttcctccttttattaaaattttgaattatacttcccgaaaactaccatttattaccaatcaggttttgcttgtatattttagcactaatgactttacctgtaggggtagccgcaagccctcccagagccgtctcctttaaagatacaggaagcgcccgcccaatttcccccattgcatcaatcacttcatcaaaaggaatagctgaaacaattcccgctaaagccatatctgctgccgctaaggcttgtaccgccgccgcaacattacgctttacgcagggaacttccactaaacccgccaccggatcacaaactaaaccaagcattccttttaaggctatggctcctgcatgaactgcctgctctggagttcctcccattaattcagcagcagcaactgcagccattgctgcagccgaaccacattctgcctgacagcctccctgggctccggaaagagaagctttatgggcaataactactcccaccgctccagcagcgtataacccttcaaccactttttcttcgggaatactatactcttccattaaacttaacagcactcccggtaaaacccctgcagaacctgctgtaggagctgccacaattaaacccatggaagcattggcttcacttacagctaaagcataagtaattgctttaccaaaaacccccaaggctaaatttttcccttcatccagccgttttttatatttaaccgcctggccacccaccaaccctcctaccgaaggttttccggtaagcccttccgaaatcgcctctttcatcactaaaagccttttttgcataatagcaattaattcttcctcaggaacatcccgatctttagcttccaacagcaatgctgtccctcctaaggtttggccaagctttttagcttcattaactaactgttctaccgattcaagatacatagcatcctccttacagcgggggaatggtaaagccaccatttatccctggaagtcttttaatttcccataatgtttcttcatcaaccggctggtcggtttcaatgaccattaacgcctcagcccctttttgctgcctggaaacactcatttgagcaatgttaattccgtgccatgctaaaaccgatgttaccttggcaactgctcctggacggtcagcatgggggaccactaaagttgggtacttggcagtaatttttacaggataaccattaataccggtaattaacactgcaccaccaccgatagaacttccggtaatcgtagctttatttttcgccccagtcaactccatatataccgtattagggtgagcttcgggcagttctatgggcaagaattcatactttaatccccgttcttcagcaatttttaaactctcccgtatccgcgaatcatcggtatcaaatcctaacaatcccgcaataagcgcccggtccgtaccgtgccctcgatacgtttccttaaaagagccatgcaagtagattttcgccttttgcggtacctcccctaacaccagccttcctacttttcccaatctcaccgctccagcggtatgagagcttgacggcccaatcattaccggtccaataatatctaaaatatccatctttcctttcctaccttttcgctaacttaaactaaatctcaatccggttggctacttgtaccaatttatttaaattctgcattatacatccaatgaagtaagcgttggggaaatattgacaaaataatggtgctgttttaaaagactttgaatctcttcaacctgttcaggttcagctgtttcaagctccaattctacctgagccgaacccaatgggacatttatagcttctcgattgtgaattactgataacacgttggctcctgtgctggcaattatctggagtaattggcttagagttcctggcttgtccggaataacggtattcaagaaaatttttctgccatcctttactaaacctctgttaataatgcgtgataaaagatttacgtcaatatttccaccacttataagtgctacaattttactttttttataatgagataatcgatttaaaacagctgcaacggataccgctccagccccttcagctacggttttcgccctttccatcaaaaacaatatagcactagcgatttcatcttcatcaacagtaacaatatcatctacataatgttttacaatttcaaaagttaagtccccagggtttctaaccgcaataccatcagcaattgtggggtggccacttatatttgtaagttgtcctcgggctaatgactctgccatggaaggcatatttttagcttgaacaccaataacatgcacctttggtcttaagttttttatggcaactgcaattcctgcaattaaaccaccacctccgataggcactacaactacttccacatctggtaaatcttctaaaatttctaacgctatagttccctgacctgcaataacttgtggatcattaaatggatgaatgaaggtagcttttgtttctaactgaattcgtttagcttcttcatacgcttcatcataaacgttaccatgcaatactacttttgctccatattgacttgtagcctttattttggacaatggagcgtgtcttggcatgacaatagtggaacggattccataaagggttgctgccagagctacaccttgggcgtggttgccagcagatgaagcaacaactcctcttttcttttcattttcacttaaactcgctattttataataagcccctcttaacttaaatgaaccagtacgctgtaagttttccatttttaaatagatatggttaccagtcatttcacttagagtggtattatacacgagaggtgtcttgtgggcaattttgcctaaaatttcactggctttttttacttcttctagtgaaaccatgaattttcaccttctaatgaatttatttacaagcaacaacttctacttctaccagcgcgccttttggcaaactagcaacagctatgcatgaacgtgccggaaaaacctcaccaaaatattcactgtaaattttattcacagtagtaaagtcatccatattggtaataaaaattgtagttttaaccacatggctaaattccatacccgctgcagataagatctgccttatattttccattgcctgttttatttgggcttcaactcctcctggtacaagttcaccagtctgaggattaataccaatttgaccagagacaaatagaaatccatttacctttatagcctgagaatagggaccaatagcttgtggcgctttgctggtgttaataacttctttcatttctcatccctcttcttataattgtttagatacctatatattgtactttccgaggtttttagatattttgcaagttcggttactgcaccttttaataaaaagaagcctttatcatttaatttttggacaatttctattttttcttcttgtgacaaccgctccggtggaacgttgaactgtttaatagtttcttcaataagggatgacattaagtcttctaaagatgggttcgtaacttccaaaaactcacttcttaaattaattttttgagcttgtttatctgtgtctatattcataataaagtcgtcaataaatttacgtgcttgtaaagcagtactaaggtccacatttacgcataacattccaactaattcaccattatcatccttaatgaaaaaagtagacgaacgtaacggttttccatcttttgtccgagcaggatagttaaccatagcatcttgcgtttgatacaatttttcttttaaaaattttagccctaaatcggtaagcggtcctcccacctttcgcccactaatatgaccgttccgtattgcaataattgaactctctacgtttgtaacatcgtgtagaacaacctcacagtgtggcccgacaatagcagcaatgaaatctaccaaaggaataaatctttccaataacttttccttcaccttatcccccctcagtgagattatttgtgttgttagtaattttgaaaataattttaccttttatgccaaatttttttcacagaaataattctgcataaaaataaaaaatccttcttataataaaaatttttttgcaacttaaaaattagtaatcaacgtattttttaaaattatcaatattatttgcaaaaaaaaataactgcttttgttgtagtagttgctgtataagtgttaccgtctttactgatttcaacacttaacgtttgcccattatctggtgcaggattaaccctaacttccaacggattgtcttgtgttaacagaaagccacctgccaaataagcatctgttggcgtatcagccaagacaattgtagatgttgcaaataacagcaataatgcacccgtgagtctgcacccatgccgggcgcacacatataaaaagcgaggtgtactacctcgccttttccttttaatccatatgttgttcagcttcctgatgtccgtgagtaatgacttcaggattttttgctaagtcctgaagataggtccaagaggcaaaagctaaggttaaaataacaaccccggcaattaacttttcttttaatttcggcttaataccatgttttaccgtaaagctaatcagcgaaataactaagcctgcaggtattaagtaactggcataagccggttcttcatcaaaatgctgaatacccccactcatcatccctatacctaccgataaaaacaatgaaaatagtaaaaacttcaccgtttccgtaccacttaattctcgcctgtttaatttcacctcataaagatatgaggcaatcacgaaaagcactatacctatactcatgatcaaagaatatcgagcaggatttaaaggcatgtggactatagaaccggaaataagccccattccaagaaaataaaaggcataactaaaatacggaaacaaaaccttttgccaggaattttggaaagaatgattgttgatttccatcccgcacctccctatttttttacactaacttataattaacagcaaacttttacggatccttaatcaaaatgttacaaaactactacaacttatagttttaatttttgtaacactttcgttatgttttttaaacatctttttgctaaagtaagcaacagcaaaatctactacaggaggtgataggctatgaaagcagcaacaaaagttctaactcttttagtactgtttatctttattttaggtaacattacgttggccagcggcgggcatgattccgtaactaatgacagctcgatgttctcgggaaatatggaaatgtcaaaggataatatgaataacaacaagcaaaacaccttgtctgcagaaaatacggatatgtcaaatgacagtaccgatgaccaccaacaaagcggcatggatagccatgaagccagcgattctcacgcatcaagcgatatcccttggagttttttaaaagttataggcattttaaatacaggcataattttaactggacttatatcccgttatcttcccgaaagagaggagttgaaaaatgaatcaggtacttaaaaatatccttaaaagccgctggtatccggtaattttccagatcattacattatttttctttagcattgttatttatactctaatcaccggccccgcatcaccccatgataattttggtacagctctcacctgggtgctttggtggccgataatcccgttaattttccttttgcttggtcgcttttggtgtgctatctgcccctttgccaccatcaatgattttgtgcaaaaatttgctggaatgaaacttaaagttcccaactttcttaaaaagtacggaatttggattattgatgcgacctttatcatcataacctggtcggaccacatctggggaatcgtcgaaaaccctcgtggttcaggaatcctgcttcttttaataactaccggtgttatcttttccggagtattatttgaaaggcgtacctggtgccgttatctttgtttcttaggtggtcttgcaggtaactattcccgaacaggtatgctaaaattacgagctaccccggatatttgtaaaaattgcaccactcttgcttgctataaaggtagtaaaaatgcccctggttgcccgttatttgaggttcctagaaatatgcaaaccagcgcaacctgtaatctctgtggctattgtgttaaaaattgtccaaatgattcaataaatatctcttttaaaccccctgccagtgaactttggtttattaaacggccacgccttgaagagtcatttttggcaattgtaattatgggtatcgtttttgtacagaaccttaccatgttagaaatctggcagaaatggcaaaaagctttaactaatattctccacactgatagttatccagtattatttacagtactatttttaattgccatgaccataccagtagtcctaaccttagttgcaagtaaaggtgcctcttatgccaatcgccaaaaaacttgggaaaatttcgctcgctacggttattcccttattcctttagatttagctgggcatatagctcataacctatttcaccttttggctgaaggaaaatcaatttattatacaggtttagcctttttcaccggcaaaaaattagaaggtatgagccctgctattgtgagctcttcgacaataacctttttgcaatataccatattggtattaggtgcaattttgtcgctatacaccgcctggaaaatcgctaaaaacaacgaacctaaaaataccttcaatgttttcttacccttcagtatattaattatcatcttcctcttaataaacatttacctctttatgctcccgatggctatgagaatgtaataacttagaagacttaacaaaaatacccccatatttaagggggtatcatctttatttgggaagatcatttcttccgtaaggcagcgggatatactgcaccgaaggccggcggccctggggttgcggatataaatccataagttcataaatctcccggggcaggtccgtcgacaccggaagtcccagctcttttaactgctgggcggaaatgggatagtcgtgggtccaggttccctgggataaaagcttggccacttcccgggctttttctaaatccatcttatcggacaaaagctccaccaccgtattttccacctgggctaaagcttttttagctatatctgccataatcaaagttctgtcttcgaccttatcgggacccttttgctccaccactttgagaattgatgccgccgggtattcccccagctgcgggtctaccggcccggctaccgcattttcatccatgacgatttcatcggcagcaagagcgattaaagtgccaccggacatcgcgtaatggggaataaacaccgtaactttagccggatgttttcttaacgcctctgctatctgctccgctgctaacaccaggccaccgggggtatggagcaccaggtcaatgggcatatcatcgggggtaaggcgaattgctcgcagtatctgctccgaatcttcaatattgatgtaacggctaacgggaaggccaagaaaactaaacgtctcctgccggtgaatcatggttattaaccgggactttctcttcgtttcaaaatcccggataattttaagccgtaaaacctcaattttttgctgcttaaacattggaattaacgacatcagtaaaagtaaaaaccagaaaaaatcaaaaagagaaactttcaagcctctcacctcaattttcgcaaatttttatttctccattatttatattttattcttttcccaacttcaatgcttcttctatttttccccttatcttcatacatccggtcatccgcaagctttaacaaaatttccaggcttccagcctccaccgggtaagtagccccgccgactgctaaagaaaattcccgctggtatttttttatctttaaggctgaaaagttcttttttagttctgcaattttcttttttccttcctccagccccatcttacggtaaataatcccaaattcatcgccgccaagtctcgcgcccacatcgctctgccggatattttcccggattttttgtcctatcaattttaaagcaaggtcgcccgcctggtggcctaaattatcattaatttcttttaaaccgttcatatctaaaaaaaccaccgtaaacggttcaccgtaacggtcggcatcgtattttgttttattgagttcttcaaaaaagtaacgcctattgtgaagtcccgttaaactatcttcatacgacagtctctccattatctcctgccttttagcctgaacaattgccagagtagcaaatttttggaaaaaatgggcagtatcaaaatcatcttcatcaaacttgacaaaaggacggaaaatgtaagccagaataaatccgtaaagctctccatcggttaccagaggaatatataacacctgtttgctgtgggcaaaaatctctttaattaaaggagtaaattctttatggtgtagcatctctaagacattatttaagttttcaaaaacctcaacacttaacccaaaaactttttctaaatctttaaaataaatcatgcctctttcgggaaacatctcctgaaatttaccgctgctgtaccccgcccggtaagtatgttctccctcttttaagtaaatggcaatcctttcggcttttggtattagctgttgcaacttatctccgtgaatctttaaaatcgcctctaagtcgatttgatgttttaaaagttcttcactcattttggccatttcgcttaaattataaaaataagttattattcccgaaagataaattgcccggaaaagaaaaatatatgccaacaccttgtataaatgaccgattagattataagtatcataaacactcttataaaaagtaaaagctgcctcagaaaagaaagtaaaaataagaaaataccccagatttgttattaacgaaagttttaattcctgtcttttggcaaataccagtaaaaaccccaaaccatataaagtcattaaaaggtgttccaaagaaactttaagggaagtaagtccctgtccctcgataaaaagcgggggaacatattttaaataaaccgtagaaaacaaaaacgctattactatcaacactatgtcggtaaaaacaataaaccagggacggaccacagctcgggtcgatccccagaggtgtaaacttgcaataataaccgcaaaagccactataaaacgtccataaagccaaagaaaagttgccttttgataggaactttccgtaataaaaagaggcatccccttatacgatagagcatgaagtaaatcaacccagcccacggcaaaaaaaagtgaccccaatacgtagagaaaacgcccgcttcttcccgtaagcccttcccgcattagccagaccatactgaaaatcgcaaaagaaacaaacaccgtaataagctctaaaaaagtgtgtatcccgagatattgttcatgactgtaaatccggtacatagtcggtgtaaaatatcgggcaaaagccaggaacaaaaaagccccagcaaaaaccaagaatagttttttcttgtaaccttccaaccgttgttccctcccgcaggcaaactaccagccaccactggccccaccgcctccgccggagccaccgccaaaattatcatcaaaatcatcatcaccaccgccaaaaggccccgttggaggaataaaaatcggtgggtcaaaatccggtccccggtaggaatcataataaccgtacttccgcggtcgcagcaaagcagtgatgaaaaaaaataagattatcagtattacaaaaaccgcaccgattacttccacggaaacacctgattttacccggtataaagcgggattttctttacttaattggtcagggttcactccgtactctctggccacttccgcagctattcgccgaaaacccaaaagaatcccccggtcataatcgccgttactgaaataaggaatcatctcttcccgcaatattcttcctgctttgccgtcaggaatagccccttctaaaccgtaacccacctcaattcgggctttacggtccttaatagctactaaaactaccacgccgttatttttctcactgcttcctacaccccactggcgtaaaacttctaaggcgtactcctcaatcctcatcccttccaaactattgaccgttaccaccgctatttgtgctccagttttagcataaagcacccggttaacccgcaggatttcttcccgggtcgccggggatagtaccccggcgtagtcggcaacatatatatcctgctgcggtttgggaacgatagctaaagccgaagaacttataagaaaaaggagtattactactcctattaggtatttataaattttcactttttgtcacctactggccgaaattcaccttgggaaaagttctggcattttccggtgccttaaaataatctttttccgtaaaaccaaacattctggctacaatatttgtaggaaaagtttttatccgggtattgtattttctaactgcctcattgtaatcccggcgggctaccgtaatccggttagccgtaccggtaagttcatccatcagctgagcaaaccgggcatcggctttaaggtttggataattttccgtcagcattaaaagccggccaactaaattgctgagctctcctgccgcttcatcccgctgggaaacggtaccagcagaaagcattaaacttctggctttagctatatcagagaaaatcactttttcgtgggctgcgtaccctttgacggttgcttcaaggttgggtaaaagctccgccgcccgggctaattggttatcgatttcacttaaattagcatcaactttttcgcttaaagctaccaacgaattataagtagaaaaaccatataccaaaaataatattataatcccaacaactatccaaattaaggtcttctggttcatcactctacctccacattttcgttttctcccggacttattttacattaccacccaaaaactttcaaacttttggtggataatgtaataaaattttaacaattaaccgcaaagaagttaggagcatcctctaccggtatcttaattttatgcaaccaaaccagttaaagattctttttttccaaaagaaaaaagtggtaaaatattaacagtggtcggtggttagtggtaggtcgtcgaccaccgtttgtgtagagtcgactcctgtcgaccgaactttttaaaatttcaaagcatttaaaacagaaaggtgaagggtgaaaaatatggaacacttattaaacgtaattatcggcatatttgtgggaatgatcggtactttaatcggagccggaggaggctttatcttaatcccctaccttatcctggtggcaaaattttcaccccagaccgcagccggtacctcgctgtttatggtattttttaatgccttatccggaagtatcgcctacatccggcaaaaacgagtggattttcgcaccgccttttactttgccctggctaccattcccggggcaatttttggtgcctatttaaacagctttcttcattcgcgcctctttaatgtcctgtttgccttactgttattttttctggcagttcgaacattttttcataaaacctccaatgctaaaaaagaaaacaaagaaacaaaaattcccgggcacgaaacccgggaaattattgatgccgaaggaaataaatatgaatattcctttaacctctggcttggtatcggaatcagtttaattgttggcattttatcctcccttttgggtataggaggcgggataatccatgtcccacttatgggctttttgggctttccgatgcatatcgctaccgctaccagccattttatcctggtaattacctcattaatcggggtgatatcccatattagctacggacatgtggtctttgccaaaggtatagcctatgccctgggagctatcattggtgcccaaataggagctaaaatttccgctaaaatttccggcaatgccatcaaaaaagggctatctatagctttagccctggtagccataaggcttcttactctttaaacagctttttccctgacttttatattttcttctattatcttctctgccttatctgccagggcatctatcgcttttcggcttcgctctcccggccggcttcttttctcaccggcaagcgagagcttttcttctctaagcacatccggtaagtatacttcaaaatcaaccttgccgcctttatccaccactgccttcgtggcacaccggtctttacagccatttagcaccaacaccggataatcattgataaactcaatatcttcctgaacgccggtagccagcgctggaagacaaaccaaaacggtattatccggatataactcttccaccaatttatacgctgcttccctcgttatcaccccaaaaatctggccaattcccgcacagggggtaacggcgattttttcgtagtttttcatgtttatacctcctcaaatagtgttcggtggtatgtgatctgtggtagggaaaaattaattcgtaggaaaatattttttacttaatattagtattttcgtaattcttttataatattattatcaataattttccctgtcaaggtatcattcttttaaaaccaaccatgcccccacaataataaaaaccgctcccaaaatcgtctgccaggaaaaaggagtttttgccagattgaatatccccaggcggtcaattatcccggcggttaaaagctgcgctgctacaatagctgtcgttgctgctgccacccctcctttaggcatcgcaaaagctacagcataaacaattaccacccctattaaaccacccaggtaataataccagggtccttgaaaaaagctacctttctctttactaaataaaacaaaaagggccgctccgattgccccaacaatatgtacaataaaggtagtcttggcaaggcctatggatttacttaaagcactgttcatggaaccttgaatagccattgccatccccgccagagcagctatcatgtaggctaaaagtttcccatccataagtttagacctccgtaaattgcggtaagtggttggtgctcctaacataaaaccgtggcttttgccacggtttacatggtgggacggacccggatttcgtttccggtttgctgcaccagcggaacctgataccagcccttttgggacattgtagtaaaaagcttccgggcattatttaacttatcgttatgggcctgcattaaagtattccgcacctgatcggaataagcctccattaccgccgtgtgatacatggtagataaaaatttttcaaaggaaagaatatccgtaatcatgtcctggtctttaagcatctttaccacctccttagtgcatggttatacctgcctgggaaagcaaactgttaatgcttgaagcatgctgcgaacagttgctggaaatctggctaaaaagggattttaaagacgggtcactggcgttctgggcataaaaggaagcccgggctgcctgaagcccctcaagcttggcaagctcctgcaagtaaattagctctttttgggaaagctgcataaaaaatcacctcctcggtttttacttttcccgagaaggttttgatttattaatggtttatttttccatttttacccaaatttataactcaccccgaagccaccccggggatagcgccattcgatattgttaaaaaggcagccgtatttgcaggtaccgcactccacacagccttcataggcaatcataatccgctcactttccttatcccaggagtaaaccccggcagggcaaatgtaagtgcagtacttggcatcacatttttctttacaaattttggggtcttttattttaagatgggattcattgtccggcacaaaccggtttaaataaagcttatccattaaattcatcgaatcaaccccttccagaaaccataagcatctttcaccatctgccagaaagacctcttagatagcgctttttccttaattgccttaaacttgtcccgcttcggtactccatctaccataaacagttcaaaaaaggcctcatccatcatatcgggataagtggtcatcaggtcgtggttttgttctaagaaatctttggcatttttatatttttccaagtctttcataacaaagctttctcttaaataatcttcatatacctttaaagtattagcggagaaatccccctggcttgccgccctgattatcgcctttgccgccaatgctccggaagttatggccaaattggaaccttcccggtggatggagtttaccagcattccggcatcgcctacaatcacaataccatcaccgtaaagtttgggtatccctttatagcccccttccggaattaagtgggcaaggtactcctttacctcgccgtcacgcaacaaaggcttaattgccggatggtttttaaacgcttcaattaaatcattggggctaatccgtcttttaataaggtcggacattaaagcgccaaccccaatggaaagggaattctggttggtgtagataaaggctgttcccaccataccggccgttgctttgccgaaaagctcaatcgccactccttccccgggctcgatgttaaaccggtcctcgattaccgaagctgggagcccaattacttcttttaccgccaccgccaggttctgcggtggaataggcttttgaaaaccatacttttgcgctaaaagggagtgggccccttccgccagcaccaccacatccgccagaacttctccttctttccgcccggcaataactccttttacttttccgtctttgacaattaagtcttccaccaccgtttcggtaattaaaagtgctcctttttcctgaacttttttggctaaaaaccggtcgaatttcgcccgaaagaccgaatatccgctaatgtcttctttataccggggatttcgataggaaaatccaatttttgcagtatcggttaaaaaataataacgctgttcaattatcggtcgctccaccggggcttctttaaaaatctccgggaaaacagcttcggtgggctttttataaataatgccccccataacgtttttggcgccgggaaattcgccccgttcaattacaataactttcagtcccgcttccgccagtttataggctgccgccagtcccgaaggtcctgctccaaccaccactacgtcaaacttttcgggcatttaccgcacccccctttgtcctgccagcacccggcgtgcttcttcggtaattgccggaagtacctccagtatatcgcctacaataccataagtagcaatattaaaaatcggagcattgggatcattgtttatggctacaatcacctcggacatttgcataccaaccaaatgctgcactgccccagaaataccgcaggcaatgtacagcttaggccgtaccgtctgcccggtctggcctatctggtgagcataaggaacccagcccgcttctactgccgggcggctggctcctactactcccccgagaacttcagctaattcctccaccagccgaaagttctttttacttccaagtccccggcctccggcaacgatgatttccgctttatcaagataaactcccggtcccttttcctcctcgtacttaattatccgggtcggaacttcctcctctaaaatcccaagctcctcttccactaccacaccaattctgggcttaggttcgggcaggggaaatacccggggacgtacggtagccatctgcggccgggcggttttgcagagaatggtcgccatgatattaccgccaaaagccgggcgggtttggtgtaaaagccgggttgttttatcgatcgaaagctcggtacaatccgccgtcagccctgtattaagccaggtcgccaccactccggctaaatcccggcccaaggtagtcgccccgatcaagataatctcgggcgtatatttttgcgcaagcttgacaatgcctttagcgtaaggatacgtccgataatccttcagaacagggtcgtcaataaggtaaaccttatcggcaccgtagcggaaaagctgctcggcaaaatccctgacaccatcacctaaaagcaccgctgccagttcggtttctaaatcatcggccagttcccgtcctttgcctaaaagctcaaaagtaaccggagcaatttctccgcctaaatgctccacaaaaacccagacgccttgcgcgtgcatccaaccaccaccttttaataattgtttgggcaactcccattgccatctttaagccggcaggaaccggcccttttatttattagccactaacgttagcggtaccagcttctctaccagagctttggccacttcttggggactgccggttagcatctcaactttggcccgggctttagcctggggcacaaaacttttccatacctgtgttggtgagcctttaagtcctaaaaaagcttcctccacgtctaattgctctttcccccatacttccggctggtaacgggcagcacgaatcatatccggcatagtagcgtaacggatttcgtttatcccctttaacgccgtaagaagcgccggaagctttgcccgcacgtattctttccgcccttcaattttccttaccgccactacatagccttccacgggattaaactcctccacccgctcaatgtatgtaattaaagccatattaagccgggctgccaccccgggacccacctgcgccgtatccccgtcgatggcttgctttccggcaaacaccaaatccaccggttccgcggaagctattttctcaatagctttggcgaggacataacttgtagccagggtatccgatccggcaaacttcctgtcggtaagtaaaatcgcccggtcggctccataagaaattgcttttttcaaagcctcggccgcctgcggcggacccatcgaaaccaccgtcaccttaccgccgtatttatccttaagccttaacgcttcttccagggcgtgggcatcgtaggggttgataatagatggcaccccttcgcgaattaaagtgttagttttggggtcaatccgcacttccgccgtatcgggcacctgttttagtaaaactaccgcatgcacaataccacctccagacgtttatttttagtttacccaggattgaaaatttttctgtgagttagcttacagttttggcaagtgttttttattttatttttaaagtcaccaaatacccatcctgggtttgttccttttggtaatctaaatttctataaccttcataccccaaccactaataattttattttatttagaatataacattttataattttatttgcaataaaaaaaaaccgcctaccacacggtagacggttctctatcagtttaattattcggatatctaattatccggccttcccagttgcgtaaaactgcttcttcttccgagagttcaattaaatactggggtaaaagcggaattttcccaaagcctccaggcgcgttgacgatataatacggcactgccagtcccgaggtatagccccgcaagctttccattatccttaatccgtcttcaatcttgggaacaaaatgcatcgttccccgtaccctcttcgcctggaagatatagtacggccgtacccgaatttttaaaagctcatggttcaatttctccataattacgggattgtcatttaccccttttaaaagcaccgcctgattacctaataccacccccgcttcaattaatttatccaccgcttttttggcctcaggagttacctcccggggatggttaaactgggtattgatatatatcggcgggtatttttttaatattttaaccagattatcggtaaccctttgcggcaaggtcaccggtacccgggtaccaatccttttaatttctacatggggtatttcggaaagttcttttaatatccagtccagctccaaatcggataagagaagtgcatccccaccggtaattaaaacatcccggatttctttatgctcccggatgtaaagaagggcttcttttatctgctccctgggagttttccggtcaacctcaccgatatttcttcgccgctgacagtgacggcaatacatcccgcacatattggtaacattaattattaagcggtccggataacgccgggtaaccgccgccaccggcgaagtccccgcttcattcatcgggtcaagttcaccggtatcatctaaaacctccaaaatggaaggaatcgactgtttcttaataccgcaatcgggatcatcgggatcaatcaagctcaaataataaggcgaaatggcaaagcgataaaccttactgacctcctcaagttcccagaggacctggtcgcttaaaggcaaaatttttcgtaaaacttccggcgttgttatccgatttttcaactgccagcgccaatcctgccagtcttcttccgttccacctaatacctttaaaatcttctctttttgttttaaaattttttcccaggcttcaaatcccgataaaaccttttttctttcccttaacctactacgaccaatccgggtaagctctctttgccgtttcaatccttcatctttctgcgaaattcttgctctattcatgtaaatccctcctttcaattcagagggagcacagaaaaaccctccacagggggagggtcaaaaaggcaaaaaatatccattttgctcccccttcgacgcttacgaggttagctgacgggttcgggcggaaggagtcgccctacctgaaaaggattcaccccaaaaagtggttcccccgcttcccgtaacgggaattcagcgtttggttaatagtattttaccaagtaaaataatttttttcaagattcttgactattttgtaacatattttggtgatattagaaaaatttaaaccacgattttttcttttgcctttctccttgtatttccaaagtcaccggttcgcaggattttccctcaaaaaaccggcggttattggtaaatacttccggtttaagatactcctctaaaaaccttatactccctggaccgtgagcatcggtgccgaccaaaacccctttttctaaaaaccaccgggcactttttcggcttccttccccgaaataccctgataaaagggaagtcaggcttacctgaaaaacaacccccatatccaaaagctcctcaatttcttcccggttctcccgtaaataccggtaccgctccgggtgggcaatgatgactttattcccggccccgattatttccgctaaatagaaggtaagccagggcggtttttgcgttagcggcagttcgattaaataaatccgttccccttttaagcccagcactttacctccggctattaactccggcagttccggcgtaagataaagctccatccctggataaactttaagcccaatcccttccgcccccagggcctggtttaacccttcaactttgcggattacttcttccggctttagcggagctccttccgccataaagtgcggagtcgccaccacttcgctaaaacctactttcgccatttcccgggcaagccacagggaatcttcaagcgtctttggcccatcatctactccgggtagtatatggcagtgaaggtccagcattttaagcctccttagcagctcacttactgtttagaaaaatctgggttataattttacaattttccccacttacatctcttggaattttcatacagctattacctcatctttaacaatatgcaaccgcattattttatccctaaacttttattaaagaactcacagtttctttccttcccggtaaactttttcaactaaacttgccggtgcatcttcttctaatactatatgtacctggaaaggtaccgctaaatccacacattccgctaccagtttaaaaaaactgccctcaattttcccggctataaaaatatctatatccgaaataggggtaaaaaaagcattttcatcggccaaagaaccaaataagtaaacatccttcactccgtacttttcgcggataaattcagctatttcttgagctttactcaaagcttcttcccgtaaaatcttctgctcttcttcctgccttttctgtcgcttttttaaccactcccgctgttcaataatatctttttcggaatagggaaccacactgctcactccctatcggcaacacttttttgcaaaaactcgataaattcttctatctcagcaaaaaataaccttagtgtatccggcaactttattaataaagcaaggattttttcttcatttaaattaaatccataaacatttcgaaatacatgcctaaagcctcttaattcctcaagcttttcccaaagttcccggctaataactctttttcgtactccatcgatatccagcgccatctgcaggagaagttctttatgccagttttctgacgctggcacctttccgtcaaactcccgggcaattatcttaaaaatgttttctatacatacataaatatcatgcaagatagaagccactgccctgataataaagctatccccgcttaaaatcttttttaaatttttttgtccagaataatatcctttttctatgagttcatcttcaagctttttaatattttttagctcttcctttattctcgctgaaataatcatgatgtcccgtggcgtcatttttacccctccgcttttatttactttaattgtatcttaactcaccggcccttacaatcagcactgttaattttttctattttccttgacctcttatatacccaaggataaaattaaattaacaaaagtaggcaaaaattatgagtaaagctttgaactctaacgtttttacctataaagattatttaaaacttccggaagaagagcgtggtgaacttattgatggccaatttttctcaaaagcttacgcttctccgtcacgcctccatcaaaaaacccttttagagcttgctttgcaaatcggtagtttcctaaaaacaaaagaaactacctgcgaactttacgtagccccttttgatgtgattctggctttagaaaatgaaaccattgaagacgttaaaaacgtagttcagccggatcttctgattatttgtgacccgcaaaaacttacagaaaaaggttgccttggagcaccggatttaattattgaaatagtatcccccacatcctatcgcctggattatgtattaaagttaaacttatacgataaattccaggtaaaggaatactggattgtaaatcccgaaacgaaaacagtattaatttaccgtcaggataatgaccaaggttttggcgagccggaaaaatacactatcccatcattcgtatcttcttctgttctgccaggtttaactatctcaaccgagcaaatatttaacgattaaaaaaacaccggcaattgccggtgtttttatttccctaaaaaccatttggttattccctgggctaaagccgctgccgctttagtccggtattccggggtagaaagtttcttctcttcttccgcattagataaatacccaacttccaccaaagcagagggcatttccgtatatttaatcacgtaaaagccctgattggtataaattcctttatttttgctattcagtacctcatttaacgcaaccatgagattatccgccagggctttttcctgtgcttgattgttcgggtcaggataataatatacttgagttccgttagccgagtaatacgctggcgaacctacactattctggtgaatgcttaagaataaatcagcggataaaccgttggcgtattccacccgtttgcttaaagtgggataagtgtcgccagttctggtcatataaacagtagctcccagcgcttccaggtaacctttaagtttaagagcaatatctaaatttacatccttttctttaatcccatagacctttcctatcgtaccggggtcgctaccgccgtgaccaggatccagtacaatctttttccctgaaagtactggttccgggaaaattcttacattgtaccccccattaattttctccaccgtaaggttcagcggaacaaaaccggcaaaatttaccactacatttccattttccgtagctgtggttaagctttttaccggaaaacttaaatctggagcagtaagattatcgatttgcccattctctaaaacaattttggccgttaatttatcgtcacttaaagtataagtaagattggccgtagtagttatttgccaggtcagcgaagcaggtgccgtttcacctttaatctgcaccggatgtaccggttctaccggagtatcgctaaagtaagctttctccgcccaacctatctcacggccagccaaagctaaccggtaccagccgtctttttcctctaaaaccccaaagctcttttccccggaaattgtcgctttaactccggtagaaaaccccgcaccgttaaaaacatttacggggtcaacctgcggataaacggtttttataattcgaagcccatccccgcggctggtttctgccacataaggaactaaatacgcttttgcaacccagccggtagtacttcccgctttaaccttcatccagtcaccggaaacctgcagtccttctacctttgtcccctgcggcagggtctttatcacgctataacttgttcccggaccggaacgaagatttaagctggtagcttttactgcatagactccagaaatcgtcttaatagaagtattagtactgctctgcggaggagtaggggttgtcccccgggaagtctcggtaactttaatataggtttttaccacccacccggcaatactccccgcttttatgtaataccagccgttttgctctttataaatttccacccgcgtgtttttggccaatttaccggctatcgccgcagaagtactcggggttgttctgacgtttaaaatggtagctgtcacaatcccggtgcgagacgcttgagtgctccggctactccctactaccggactgatatatttgccggaaacatatccataaccgtttttataccggattttaaaccactcacccgtttttgccgtaatttcaactttttgtccccggcttaataccccaatctttgcataattaatgcccggaccagaacgaacatttaacgtcgaagccgtcaccactccgtagcttgcggccaatactggcaggcggaacccaaaaaatatggagaaaaggaagaccaaaagaaatgccagagcttgtccgcgaaggttggagcgacatccctttctcactttttcacccgcctttttccattaatttatcaaatcttgtaaatattataacaaagtctttacaatttgtcgaacaaaaaaagccccaaaagggcgtaaaatcagaaattacagcacataaccccctgggacttgtcaaaatcctatgttttttgggtagttttatggtttttccagtttttatccaaatttgagctatcccgacattacctgtcgacggaagtcaatcgtgggtggaaagaatcaccctactcttcaaaggttatcgaatggagcatttccgcttcataataggcttccgccgaactatcttctacatgcttgggtagaggtgcttcctttaagaaataatcataaattataccatacttttcctggtcatcccaggtcacatccacatccagccacttaccgttaacgtaaaccctgttccaggcatggggctcaccatcaccggtaccgatcacaattttagtgggaattcccgctgcccgagcaatagctgcaaacaagcggctgtaatcctggcaaacaccggtaccggaagccaaggcttccgaagcagttttctgaggcaccaccccaagccggtagctggtccaatcataagccaatgccctggctacataatcatgaattgcctttactttctccaaatcactggttaagtccttggttaaatcgtaggcaatttgccgaattgtaggattatcgctatcaacaaaaccggaaggtaaaagcgtcgacttatcggcaataccggttacgtttaattttatcactttttcaatgtaaacactgctgccccacgactgcttgtaaaatagcaggtaatagctgccactcccgtaccggaaataaagcttctcgccacttatattggaactgttaaactcctttattgcatatattttcccgctaccggctggcttatagccaaagtcggtactaatccccgctggaataccgctaatttgcagggttccaatttcctctccgggttttaaattaagggtataggtattgacatcgggatactcggaaagcttccggtagtcaaagcttaaaacacttcccggctttatctcttctaccggagtattcgagctatcccggcgaataatttttagggatttaacggtggcattaccaaagatatcaacagctttaaccgttacggtattttcaccgggattaagattaaccttagcaaccgtctggtaataccaaaccggtgccgctaaaaggtttttcccgttaacctctaactttgctacccgggaaatatcccaagcagtgatttttaaatccgccgtagaattagtcaccaccgaaggcgctgttaccataagcaccggcggagttttatccaggtaaacaatatatacccggcgtaaggtatacttgcctttatggtcaaccactttaacggtaaaaatattacttccggcttttaaattcacctttaccgatttaactatacttttcgtacccggcaaagcataatggtttttattaaccgtcagatactttaaaggattctgtccggaagcctttgcggtaatggttgccgacggggaataaaccacctttggcgccacaacagtcagggtcggggtgtccgccgctaacgaaacagtgctaaatacggtaaccattaaaaaggcaagtagtaccagtactcctaattttcttctcaccaccaaccctcctttcgcaattttttctattatcctaagtatattataatctttttgacaattttctgcaaaaagaccctctctcaaggaaaaaagctgtagaaaaaactacagcttaaaacgcttctttatccacccaaagagagaaattttctaagtttttgagaaaatttgccggttgatttgcttcccctgctaaaagccttttcaccgcttccttcttcctgcttccagtagcattgtaaacgattcttcggcttaattatttgcgaaaccttttagtaaattgactttagtaagaattttcaatacaattaaactatcaattgcatacaatattcttaaaaaggagggttttcatgttaaaattacagaagctccgttttctggcgacagtcctggtcctggctctaatctttagttttgtaaatccaggattagccgctatctttgccagcacgccgaaaacggtggatttactggaggtcaccgacttccacggttatttaaagtacgacacaactttaaacggccagcctttagagcagaaaatcgctgcagtcttagctaaaaagctaaaagacattaaagcctcaaaccccaacaccgtcattctctccggcggtgatatgtttcagggaacccccatttccaatgtcctcaggggtaagccggtagttgagtttatgaacaacgtcggttttgacgcaatgaccctgggcaaccacgagtttgactgggggttagacgcggtaattgattacaacaccaacaccattaaaggggcaaaattcccgcttttagccgctaatatcgtttacaaagctgataatacgcggcctccctttttcaagccttacactatcattgacaaaaacggcattaaaataggggtcatcggtcttgtctctaccgactttcccaacgtcatcatgcccgcttacatagcaccctttaaaatcttagatccagttaccaccgccaacgccttaattcccgaggtcaaagccgccggtgctaacatagtagtgatcttagcccacatgggggcgtttgactccacccttaccaaaaccgatatcccagataatgagcttattaaccttgccaaaaacattaacggcgccgatgtaatttttggtggccatacccataccattatcgccggcaaagtaaacggcatcccggtagctgtagcccagaacaacggtaaaggctttgcccgggtaacccttactttagatgaaaataataaaatagtcgacagcaccgtaagttttgtaagtattgtcaatgactacaacacccagacgccggtaattgacccggaagtaaatgctatcgtggaagccgccaaggcagaagttggccccatgttttccgaggtaatcggtagagcagcttttgacctgacccgtacccaaagtgccagccccttcggcgactcgcttttgggtaactgggccgccgacgttacccggaaaaaagtaggggcccagattggctttgccaacaacggtggacttagaacagacttaaaagcaggcaacattaccgtgggggatatctttactttaatgccctttgacaacactatctataaactgcaaatgaaaggttccaccattaaaaaagttctggaacaagcggtcatggatgggggcaaaggtattcaggtagccggacttaaatttgaatacctgcccactcttcccagcatgagccgggtcaccaaggttactctggaagacggcacaccccttgacgataatgctgtttacaccgtcgctaccaacaactttatggctaccggcggcgataacttcaccgcctttaaggaagctgtttccgccgaagatacctttatcctggtccgggacgcttttatcgaggacatccggagtaaaggtaccattacctcacagatcgacaaccggattaaaccggcaaccgatatttataaaatttccattttagctacctcggatttgcacggaaatattttcccgctggattactaccaaaatataccttacgaccagggattagccaaagtttatacttatgtcaaacaagtgcgggcccagaatccggtaattttggtggacaacggcgataccattcagggaacacccttaaactactatttcaatatgatcgataccgaatcggaatatcccatgatgaaagccatgggctatatgggctatgatgcctggaccctgggcaaccacgagtttaactttgggctcaacaccttaaaccgcattattttggatgccaccaatgaaggaatagcagtcttatcggccaatatcgtctgggccaaagacggacggacttatgtccgcccttatatcattaaaccggttaacaccccctttggtacagtaaaagtgggtattcttggccttaccaccaagacgatccccagctgggaaaacccggctaactacaaaggtcttgaatttaaagaccccattgaaaccgctaagtactggatacccaggatgaaagcccagggagccgattacattatcgtcaccttccactccggggaagaatcggctaccgatgtcatcccggaaaaccaagttaaagctctggctaccagcgtcgatggcatcaacgccatcgttgccggtcacacccaccggaatatcggcatgaatatttacaccagcccctcgggtaacagggtaattgttacccagcccgaccgctggggtcgctatgtttcccatattgaccttatttttgttaaagatagcaacgggaactataaatttgccggcaccacttccaaaaccgtaaagatggacgccaactaccctgccgaccaggaacttttagccgtaatgcaaccctaccaggataaggtattagcttacaccggcaccaagattgggactgctgccggcgatttcctggctaccggcatcactacccaggatacggctttaatggacctggtaaatgaagtgcagcggtattatgccaaggcagatctttccatcgccgcacctcttagcaccactgctaagatttacaaaggggatatcaccattcaagatatcatgtcgctctatatctatgaaaacttcctctacggtatcaagatgaccggaaagcaattaaaagactggctggaatggtcggcccgttattataaacaagtaacaagtcctaccgatccggtggtaaaagacccggtttacaatatcccggactacaatttagatatgctccatggagcaacttataccatcgaccttaccgctccggtgggacaaagaattaaaaatcttaaagttaacggcaagctcgtcaaagataccgatgtctttaaagtcgccatcaacaactaccggtttaacggtggtggaggatttatggcggcagccggtatcagtaacaccgaccccagcatagtttattttgactcggccaaggaaatgggtgacgacggacaaattagaagcttaatcattcgctatatccaggaaaaaggtacgatcgtcccgaaagtcgataacaactggcgaatttctaccacaccggtagaacaggaaaaagatgtcgaaattaaaccgacccctaacccagcaccggcaccccagtacgcggtggtaataaacttaagagcatacgtcaaagccaatccttctgcctctgcccctaccgtagcggtagttagcggcggcagcaggtatcaaatcgtagttaaagatggttcctggtacaaagtaaaagtaggctccatcttcggctacattaacgccaaagatgtcctggtaaccacccagcccgagaaaatcgtggtttataaaaaagtaaaagtaacctctaaatccggcgcctatatccgggataaagcagtagacggcaaagtcatcgccaccgtccgttacggtaccactttggaagttataggttttgccggaaaccgctacaaagtaaaatacggtaacaaaaccggctacatctgggaaaaacttgtaagctaagcgcttaaagcattaacgcctctggtcaaggctaaggccagaggcgttaatatagctatagcttatatttccctatttcctgatttagttcctctactaccctgcccaattccgttatattcgctcccacttcttccaccatagcggtggtttcctcaacgaatgaagacgtttccaccgctgtgttcgctaaatgggtagccatattttgcatttgcccggttctctcactgattatttccgctccatgccttaattctttggctttttccgaaaattcccggtagttttcggcggtttgtctgaccacttccccggccttgctggcgtctttgccaacctcctgcaactgccggtgtatgtttaaaagttcctcctttatctcatttgccttgtttcttgtactgtcggccagtttcttgacttcctgcgccaccaccgcaaaccccctgccggcttctccggctctcgccgcttcaatggcagcgtttagcgatagcaggttggtttgctcggctatttcggtaatgaattcggccacttccattaaagcgttgctggtttgagccgctctgttcaccttggttatgagttcttcgatcctcttaacggtttcctcgctggtttgccgcccctcttcggattttttctgaatatagcctgtttctttaaccgcctgattgattaataccgccagattctcggcggtttctttcaactgttcggcaatgctggttacgttgttaaccagttccgcttcccggattactccggtgttgatttgttccaccgcccccagtatgccttccatactgctgttaagtttctgggtttcctgctgcattaacgataatatgcttttatttctgctaatcatggtgttgtaagccttaactaaatcgtccagttcatccctgccaaacatagctttcctttgaaaagcgtcagcggttaaatcccctgaactgattacatcacagtatttggttagccgtttaataggctcaaacaaatccttgataatttgccggctaaaaaagatcaaagctcccagcatcggaataaacatggcaaccataagcagaagtacgttgtgagttgcttttttggccgcaccgtgtaaaactgcaaggtttccgtggctaccaaactggttaacggcatttaccagcccaaaaaagataacatacccgaaagctatacccacgaagatgatggcaaagatactgccaaaggcgataaaatattttgtctttaaagatagatagatatcacgaatgtttgtaatccgcgtcaacttttatacctcctttaagtcttaaaatattttattaaattagcaaaataaaggaacattttcacaaaaaaattgaaaaaaaaatacttttctgcttaaaatttttcgacaagaattaaacttctcctgcaatactttttaaaattttcgttttaattgaaaaattagtaacgtaattgaggcctttacccatcctacttatacaaggcgataattttagacaccttcccatcgcagctatcttaaaaccgctttaaattgttaagaaaatatgataggattataccaaaagcataaaaggagcgatcaaaaatgcccgacgaccgtctggatgaaattaaaatccagataaatcaaatgtcttcaatgttagccgaacttattcatatggtcggccgtactaacggtgctgttgaagaactacgaagcgacataaacgaaatgagaaaagaaattaatgaattaagagctgaagtgaacgaattaagagctgaagtaaacggattaaaagctgaaacgaatgaattaagagctgaaatgagcgaattaaaagctgaagtgaacggattaagaactgaaatgaatgaattaagaactgaaatgaacgagatgaaaaataaaattactactatggaagataaaatcgcagctatggaaaaagatattgctgaaatcaaggccacccttcgcgagcacaccgaaaaacttgattttgctatgtttaaactaatcaatcacgaagaacaactttttgccatgaagcgaacaaattggaaataggccagcttgtgcataaaattcttaatcctaagaaattaaggttacccgcacaaaaatccccggccttttaagccgaggatttttactggttattaatcaataccatttttcactaaaatcgttaaaaccgcttaccgcctcgtaaaaataccagtcaacggtatacttgccattattgggagttatatattttgccggtaccaaattttcggcaggcatttggtcaaggtcctcatacaccctgaaccaaacatgaaaagctgggatccccaaataattagaaaacttttcggttaatgttcgggccaaaatgctccaatcattattaaaatctgcatttacctgatgatttagataaatttttaaaaattgctggtaattaacaacaacgtcaattccgtaatgaacagcgccagtattctcatctacccaggtgccattttcatacgtaaccctgccaaaatttgttgaaccaattattaaaggatttaaataatcgtaattcccttcatttaaagttttgaccagctcatcaatccctgcctgaaaagtttcatcactaaagacttccgctaacggagcattgaccacaaaagcggtattcatattctgcacaaccgtattataggaaatagcaaaattcagcccttcgcttccattgagcttcatgttgattatgcctattacttcgcccttcatattgaaaagtggcccgccgctattgcccgggttaaccggagcagtgatttgcaggtaagatttgccgtctatttcccgattattgctgctaactatgccgcttgccatactccagcttaaaccctgaggattaccaatggtaaagacttgttcccccacctcgggaagtttggtagttaacgccaccggttttacatttcgggcattgattttaattatggcccaatcattttccggatcatatctttctaaactgacaacttcatattgggttccattggctaaggtaacataggcttgcttttctcctttaataacgtgatagcaggttaaaatccgtccgtcggaagaaataataaagccgctacccaggcctgaaccggtagtgatcaaaacagtactatcctttaattctttaaaaagctgggttaaagttttaggcttaacctggatttttatggatttataggctgcagcttttttgctgtcgtaaacttttagcttaattgtgaaatatgtatcaccggtaaccttaggggctgtccaggtaacttttgccgccctggtactgctgaactttcctttatccgagctgctaccgcttaccgtccattcataataaactttatccttatttttatcataggctttggcagacaaggtgatgctttctccggaagtgactaccgttttgctggcagaaatagttagtatttggggcggatagtttactgttttagccaaaactgggcgataattaaaaagaaccagacttaataaaaaaacaacgataaattttcccagggatttcatctttaccctctctttctttaaaatgctttttttctttatcattctctaaagttagaaaaattcctgcaccttttaaacaaaaaaggccagggacttttttcaagtttaaagataagttttaacggcaatgttcctgccagtgttagttttgaaatttttttcgattatctttttcacgttttctttatttttatctaacccatcttcctcgatgtttaccagaaggtcagcttcccagatgatctgaaaatcaagtccatcatttttttctgcggtatgatggccccctatgatatagcaaaccctttcaataatgcttttatcttcgttatttttaaccattatttccctggcaattggcggcccttctatttcctggtatttaccggcagaagaattgtatttctgttcggcaacaataatgccgatatcgtgaagaatagcagttatagtaatgattttctttaaatcaccttcaatattttccccttccattattctttccgcataattaagtacttttagggcgtggttaatacgccttgtatcatccccaaaatagttcttcatcgcttcaatatacttttccttgtacatattatttcatccccctttatcccggtcgtccataccgtaaaaattacgccattggggttggcatttatatacttgtcctctcaatctatatttctataataaccttatccgccgctattgtacagacaaaactgcttttccttttatcctgctgaggatatctaaacaattaatctttttaactcatcaaaaggcaaaaaattaaaggctgttaaccttttgccaacagcctccgttttaatctcattttttaatctttgccaatcgcaaataccttcccaggcaatttacactctaaggttggtttaagatgaaaaatttctcattactataaattaaaaggtcaaccggaactttaacgttggggccatacacttaatacgcaaatacaagttttaaatcaacgataagatcgtcaaaaatggatactctgattacatcatcatccgtatatatctctggtctgccataccttttgttggcttgcaaagtaaatacacttataattttgctgtcaggctctactatccaatattcttttacaccaaatttttcatataaattaaatttttctacttcatcttttcttgcggtagatggagatacaatctctacaattaaatcaggagctcctttgcatccctcaacatcaagttttgcttcatcacataccaccactatatcaggctcaacaacagtttttatatcttcatcatttttttcattactggaaggaagcctaacaccaaaaggtgcatgatagaccttgcacggcttatctttaagataattgtaaaactgattaaagatcgctcccgaaatttcctggtgaattcttgacggcggtgccagcaaataaacctgtccatcaattaattcaattctttcctcttccggccaggtcaaataatcaacatacgtatatattttatcttttttgggtaatggcatattgccgcctcctgttccaagcttttaccccaccagcatcagtatatcctgtgatactattatatagttaatgttaattttttacaatatgtacctttcgcttggccacagtcgcacaaaaaaccccagctttgctgccggggatcaattaacgtgagcagtaacactttttaattttatttttgaattttcattaaaacaaagttttttattctctcggcacttttaatagcattttcagcatcaaattcctctctttccaaataaaaaggatagcgagcctgtactccataatctattaattcgatacaatcatcttctatcttagaaaattcagggtcataaaatctgtcccccgtttaaagcaataaatccttttaaatatttttctgcactctgctggcaatgataacaaataatattacttggtttagggttcatattcattaagtattttgctacatttaaatcactatctgcaaaattaaaccattcgaaggcaatatcccaattatccataaattttaatgccttcccgagcaattttatactctaaggttgatttaagttgtgaacgctttaaaaattcctcattactataaattaaaaggtcaaccggaactttaactgttggggccattaattttctaactttttttaaatattcccttttattattaatcgaatccttagtaatgatacaaacatcaacgtcactttccgaattaggtgtaccataggcatgtgatccaaagatataaaccctttctacatcggcaactgactttgcagcttcaataatttttttaatttcaccacttatttctataaccatttattatcaccacttcattatctttctttaatactattatatctttagtgtaaattttttacaatatattttatctcatgttgtgattatcattggagaatgccacaagatgtctttatgcttataaaaacttgagctgatattgtttcaaaaaataaacggtaggagacagcccgttctaaaagccccgggtaattccaggactttctgtattttccgacaatgtcttgacacgtgtatatatacgtattataatttactcaggaacaacttattagaaaataaatcttataacgctgttgatatataaatttccagggagaagttaaatgaaggcatattcatcaagggaaataatagaaatacttaaaaatgatggttggtttctctatgaagttcggggagaccaccatcaatttaagcatcctgtaaagaaaggaaaagttacggtgcctcatcccaagaaaaatataccaataaaaacagtaaaaagcatactaaaacaagcaggtatcgaaattgaatagttcactaatatcttctttcaaaaatcttaacggaggtttttatttatgtataaggacttatatgtgttccctgccatttttgactatgccgaagatggtatttccgttgaattccctgaccttcccggatgtttaacctgtggtgataacacggaagaagctttaaaaaatgctaaagaagctcttgaacttcatctgtatggtatggaaaaagacaatgagccaattcctgaaccaacacctatagacaaaattaaaattgaacccaatcaagttctcgtattggtagaagcctggatgccattagttcgcagtgaaatggataataaagcggttaaaaaaacattaactttaccaaagtggttaaacgacctagctgaaaaaaagaaaattaatttttctcgtgttctccagcaggctttgaaggaacaattaggtataaaagaacgggaaatataactttaattttaatttaactatcttgtttataattcattaacctaaagtcgatttctcattgcttttatttgttttattcgtttttttaaagattctttttaaaaacttaatcagaccggtaaatccttctatagttgcttttatcctttcaaaaacaattacgaaaactactgcgaaaaataatactttggttatataaaatgaaattggatccatccaaatcacctttgacagaggtaaaatttccatcccatactgtttcaattaaccgccatcctccagggtcagggccttaaaatgatagaaacctcccgtgatgcaaaaaaacctgggcagcaagaacctttattttgttttttctgtatgtacaaatttatgccaatggccaggcagtagaaaaactccctggccaaaaaaagtgagcaaaatttgcgttcacttaatttgagctaaatgtggtcaattaacgtgagtagtaacattttaatttaaatgacatttctagctattttaaaatcttttcaatattcatttttgcataaaggattctatggatttctacttcatcttcagtgaccacatagaacaccaaatagttttttaccgtaattatacattattagcatctaccttatcagcaagtcttgaccttaaatccgaaaacacttcatcatgcgaaaaccgcttagtagtcgtttttgcttccaactctgcttccttaagtttgaaatagatttcactttcaaataggatgaaatcggaaaccggtctaatgtgtggcatgtaaccaccctcttttataatttatcatgactttatcataatattgtctccaagaactctcttaactctatcggaatagctacaattttcttccttacgacccgctattttagcttttccaataaacaccagagctttgcccagagcatacccaccgttgaagcaggtttttttatcccaataataaccatcctcttttgagaaccaaacttcctggaaactaccgtaagtttgaaccagccaccattatttaaaagaaattttaaaagcactttttctttttccgataaatcttttacttttctttgcaaatttttgctactggtcagaaaagagataatttggcgtttattgaaaaaatcctaccagagctaaaaacttatccacaagtagaagcctaagccaggcttttagtttgatttgccagctcgaaaaattgcagtggccttatataaggatcatgttccttgggccagaggtttgcctcccagcattgggattaagcttttacacccttttaaagttttcatccagcataaattttgtagtaaaattaaaaaaataagatataatataagtagaagagattttacctcaaatatgacaaaacccggatccctttgaaagtaagcaataatgtccagataactttctaagtatataagggattggtataggttttatccaaatatgtcaccaatatctacaagtttcgagattattttagagaaatatgcgtgaatctaagattatcttttttttgaggaggtcgcataaataaaatgtatagtataaaaaaagtaacagaaaaaagtacaaaaaacccccggaaatggtttgggttcctaaatgaagaaaaacaattcaacaaacagaaatggtcgcgacgtagaatatttataaataaaaggattaaagctggcagaattagcgggataagtgagcgtgacattagtgcctattttgaaacacgtaatttagaaaaattggcttcgttaagaaaatatacccgccaagaaattcgcgactttttggacgctgataaattaacaccagaaattgcccgtaagattaaacgtttgctcaatgaataaaaagcccaaagtttttttagatgcatgttgctggatagcagcagccatttctcctgatggcgggtcagcgaaaattttaaaacttgctaaagcgggttacatccaaattgtagttactaaggaaattctaattgaagctcatagaaacataaaagaagataaaaaaaatgggaaaaaagccttaacgcgtttttattgtgaacttcaaacaacaaaaataattacagtggacgagcctactaatgaagaaaaagattgttggagaagtttagttgcagaaaaagactgtcatgtacttgcaggtgcttataaagcaaatgcggattttttggtttctttagataaaaaacatatactcaccgagaaggtaaaaaaagaatttccaatacctgttatggataccaaagaatttttaacagaaatactttcaaacttttaataatgttttaaaaaattgggataaaacgacttgcttaaaatagcaggcctttttttatgagaaagataacagacaaaagcgctttcggtaaaatataaaatggcgcgagattttaactgaaattttacttgtttcaagcgcattgctcaaatttcttttgttaaaaccccgggatttaagccgtggtgtttatggtaaaataaaagtgcagagtttggtaagataaaaatacagagttaggaatagtaaaaaaaccattgccagcagtcccaaattatggcctactaaaataatttgcaattttttgctgattacagctgccttctatactaatttattttgaaaaatagatgccagattaatttgcaagttcacactaatcccgtaacaagtgaaacaaccattctcaaaaacgatattgattcttgctcattaaattctttactaagtctcttcacccttccttttatgttatcccaataaaatctttcataactcattcctcgcacctcctatgccaaagtctcaaaaactttttccaaaagtagctttgaaagttctcgaatgtcaatagcggatttaaattgacccattttcagcggttttaaattgacccaccctggctttttttaaaattaagctttgatatgtggattaccgtagagaccggtttttaacctgtcttttaggcggtagctgttgcctcttatgttgattatatgggcatggtgtaatagcctatccaacactgcagtggcaagcaccgggtctcccatgagctccccccattccccaaagcctttgttgctggtgaggataatgctccccttttcataccgggcacttattagctggaaaaagaggtttgagccaaggccatctaaagggagatagcccacttcgtcgataacaaggagcttgggcctaaggtagatcctcattcgcctttccaaccggctttctttgtgggctgtttttaggtcttcaattagcctggaaaggctcgtaaagtagactgatatgccctgggatagggcttctatagcaagggctacggcaaggtgcgtcttccctactccaggcggcccaaggaatattacgttttctgcccggtggacaaaggccattgtggcaagctcttttatcagtttttcatcgatactgggctggaaggtaaagtcaaattccttcagggtctttttatacggaagccgggcaagttttgaccttacctcgacatttcgcctttgcctttcggcaagttcagtttcaagcagatcattaagaaatcaagatacgtgctgttttcccgctgggccctttcaaggagggcgtcaagaaaagccactgcgcttaaaagcccaagttcttcaaggtgggaccgagctttttcaaggtctatcatactgtgcccacctccaggaggctttcgtaaacccccagaggacgcttctcaacttccagggaagataacttgatcgccctcggcctgggataaaacatgccctcggcttcttttagacccttatactggtctttgaggaaaacggtgctccttgagcggtaatgcttttcgtgggttgctatcaccttcccatcatagaggatttcgattttaccgtttttgtcccttacaaccacctcttttccgctatactgccagggaacaccgtatcttacgccgtcaaaactcaaaaagccgtctttgtggactttccttgcttcttccaggaatttttggtatttatcaagggcaggcaggggtttgaggttttccttcttcaggcggtcaataggcctttccccggtagtgccgtgtattctcctgtttttcttttcgcaccacactattgcctggcggtttaaatcaccgtagtctacgaacttcctacccggcaggaagttgtttttgacaaaatctatgccgctttctaccttgccttttgtttgggggcgccgtgccctgcacactttaggaataaatccaagggtcgccgcaaggtcttcaaaggtagggttccatatgggctttttgttctcaccggtgcccagtattacggttttcattctatcggtaagaactatgtcggttactccgccgaagtattcaaacccgtggatcaagcagcggatgaaggtatggacgtcgcagcggtttgtgaattccacgtatatggctctggagtagccaagcaccatgacgaagacgtaaagcttacgtatttcaccggtttcctcgtcaatgtaggtgtattcgccccagtcgacctgggcttgctggccgggcttggtttcatagcggcatacggcagggacctgttttggaggtctaaattgtcttacatagtcccttaaaatagtgcgacctccggtgtagccttcttccttgattctttcgtaaatgacttcgcaattgaatatccccagattcatgagctcttgaatagtatctttgtatgggtcaagctttgaacctcttttgggatggggcttcctttcaggaatgccctctgctctgaggtattttcttaccgtatttctggaatggcctgtttctcgtgcgattgcacgaatactcttgcctcttgcttgtaattcatgtaacatgataattgatccactccctatctcaatattttttgattaactaaattaagctcttaaaatcttattttttcgctgaatttcagctatttcaatgttgttttttgtaaaggatttttgagacaaaacaagaccacctacgacaacttgcgaatcaagttgcctcacaaacgcttcacttatgccctcgactaccctatcatgtctctcgaggtcctacgccctcattacattccttcgttctgccttagagggtaaggcggggagcttttttactagcatgcagggtcttgcccctatgggagtgttagagcttccccaccttaccggccaactcatttttaggctgctaactggtttatttgcataatgcggtattccccaaggactttctggggatcgtaattttctctcttcttggcaagggcaaacatcacccttaccagtttgactgaaatcgcaatcaatgcctgcttagctttcaatggatttttgggcctttttaggaaatagttgtatagtgccttgaattccttgtttttggctactagcgttaggcttgctttgtagagaagattcctcagctcaggacggcccctcttggagatcttggccttccctttgtgttttcccgattggttttcggctatattaagccctgctagtttttgtatctgcttaaagtgggtgtagttggctaagtcacctacatccgctagaaatccagctacggttattactcctatgccaggaatgctgaggaggtattctgctatgtctatttttttgagcaattcttccattgttttttcaatcgtttcgagctgaccttttaaaaattctatttcgtcaaggtatgagtgaaggcgaatatatgccccttttaacccttcttttacccctactgacttttgtgctgcttcgatgagtttctcggctctttttatgcccactcttttattggcggctctcttcaggttttctgccagctcttctttggtgtagtttaagatcatgctcggaaacggacagtgccgcaatacccataaagccgccttgcctaagaggttcttgaatacttcttcaaattcaggaaagtattcatctatgatagaaactagtttgtttttagcgctgttaagcttacttattaactgctttcttgcgaccgaaaggtttcttaagtctgcgtaaatcccttcgggtaagaggcagtttagaaacttaccctcttttacgagtttggcaattattaatgcgtcctttcggtcgtttttggtagggctgttgtcttcctcttctttccttttcttcacgtggaacgggttcaccaggactacccggtatccctgttgcttcaaaaaccatgtgaggggcttccagtaatggccgctgggttcaaggcctattattaccctttctgcttttgttttttctttggcttcgagtattttagagactatacgaaagtagccatctttgctattattaaacttgaaaggttttactggttcgagtccgatgtggtttatgatccttgcatagtggttctttttggcaacatcgatcccgacgaaaattatgtcggaaccatgaactaaaaggagtttctcgattttgttcatgcctatcgccctcctggttaagtggttttgtgttccaattattcttttaccaggagggttttgtttttgcaaaggctattttaatttattacaggaatgctagcatttatttccctccgatcctttgcagtggtatcagagggatatttcgccagagggtgggtcatttacttttcgttgctcctgggtcaattatataccggcggtgacattattaatctaaagaaagcaatcgctgtttttttaaagatcttgctaggatttttttattagtggtaaccttattttttatttttttcgaactttataattttaactatcaatttgattattcatttcatgtattcatttcatcgcacaaatatagccaaatcgttaatcgccgctcgaattacttccaaacaaattctacaggtatcaatgtctggatgttcttgtcggctaagctgctcccgaggatgaattaggtttcgatattccctgagaatatgagtaaaatctttagcatcccgttgaatccatccacattcatgcgcgacgttgattaagttgctaagcgtccagtcgttaaaatgcttaactttccccgatttatctttcggagcacctgaagctttatttgcttcatgaggatacttatgcacaaaagcataaagcaatccttcaagtatacttcccattagtattatggcagctaaggaagctccatttttaatacaaataattgcttcttcccagcgtttttcaagaatctcaccgagattttcatctcccgtaagttgcttgaaatcaggtagtacaatttcctctgtagtcacaatagttggagtaggaacaataggagctatttcccttatttgcggcttaaccccttctagataaacctctaatccttctacacatagaatcttgttaagcttccctattacttctttaactaattctggattttgaggatattcacggggatctgctaatctttttataactttttgtatatttgcagggtttaagttataatcctttagcctttcgagggtccaccatttgcgggtactaccgtcatgagcaggacagtttaagccagcccggcgaaaaaaatccggaagttcccagcctttcctgtaccactccgttgagtcaccacaaattaactcagcaagtgcttccagagttttttcatcaagtggtttcaacgtcttatccacttgaggtccccccaatccctatttccctcggcctgagccattttgtattcctgtaaccaccttcaattttttataattttttctacaaaattttttcgactccttgttctgttttgccaaattttgtcgataaaattttacataattcgacttttttatctaaaaaatggcctatcttttaagaacttgagctggtattactaccaaaaaataaactttcttaatttaagcccaagatttattttatcttagttaaccgcgtagatttaaaaaaaattaaacccataactactgatccgacaatgtcttgacacgtgtatatatacgtattatagtttactcaggatcaacttattagaaaacagaggttgttatttatgtataaagacttatatgtgtttcctgccatctttgactatgccgaagatggtatttccgttgaattccctgaccttcctggatgtttaacctgtggtgataatacggaagaagctttaaaaaatgctaaagaagctcttgaacttcatctgtatggtatggaaaaagacaatgagccaattcctgaaccaacacctatagacaaaattaagattgaatccaatcaagttctcgtattggtagaagcctggatgccattagttcgcagtgaaatggataataaagcggttaaaaaaacattaactataccaaagtggttaaacgacctagctgaaaaaaagaaaattaatttttctcgtgttctccagcaggctttgaaggaacaattaggtataaaagaacgggaaatataactttaattttaatttaactatctcatgccaggcagttaggccaatgccaaggaaattttctataaaattagcaaatggtaacggcaataaattcgaaaagtttagcgcaaaaacattaaaccacttggttttaaaaaaaaccaagtggctttttacacggataccattgatagctcaggatattgactccataatttcccatccaacaacccgccattttttctctttcgcgttccgtataaaattatgccaatggccaggcagtagcaaactccctggccaaagaaagtgagcaaaatttgcgttcgcttaatttgagctaaatgtggtcaattaacgtgagtagtaacattttaatttaaatgacatttctagctattttaaaatcttttcaatattcatttttgcataaaggattctatggatttctacttcatcttaagtgaccacatagaacaccaaatagtttttttaccgtaattatacattattagcatctaccttatcagcaagtcttgaccttaaatcagaaaatacttcatcatgcgaaaaccgcttattagtcgtctttgcttccaactctgcttccttcagtttgaaatagatttcactttcaaatagtttgcgttcataagcttccatgctcattacaaccatatcaccgtaaccatttttggtcaaaaacaccggttctcctgtttcatggacaatccttgatatctcggcaaaattatttcttaaatccgaaaccggtctaatgtgtggcatataaccacccctttcttgatttatcataattttatcgtaattatgatatttaatcaagaacgatgcttcaaactttgtgattatcttgtgaaaattccacaagtcatgggttttcaatatctgtcccccgtttaactgcactctgctggcaatgataacaaataatattacttggtttagggttcatattcattaagtattttgctacattaaaatcgctatctgcaaaattaaaccattcgaaggcaatatcccaattatccataaattttgataccttcccgggcaattttatactctaaggttgatttaagttgcgaacgctttaaaaattcctcattactataaattaaaaggtcaaccggaactttaacattttggcgcatccacttaatacgcaaacacaggttttaaatcaacgataagatcgtcaaaaatggatactctgattacatcatcatccgtatatatctctggtctgccataccttttgttggcttgcaaagtaaatacacttataattttgctgtcaggctctactatccaatattcttttacaccaaatttttcatataaattaaatttttctactttatcttttcttgcggtagatggagatacaatctctacaattaaatcaggagctcctttgcatccctcagcatcaagttttgcttcatcacataccaccactatatcaggctcaacaacagtttttatatcttcatcatttttttcattactggaaggaagcctaacaccaaaaggtgcatgatagaccttgcatggcttatctttaaggtaattgtaaaactgattaaagatcgctcccgaaatttcctggtgaattcttgacggcggtgccagcaaataaacctgtccatcaattaattcaattctttcctcttccggccaggtcaaataatcaacatacgtatatattttatcttttttgggtaatggcatattgccgcctcctgttccaagcttttaccccaccagcatcagtatatcctgtgatactattatatagttaatgttaattttttacaatatgtaccttttgctttgccacagtcgcacaaaaaaacccagctttacagccggggcgcttcctatcccttaattttgcggccagttttcactaaaatcattaaaaccaatttctcattgcttttatctgttttattttttctttttacaaattctttttaaaaacttaaccatcccggtaaatccttctatagttgcttttatcctttcaaaaacaattacgaaaactattgcaaaaaacagtactttggttatataaaaggaaattgggtccatccatatcaccttcgaccgagggaaaatttccacctcatactgtttcaattaaacgctatcctcaaaggttagggatttttattataattatttatctaatccttcaaggtattttacagcaaatccaccataagtttcgccaaaaatataaacatatggttcaggtattttgtaatggtaaagcaaatcaggttttaagtaatagtcataaattacaccctgagactggtcatcccaagttgtgtctaacgccagccactggccatcaatatacacttcattccactcatgcccgccaccagctataccaacaacagttcttgtaggtataccaacagctctagcaagtgcagcaaaaagatagctgtaatgacggcatactcctttctttgtcaataacacttgaaccgaattcttttcattctccatagttaaattatcttcatcgctattatactcaacagtattcaccacaaaatcatgtaatgcttttactttatcttttaaatcgcttaagccactggtaattttgttggctgtatcaattattaaagggtcatccgaattaactaaccctgaaagcattatgtatgatttgtctttaattccataaaccgcaaattttattactttaacacctgacatgccatttttattaaaacctaaataataaatgccgcttccatggttgaaataaagttttatctcaccatcagccaaatcattcttcccaataagttgaataatacctgcttcaataccattgggcaacatataatattgttatttagcaaattatcttctctcaaatccccagaaatttttcaaaataaaacagcggcttaacctttttagaccacaaatattttgctataatttttgcaaaatatttggggtgatttattttgatgattttttatgattttggcttatctgtccgggaatatgcccggcggggcaaaaagaatgattttcccgatgttgacatttgcccacattgtaaagggcatattagactgttacggcatgggttttattttagatacgccgtcactaataataacgttttttccatccctatttgccgtttaagatgtccttcctgtggtaaaaccgtctcaattatcccttctttcttacttccgtactttcagcatactgtggctactattttgataaaacttaaacattacttcctttatcgaaaagtcataggttatcgtcagttattggagttttttaatcaaaggtttaggaaaaatctaacccgtatcgagatgtttttccgagatgtcggctttaggggcgtttttccttttaacccaaaagaaaaagccataaagttggtggaaatgctcctggctttgggcaaaactcccctcctgaaaaggggcatcggacatttcccacttaactttatggcaagttaattctatcattttttctccctcctgaaaactattttttgcttccacaaaccttttgcgtggtattctttttcctcccaggttaaaatggtctcatggatggttaaccggttagcctccttctaaaaggagggtttttatggatgaaaaagtgcgtgaaaaggtggctcttttccgttatggccttctggctcctgttctaaatggccaggtgtctaatcagcaggagtattttgcccaaatttgctctaaggttcatgaggtgcctttttatggccctaaagaatttactcctaaaactctggccggctggcttctttcttaccgccggtttggttttgatggccttaagcctaaaattcgttcggatcggggaaaacatcgagtgctttcccgggagcaggaagagtatttaatagctttacgaaaagagctcagggatttgcctgcttccgttttttatgaacgcttagtggataggggtgagattttacctaaggatgtttcctatgctacggtttataggctactgaaaaagtatggtttggtcggtaatgagtcccccaaatcccctgaacgcaaaaggttttcttatgatacggttaatgttctctggcagggagatatgtctgttggtccgtatattgtgcaaaatggcaaaaagctaaagacttttctttttgcttttattgatgattgctcaagattggttccttttgcccagtttttcttttcagaaaagtttgagtctctacgaactgtgttcaaggaagcgttaattcgccggggtatccctaagatggtttatgtagataacggcaaaatttatcgctccgatactttccaaattgcttgtgccagtcttggtattatcctgacccatacccagccttatgatgctcccagtaagggaaaaatagaacggttctttggtacggttaagacccgctttttccctttgctgaaagaaaaaccggcatcttctttagaggagctaaaccgccgcttctggcagtggttagaggaagattaccaccgaaaagtccatgcctctctgggtatgactcctttagatgtttatttatctcaggtaagtcaggtgcggatgattgatgaccccgcttcccttgacccgctgtttttgaaaagggaaatgcgtaaggtgaaacatgatggcactatttccgttaataataagctgtatgaagtaccaccccggtttattggccaaaaaattgaagtccgttttgatgaagatgtggtttatgtttatgaaaatggcatagctgtagataaagctatcccggttaatttcgctgataatgccaaggtaaaacgccatcgctcgctttcttttcaggctatgctggcgggaaaggaggagtaatcggtgtatcgagctttttattctttgaccaaagccccttttactaaagaaatcaaaaccgctgattctttcctgtcaacttctttttccgaaacgatggcccgacttgagtatctaaaaaagacccgtggcattggcctgattgctggagaaccaggagccggtaaaacttttgctcttcgagcttttgctgaaagtctcaatccttctctgtataaggtgctttatttccccctatccaccggtacagttatggatttctaccgggggttggctatagctctgggggaagaacctaagtttcgcaaggtggatctttttcaccagattcaaaccgctgtcctcaggttttttcgggaaagaaagattactccggtttttatcttagatgagatgcaaatggctaaagaccttttcctttgcgatataaatatcctctttaactttagcatggattcggaaaatccgtttatcttaattctctctggccttccgcatctcttagataagctttccttaaaccagaataggcctctggcccaaaggattgccatgagctataaagttgagcctttgacccgggaagaggtagcaggctacatccagcatcaaatggagcttgccggagccaaacacagtatattttccgaacaagctatcgaagctattgcttctttatcccgggggtggccccggttaatcaataagcttgctacccattgcttgctttatggtttccaggctaaaaaggaaatcattgatgctgaggtggttaggttagcggctttttggatgctggtttctaatcttgcccggtcgcacttttgcggccggttttctttttatttttctttgctaaaattctgtgatattttgcaaaaggttttactggcctaccaaattaatttgcaatttttgcagattacagctacctcctatgctattttattttgaaatattggtgcccaaataatttgcaagttcacagaatcccttaataaataatctgcccggtcagcatctaactggcttgaaagtaaatccctccagataagcgctccatcttttggcaaacttccttcaataaatctggcaacctgttccgcagtaatttgataatttttttgatttattggatgttgttcaataacctctttaaaaaaatgtctaattattgctgcggaataatgctcatgtttatacgctttattagttttcggattggttggcattaaatcttcccccgcatgggaaaaaggttatagttatgactttttcggtgatgttgccggaggtatcttttacctgtaccttaatcggattggggccttccgatagtgttacgataatgctcacctccgcattttttgttccgaccgcaatgactttaccagcgatgcggttacggtttcagagtatagcaattttttgataccagcgatacttaaccatttttaacaaccccttgcatttgatatttaaaaaaggagcggttaaaaacccgctccttttttaaatttgcttgtttcatgaccataatttaaatttacgtagtaaaaaaccccgggatttaacccggggttttggtgttactggacggaggttaaagtccagaagttggggtcgtagatgtaaccggtgtaggtcttgtagccgccattgctccagatggatacccgtactttgttccatacaccttcgcggccgaggtagcgcatcttgtaacctttcttcaatacagctaagatcttagcattggcctgcggcgccacccggaggttggtcttggtgtaggtaagttgcaccatctgtcctacgtacttgctgtatttgtcaccggtgttggtattgccgccgttgttggcgggtggcggtgttaccggtttttcgtattttacagttatagtcttggaggcaacgttaccagcaaggtcagcagcttcaactacgatagtattgtcaccttcaacaaggttaacgcgtactactttattaacttctgctgcaggtgctacaagagctacagcagcattattaacggctaatgcagcaaccttatcgttatcagttactttaacagttacatcaacataaggtacttcaactttttcgggagctgttacggtaattactggagcttgagtatctacaaatacatcagatttaatttttgctatggtttcattcgctacatctttcagttctacgttaatgtctccagttgcattggattggatataagtagtgacctgaccattactatcaagggttaattcttggcttacaccagcgccagataatgtaacaacataaccagctagtgctttaccatgagcatcttttgcagttaccgttatagcttttggaacagcaacagttactttatcagagcttacagctactacagcaggttttacatcaaaagttgcgacttttatgccatttacttttacttcaaattgcggtgctgctttggcatctttattatattgtgctaaaatcacaaactcataagttgaagcaccttgcttatcactatctgttgcaatagtttttccatctttttgatatacgcttaatacactcaaggtattggtattttcggaatcttttacaattgcaaagtcaattgggagtttaatttctgcattatttcttggatcataaattactgccttgatcgattctttcacactatctgttattacattatcgcttggtgttaatacaactttgggtgctacaacatcaattttaactgttccaaagctcgttccgttgtttgaggttacagttattgttagtgtacctggtttgcttacattaaggttccctaaggtaaagctaccagtagagtctaatgttacattattcaaatcagagaggctattttgtgaaatggatgctgttgtgtcagaatgttttaaacttactttgaaaccagttccggtaactacattggcaccatctttaactgtaatttttacattttcaggataattagcaagtagtgctgttttatcagcagttactgtatacttttcatatccaaggaatgtatatggaactttagcccatgtttcatatgttgttgttccatcagcaagtttcttcattacgataacataaatatttgttgagccaggggtatcagctttaatcgttgcgctataattaccgtcagtaatatttgttactgttccatcgactattgtatctttatcatttaccacagcagcatctttaaacgtaccatcgctaccttttactttaatgtcagttttatcaaaagctataatggcgttattgataggattgccatttacgtctttaacagttacagtaagtgcggtttcctgatcataaattgactgacttaccgatacagtaggcacaaatccttttactggaatcgatactgtttttgttacccaagtatcagttccatttacagtaacttttgcatttacagtaatgttcacgcttccaccaattttaatagtattagttgttaccgtcattgcaccagctttaagttcaatattatttacaggagtcataccagctcctgatgcacttacataaactgctttaatagcagaatttcctgaagtaaaatcataacctttttggtcaaaaatagttttggtattcagtgcataaatagtaacctttgccgtgccagtccctttaaatacaaggccacttaaatctggattagcagtaaattttaaaacaactttatcgtatactttgttaccaactgaatcagttcttacatctgagctaacaaatggatcaacaggagttgtagtatacttaacaaatttattatttgtcccaatgctgtcggcaaccggtactccttctataaccacataataggttgatcctgatacagaagtatcaccaacttttaaggattttaaggttaacttataatttctaccttcataggcagtagcagattccagggtagcagttgctgtttttccagaaacggttaattcataataaccaagctccctcaatacaaacaaatattttccggcaactttaggcgtaatgtagaagttaaccgtaccattagccgcaacgccaacagtacctatcgaagaataataattagaatcacctgtcaccctattataaggtgttgcaccattgctataataaacttcaaacgcgttatacgaagtttcttgtgcaacgacatatttgctcgaagtctcatcgtatttaaatacagtaccgcttatttttacttcctggcctatcactggtgacgcaatagattgagaaccatcaaatttatagccatgagtgatgtatttgactgtagttcctttgcttgattttgctactacagcaaagatgacatcctcattcttatagaagttgtcacttaaatccgcgataaacgttcctgtattaggattaacagttgctgaaataacatcccaaacaattggagcattcgttatttttgtatcttctgccaaaacataaacatcgactactgcatctttatctgtagtaccttcaatagaagtaacagactgaccaacatagagattatttgactcaggtttggtaatatttaaagtagcttttccatcagcagaaccaacagcatttgcatatgggttaatctttggaattattccagttgcaagaacataattatttgaaccagtgatgtatttaactgtatagttgtgatctccagtggtgcggtttacataaaaggtaaaactggaaacgttacttttatcaataaatgccgattcataagtattgctatccaaatatactgctatgacactgcctgacgtgataccattactaccatcatatacaaccaaatccactttagcctcattccaagcggttggtgtaacagaagcaacagctggaatcacattaaaggaagatgaagaagctatttcagtcgctgttccccctgaaggagtgtactttacacttaaagaatacccacttccaaatggtacaacattgcttgaagtatctttaaaatcacttatattaaatacataatcttttcttcctgcatctacatccgcttgagcaatagtgtaaatcgctgtatacgttgtcgaattttttgttagttctaccgttattacgtcgttaagtgcaggtacatctcctaatgtaatagtaagaggcactgtcgttgaaatataattagttggatttaaagtagccgacgtgaccgctccaaacgcaacagccggcaacatgctgagaagaaatgctacgatggtcaggattgcgataggctttttgtgttttaattttgccatcttctaaattttccctccttaaaaaatttattttgggcataaacccatttttgaaaccagaaaggtatatttaattggtcttccctttcccggtctttcccccctctcatatgtaaactttctattgtttacactgttaggaacccttgaaagattttacagggttcaaaaccttttaaacaatttaaaattttgtcagccggagctgaccctacaataaatcgttaccagtatatgcctggaagttgtatttattacctattcgccatattttctaattttccttctattttataacatattttttatttttttctttgtgtagaatatttttcttttttgccaattgactggagaatttggagacagttcatctacttattaattttagggggtcaatccttagatgtcaaccattttcttgtatttttgtataagatttcctttatcttttatatcaaaaaaattatttttatcttatttatctaaaataaaaaaccctccaagtatccattcctggagggttaagaaggaaaaagccccgggagttacccggggctttttagtatttaagctttagttaatgcccagaagtagggatcgtaaatgtagccggtgtaggtcttgtagccgcccttcatccagatggagactcttactttgttccagacaccttcccggccgaggtagcgcatcttgtaacctgtcttcaaggttaccaggagcttgccgttaggcgctaaccggaggttggtcctggaataagtgagttttaccatctggccgacaaacttactgtatttgtcgccagtgttagtattatcggccggcggtacaggcttggtgtaagttacgtcagcagtagctgtggcaatattacctgctacgtcggcagcttcgacggtaatagtattctttccttccttcagggttacggttactactttgtttacttcaaccataggagctaccagttcgatccgctggccgttcaccagcagtccggcgaccttaccttcgtcggtaactttaatgttcacatcaacggtttccttatcggtggtagccggagcttcaatggtgattaccggcttcttgtcgtctacaacaaatttagcggtgatttccggtttggtgatattggcataagccggtgcatcaaccacaatcttgccggtagcaaagggcgttacggtaaagattactttgccatcggcatcggtggtaccggtaagggcaactccggagccgtttaaggttacggtagcgtctttaatcgggttgccgtgagcatcttttaaggtagcttcaacggcattgtcacttcctaccgctacttcggttttatttacggtgagaacagcaggttttacggtaagttcggaaaccttaatgccgtttactgaaagctctaattttccgtcatagccataggaagcattcttcgttgctaaaacggtaactttcgccggtgctccggtgttataagcgctgccatccacagtctttaaagcgttgccgctttggtcgtagacgccaaaggtagcggaattgtcgtaaacgcttaaggttacggtagtgttggcagtaatttcggtgttatcaattgggctgtagactgcatagctgaccgcttctttctggctgtcggtgaggatgccgtcagcgggtgccaaaactttaattaccggaagtttgacatttaccgtgaaagtaccgtatttcttgccgtcggtagatattaccttaaagtttatggtacccgctttggtcaagcttcccagacttacggtgtatttgccgttggtataggtgacaccgtttacggtttggctattaccgtctaagtctgtataggcaacatttacattatcggttactccgtaggctccttctttaactgtaaaggacacttccgtatcataaccagcaattaaggttgctttatccggagttacggtgtaaacgttgctgcccaggaccggataggtaagccgggctttcttaccgctggggtcaaccacatttaccacaaagtttgttacatcggttaaggcggctgcagagaagttatactggccgtttacgatattggtagtctgtccgctaatgctaccggtgtaaggaccggaaatagtaacagttgcgttgttaatgggcgtgccgtttttatcggtaacggttactttcggtgaaacggttgcgccgtaaactaaattggccaccgttgccgcatcaagggaagcttttaagccatcgaccggaatggtcagggttttggtttcctgagtgttgtcggttaaagttgccacaacagttacggtcacatctcccgcctgggaggggttgacggtgaagctgtattcagctttattgctatcgctggcgttgacatcgggtccggttacggtgactttaacgtcttttaaagtagaattggcatcgccataaaccttattgttgacatccttgacataaaccgcaagggttgtggtggtatctgcagccagtgaagttacattggtaaagacatttactttagccgccggatttaccggaatgtttaaggttcccagaagctcagcgttttcagtataaagaccattggcaaaatctaccgaatctttctgataataagctttgaccgttaaggttccgatggtgtccagcagttttaagttagaaagattcaaaactccatcggagtcggatacggctactttggtgtaataagtattatcaattacagttccataagtggttccggtaacactgtttttatcaatttttacaccgcttaactcgaagtaataggtgccgccggagacggttacagccggcttggcggtaaaggtaatgttgttgtcaaagctgccgccggtaagggcggttttatcggcggtaaccgctaaggtctgtggtgctacagtaatttcttcgtatttgacaaagttagtgccatcggtattagcggttcccagggcataggtgccggcataggtgaaaacgggaacgctgatggcaaagcggccggtgtcggtgacggcactgttaccaattactccaatggcatcattttcatgctttaaaaccatttgccggcctgccggtaggcctttgatggtccccccaagaattacgttggtgtctcctactttgtagctgccccgagcatcgggggtgtagtcatagcgtgaaaggacggttactacgttggaaacatcggtgccttctttgacctggaaggtgtagtctccttctttgtcaaagacataatttttggcaaaggtaccatcagcaagagtgctggtaaaggtttcctcggtaccgcctgccggggtgtagacaatagttacaacccctttgttgccgtaaatgtccacgacgctaccggagaccagggtagcagtggtgcccggccttaccgtagtcgggctaagggttaagacgtacttagccggcgtactggccaggacaaaagcggggagcatggtgagtaagaaagttgccatcgtgataatcgcaatggcctttttccccttgagtctgatcatttctttccctccttaaaaattttgtatatttatttaaaaatacggaaccctatgtaagattttggatatatcggacattaaggctattatggattttttagactttttttatcacatttaaattttaaagcatcacaccttgactgtcaatcgcttttaggcattcaggcttatttttagcttttaattaggcgtaatttactttatttttctcttttctgcggttaatttgctttaaagatttttttaagctaatggtattcgacaccatttttaatatttcgatacttttagagagttactgccgctggttttctcttccatcataatattcgtaagctttgaaaattttcggggggttgtttggagagaaagttaaattttgcagttgttttcaggggagactttcctgggtaatttgggagagaatccgtccggttacccccggggatggaagagatactttggtcaaggaatttaacttcatggcgggaagcttagaaaagatatccagtaaaaccggtaaggtaaggttggtttttatattttgaacgagaaaggaaagatgcccgggaactttccacatttctccgggcaacaataatttttggaccagggcctttaccaggtcggtgtcgtttagccgccggccggccagggtatcttcaaagatggaaattaccggtaccgtttcgcctttaaggtttacttctcccaggcggcgggaaaattgttctacgacagtttggtcaattacgatgtagtgagggatttgggtattaaaggctttttccagggttctggtaaaggtggataaccccttccgggcatagatttccccggtggtgagagtttctccgggcagcagggtacgggtaggcacggtaagaagggctgggattttggttctggggttgtaggtgatgatggtgatggcttttaagccgcccttttcggtccaaagcagcaaaatattctggtttgggcaaaaatgggccggaggagtaggctcggcgctgggagcaatgtagtttttaatcccttcttttacggaaagagggacggcaagggtaatgccggtggtttgttctttttgccgggattttagtggagtttttttaagctcaccggtttttaccggattaaaaataaagatggtaataaacagtattataataaatatgaagagccttttcaaaataaaacccccttttggcctctaagtaatagcttgggccaagagaggggaaaatatacgttattggtggtaagtggtaggtggttggtggtaagaaaaaaatcctcaacccacaacctaccacagacaaccgataacttttttgtagggttaagttcattctgtagaataaattgtttgaaatgccatatttatggtattattaaatcaagaggtgataagcatgaaaaaaagcgtaaaaatattgcaactaaagcttccttttgaccttgataaaaagttagctgaacttgcaaaaaagaatcaaaccagcaaaaataagataattgtagatttacttaataatcaaataacgggattagaagcgagaaaattattagatgaaattaaaaacgaaataaaaccagaagatgcaccagactggtttaataagcctgcttctgaatatattaaggagttaaggagtgatggataaccaaaatacctttttaaaatttttaattgatagctgtatttttattgattttttcgcagatcgtttaagtagtcttgaaaaacaaaacttatacacaatttttgaacaaggtttagtttctacaagtgtaattgtttgccatgaagtattatttggaattcaaaataaaaaactaaaatcaaaagtattaagtttatttgaaaagattgaaattatacctgtcactattgatatttcgattttagcatccgaaattagaaagcaaaataaaaatttgggacataatctttcattaccagattcgcttattgccgcctcagctcaaattaataattattgggttataacaaataataaaaaagatttttcaagtgttaaagctataactcttcttgaactaaaataatactacaaaaaaatctgccaaggtggcagattttttattttacatctcaatactgattatttcttttgctgagcatgtcccacatggctaaagcttttcctgtgccaagggcaacacaggataaggcatcaggggctacaaaagtaggcaggccggtttctttggcaattagccggtcaagaccgtttaataacgagccaccgccggtcataacaatgccgcggttgacaatgtcagcagaaagttccggtggagtgcgctctaagacttctttaacggcatttactacagcaactaagggctcggttattgcctcgtggatatttaggcttgttacttccacatttttaggaaggccggttaagaggtcgcgtccgcgaatttccatttttttaatttccgttccttcgggaaaggcagtaccaatttcgatttttacttcctccgctgttttttccccgattaaaaggttaaactcttttctgatgtacttgacgatggcatcgtcaaacttatcgccgcctacccttaaggatttgcttaccacaatacctcccagggataacacggccacgtcggtagtcccgccgcctatgtccaccaccattgaaccgtacggctcggaaatatcaagccccgctcccaaggctgcagcgatggtttcctcgatgacttccgcttcccgggcgccggcctgcttggccgcttgctttaccgcccgtttttctacgtcggtgaccccggcggggatgctgaccataatccggggtttaaagaagagaggcctaccgcctaaggctttggtaataaagtagcgaagcattttttcggtggtgtcgtaatcggcgataaccccttctttaagagggcggatagccacgatgttcccgggagtgcgaccgagcatttttttggcttcttcgccgacagcgatgatctgtcccgtatcccggtttaccgccaccaccgaaggctcgcgtaaaacgatacctttacctttaacatatacaagcacattggcagtacccaagtctaccccgatatcggtactccagttaaacatttatataaaacccctttcggtagaatggtcaattttttatcataaaagcaacaggagtcgcaacggcaaatctgcttgtctaataatgagctaaaaaataagattttgtcaaatattattttattctacctccaggggaaaaaatcctgcaaatttagagttatttggccatgtttttatattttttgcgggtagcctcacctccccggatgtgccgctccgctttgttctgttcgagaattttttttatttccccggccaattttttatctaatgcagggaggcgctcggttaagtctttatggacggtgcttttactgaccccaaaaacttcggcggttttccggaccgttgctttattttctaagacataataggtaagctttaaaacccgctttaaaatgtattcctgcattaaaagacctcccgcgcatggcattggttagtaaatactatgcggggaggtggggttttagaagttttctttttggcctaaaggtttatgttttcaatcttcttaattaaatctggaatatctcttttaattgtttcccagataatttttatacttaccccaaaatactcatgaacaagcaagtttctcattccaatcatcgatctccatggtatctccggataaagggctgttattttttcgggtattttattcgctgcttccccaattatttctaaatttctcactactgcatcaatggttttactgtctaacataaattcatcataagtgatattttttgtataatccaatatttttttcgctgattctaaaatatcagataaatatagcttataatccctcaatgataatggcctcccgtaaaatattttccatgattactggctttatagcatcaaaagttccaaggtctactttccttttaaaaagttcttcgagggcgttttttaattcaacaaattgaaagatagtaactggctcatcgaaatcaatcaataaatcaatatcactggtttgacttgcttcattccggacaaaagagccaaaaagtccaattttagatacattataggtttttagtaaatttttattttctaaaagcttgtttagaataaagtttttatcttccacaattaatcacctacttacaaacattttataaacccaattttttatataaatcttcaaggctttccgctttcataatcttcccatttataatgtcctgggaaacttttcgttcctcttcttgccaagttttactccaaaagtatatttgcgatttagaaataaattttttacttttagatttaacttttaaatttcttttcataaaatcaccttactataaatttaccttttcttaatttttagtatatttttaagccggtttgatgtaaagcctgaaaatggtggtcggtggtaaatcattttataaagcgctttcgataaaatatttaggtgttaaaattttaatatctctaaattcctttagttcaagtaagtgctgatctccggtaacaataaaatcagcgttagctgctgttgcacattctaagactttgttatccgctggatcttctttaattacattaatcgtttcgagaggatagataaaaagtacccagggaagttcaattaatttttgaatgattaaaagttttttttccacactacccagtattttaaatttatcccgggttaagactaccgaatattcatttattaattctcgacttacagcaggaattattttttgcatgatccaggcatcgaggattttagcgggataagaatgtttttttaataatccggaaataaaaacattggtatctattactactcgcattttctcgcttcctcaatctcttttaatatttcatcgtcggagatttcataagttgctgctttttccctaacttcctctatgagattttttagttccagcatttttaatttttcctggatttttttaaattgttcatattgcttgtaacttaatattactcctttaggattggaacggtaggttatgataaaaacttcacctttatcaacttcttctaaatattctcctaaacggggtctaagttgatcaaccccaattattttttccattccactcacctcacctaaggtatacattaatcttaaaatatatgtttagctaattataacttatttttttagaaagttcaaggttaatggggttttagtatagccggctcctgccggcgtaatgtttctgtagggtcgactcccgtcgacaaaatatttgcgcacaggagcccgccctacataaaaaaggcagcaggagctgccttaacggtggtaagtggtaagtcgtatgtcgttggtaaaaaagtatggtcggttttggcctaccacaacataaagcgggctgaagcccgcacactacttatattgcacaacttttgtcccggggtagtagtggcttaaaatttcccgatagtttttgcccttatccgccagagccgccgctccccgctggcagaggccgaccccgtggccatagccccgggtggtgaaaatgattttatcgccccgggtgcttacggtcatgatggttgatttcaaacccaaacggtagcgaatttcttcggctaagaaaatacggctgccaagtttaatcttcttcacccggccggtgccggttcgttcgctgattttaacaggctttgtaccggtagatacggccagggccttaaggtcggttcccaaaactttatcgatataagaaattttaaaagttttagtttccaccggatagtcgttttccagacacgttaccgattttaaataaggaacatcgtaaccccagacatctttggccgcttccgtcttttgaccgccgcaggaagcgtggtaaaccggatcaattagctcaccgttatataccagcactttacccttggtagagttgaccgcccacttaacgcgggataaataatagtagtattttaccccccagcgctttctcagctcttccccggaaaggtaagcctggctgtgggtcggatcggtacacaggtccgccccgggatggtatcctctggtgttttgcggagacaaaatccgcttcaaggtataagttcgtgccgctatggcctgggcttttaaggcttccagtggataatttggcggcatttcgccggcaacaacccccaccagatattcttccagttccaccgtctcgatcttatcggtttggtggttgtacagctttaaggttatccctttttccggctgaattttaaccggcttctcctcttccttctcctgctttaccgtataagctgtccacgctaccagcaggattagtatcgcaattgcaatttttttcataatactcacccaatttggcatatttttattaatagtgtatacgccagcgggtgagtttatacatcggtcgtcagtcgtaagtgataagtggtcggaaaaaatatatcgccggtacctttaagtaccggcgtttcttaatcgcttactcgttctattttcgcgcccaacccccggagcttttcttcaaaccgctcataaccccggtcgatatggaagatatggcctacttcggtgactccatcggcaacaaggccggctataaccagagcggctccggcgcgtaagtcggtagccttgacccgggcgccggtcaggctttctaccccttcaataaaggcggaccgaccttcgatgcggatttttgcccccatacggtttaattcggtaacatgcataaagcggttttcaaagaccgtttcggttaccacggatattcccggcacagtagctaaaagagccatcatctgggcctgtaaatcggtaggaaagccgggataaggcagggtttttatatcaagaggttttaattttccgttacttcttaccagcagggcgttttggtcttcatcttcaataacttcagccccggcttcaatgagcttggcaatgagcggggttaagtggtcggtaataacgttttctacgatcacctctccctgagtggccaccgccccgatcatgaacgttccggcttcaatgcggtctggaattacggtgtggttaacgccatctaaatcctttacaccggtaatccggatgactttggttcccgcacccttgattttggctcccatgttgtttaaaaagttggccaaatccactatttccggctcttcagcagcgttttcaataatggtttgcccttccgccaaaactgcggccatcataatgttttcggtagctcccaccgagggaaagtcgagataaacggtagttccctttaacctgggtgcggtagcttcgatgaagccatgtcccatttctattttagctcccaaagcttcaaaacctttcaaatgcaggtctatgggccgagcgccaatggcacatcctcccggcaggcttatccgggcccgtccggttcgggctaagagcggtcccataactaaaaaagacgcccgcattttacgcacctgctcgtaaggtgcttctgccgacgttatttccggagtatgtaaaaccacttctccctcggaaaaagtaactttcgcccccaatgcttttaagacctcaagcatcgtataaatatcggtaagttccggaacttcggtaaggcgaacggtaccgccggttaaaagggctcctgctaaaatgggcaatgctgcatttttggcgccgcttatttttacccgtcccgtaagtcgctgctttccttctatgacaaacttttccatctctttcctcctgcttaatagttaccaagccacacgggaatgcccagtttaacccccgcaccccccggcttactggtaatgataagctgatagttcactttttctccctttatcattataccggtatttagggccggcgtatagcccaaaaccacagtattttcgccatttttttcgatttttttcaccgtacccccgactattttttccgggttcctgccggtataggtaaactctaacaggtaatagcgtagcccccgttcttcgggtaaaaaaaggtccggcccggcaattagacgttcgtaccggttttcctccggctcatacaatacccagtactttctcccttcagcaaaacactcggttccgaggtcggcaaaagtaaagttatcattcaacaggtaagcgagcttttttaaatcatcttcgggccttttatttattttacggccaaaaataatttttaattccggattcttcacctccggtttacccatgattttctgacagagtacgtactccggataagaaccggtggaaataaaacttaccgccagtaccgccagcaaaaaagccgaaaggatttttttcatcggtatccctccggctaatagttttgccaaaattaagtaacaataaaaaagcgcaccttttttggtgcgctcttttacatttttcccgctgctttgaggcggtttaatgcccggcgcatggccagttccgcccggagcacgtctatatcgggcgtgcgtctggcaagacgctcccgggcccgctctaaagctctctgggcccgctccacatcgatctcctcaccccgctcggcggcattggccagaaccactaccttgttgccctttacctccaaaaagccgccggaaagggcaattttttccgttttcccctccaccgtatagcgtaaaattccgatatcaagggaagtaattaatggagcgtgaaagggtaaaataccaatctccccttccacgccgggagcaaccacgaaatccacgtgttcgttcgccactacccgctcgggggtgactacctcaagcttgattttatccgccatatttatgcacttccttcaagctcccgggccctttccaccacttcgtcgatggtgcccgccatgtagaagcaggtctccggaatatcgtcgtgcttgccttccaggatttctttaaagccccggatggtttctttcaccggcacgtacttcccgggccgcccggtaaacgcttcggccacggtaaacggctgggaaaggaagcgctgcagcttccgggcccgggccacgatcagcttgtcttcgtcggaaagctcatccataccgagaatggcgatgatgtcctgcagttctttatagcgctggagcacccgctgcacaccccgggctacctgataatgttcctccccgacgatatgcgggtctaaaatccgggaagtggagtccagggggtccaccgccggataaatcccgagctcggcaatttgccgggaaagaacgacggtagcatccaggtgtgcgaaggttgtcgccggcgccgggtcggttaagtcgtccgccggcacgtaaaccgcctgcaccgaagtaatcgaacctttccgggttgaggtaatccgctcctggagctgacccatctcggtcgccagggtgggctggtaacccaccgccgaaggcatccggcccagtagggcggacacttcggatccggcctgggtgaagcggaagatgttgtcgataaagaggagcacgtcctgcccctcttcatcccggaagtattccgccatggtaagaccggtaagccctactctaagacgcaccccgggtggttcgttcatttgcccgaacaccatgatggtcttatccaaaacgcccgcttctttcatttcgtggtaaaggtcgttaccttcccgggtccgctcgcccacaccggcaaacacggaaataccaccgtgctgcttggcaatgttgttgatgagctccatcacgataacggtcttacctactccggcaccgccgaaaagcccgattttaccaccctttaagaacggtaccaaaaggtcgataaccttaatccccgtttccaggatttccgcccgggtggactgttcttccagaggaggagcgggccggtgaatgggatagtaatggtcgctttccaccggtcccttaccgtcaatgggttccccgagcacgtttaacaggcgtcccaaaacaggacggcctaccggaacggtaatgggcgctccggtatccaccactttcatgccccgaaccaggccatcggtagacgacatcgctaccgcccggacccggttgttgcccaggtgctgggcaacttccagcgtcaggttaatgggcacttcggtgggtgtgtcctggtcttcgcttcttatttttaaggcgttataaatgggaggaaccttacccggttcaaactctacgtccaccacaacgccgataacctgcactacccgacctacgttcatcaaataacctccttctcttaggcctcaagggcagcagccccgcccacgatctcggcaatttctttggtaatcgccgcctgacgggcgcggttaagctgcagggtaagcttggcaatcatctccgtcgcgttttccgttgcggtatccatggcggtcatccgggcaccatgctcggaagccttggattctaagagagcccggtaaacctgaacctcaacgtatttcggtaacagggtgtttaataccgcatcggcggacggttcaaaaatatattcgccacccccgctctcctcggcaggagcttccagcggcaaaagcttcaaggtctgcggccgctgcaccagggggtttacaaattccgaaaacaccaggtaaacttcatcgaaggtgccgtctaaatatttttccatgataaagccagctatcacccgagccgcatcaaaggaaatcgactcgcccaggttggtaaactcgccgacgatctcataaccccgctttttaaagaagtcccggcccttgcggccaacggttataagctttgggttggaaaattcttttaactccacggtggcttttcttataaggttggcgttaaagccaccgcaaaggccgcggtccgccgtgatgagcacgtagccggtagctttgacttcccttttaattaagagcgggtgagctgtttcggtggtggctgccgccgcccttgctaaaacatctttaattcttttagcataaggtcttgatgccaccaccatttcctgggcccggcgaagttttgctgctgcgaccattttcatggctttggttatctgctgggtattcttgatacttttgatgcgccggcgtaaatcccgcatgcttggcattttttctcaccaccttctcttaggcgaaggtcttcttgaattcttcgatagctgactttagacgactggtcaattcgtcggtaagtacccctttggtgcgaatttcttcgccaatttgcggatagttggcccgcatgaattttaaaaattcagcttcaaaaggtcttactttttctaccggaagatcatctaaatagccgttaaccgccgcaaaaatcgccatgacctgttcttctaccggcatcggtttgtactggtcctgctttaaaagctccaccaaccgctcaccgcgggtaaggcgagctaatgtagctttatcaaggtccgaaccaaactgggcgaaagcagccagctcccggtactgggcgaggtccaagcgcaaacttccggcaacctgcttcatggccttgatctgtgccgcaccaccgacccgggacacggacaaaccgacgttaaccgccggccgtaccccggcgtagaaaaggtcggactccaggtaaatctgcccgtcggtaatggaaatcacgttggtaggaatgtaagccgaaacgtcaccagcctgggtttcgataatcggcagtgccgttaagctacccccaccatactcatcggacaattttgctgcccgctccaaaagacgggagtgtaagtagaatacgtctcccggatacgcttcccgaccggggggacggcgcagcaacagggaaagctcccggtaagccgccgcttgcttggaaaggtcgtcataaaccaccaaaacgtgcttgccctgctccatgaactcttctcccatagcacagccggcatagggtgctaagtaaagaaggggagccgggtcggaagcggttgcggaaacaacgatcgtgtagtccatcgctccgtggtcttttaaggtttgtaccactttagccacggtagaagctttctgaccgatcgctacgtaaatacaaattacgtcggtatttttctggttaataatggtgtcaatggctattgccgtttttccggtttgccggtcgccgatgattaactcccgctgaccgcggccaatgggaatcatcgagtcaatggctttaataccggtctgcagcggctcatgcaccgacttccgggtgataacacccggagcaatccgctccaccggacggaacttatcggtcacaatcgggcccttaccgtctaacggttggcccagggggtttaccacccggccgatcaaagcctctcctaccggaacggatacaacccggccggttctcttaacagtatccccttctttaatatgggtatagggtccgagaataacgcaacccacgttgtcttcttccaggtttaacgccattcccagaaccccgccgggaaactctaaaagctcggaggccatgcagtcctccaaaccgtaaacccgggcgataccgtcaccgacctggataaccgtccccacggagctgacttcgacctgcacctggtagttttcgatttgctgttttatgatcgaaccaatttcttcagggcgcaaattcatggggatttatcacctcgcagttttaaccttaaccgtaaatactacgctttaaacggtaaagctggtttttaatactgccgtcataaactttattaccaacccgcaccacaatcccgccaattaaatcgggattggtacggaccttcatggtcactttctttcctgttaaccgggaaagcttttcttttattaaatcggaaaggtcaccttttaattcccgggcggattcaacttctaccagcatttctccccgctcttcccggagtttttcagcaaaaagagcaataatttccggaagatatacttcccgccgtttatccaccaagagctttaaaaagcttttggtaatgggattaaaatcgggaaaaagcttttccagaagctcttttttggcggcaggaatcagtaccgggttgtccagaaccttttttacatccggtgtttcctgaatagctttttccagaacttcgaagtcgtgggatatactgtcaatagctcctttttcccgggccagttcaaaaagggcggacgcatatcttttagccacagccaaagatttcattacattttcacctcatttaagaactcgtccaccagcttttgatggtcttctaaggtaaccgcccggtttaaaattttgcccgcggccagtactgccagattgccgatttcctggcgaagctctcgaagagccttttctttttcctgggcaatggtagccttggcatccgcaagcaaagactgcgcttcccgctgggccgtagcgataatttcttctttttccgcctgcgcggttttctgggctttggcaataatttcccttgcctcttcccgggctttggcgatcatgccgtcgtattcggctttgatcctttccgcctcttcctgagctttggcggctttttctaacgattcttcaatggattttttccggtcttctatggttttcaggaccggtttatataaaaggattttcagtatgaacaaaaggacaaaaaagttaataagcgtccaaataaaatcagaccaatcaaaatgcactcataagtcctcccttcaaacgggataaaaccgcaccgcgaaaaacagtgcggtcttagctcatcttgttaagcagcataaaggcgataaccagaccgtaaatggtgagggtttccatgaaagcaagggcgatgattaagaatgtctgtacagtaccccggacttccggctgccgggccatagcttcaaacgccttaccggcggcaataccctgaccgataccgctacctatcgccccaaaacctacagcaatacccgcaccaatagcaattaaaccagcaactaaactcattgtaaaatccacctccgttaagatttaaaaatgattagaaacttaaaaatattaatgatgctcatcgtgcacggcttcgccgatatacgaactggttaaaagggtaaacaccaccgcctgaatggcgccggttaaaacccctaaaaggttaaataccaccggaattaacatgggcaccagacccataaaagtacctaccaccagctcgtggccgtaaatgtttccgtacaaccgcatggaaaggctcaaaggccgcaccagctgctccaaaatattcaagggcagcataaagataaacggtgagatgaagtgtttaaagtagcccagccctttttcggcaatgccgaaaaactgggtcgcaaaaaacacaatgatcgccaaagcagcggtaacactaatggttgaggtcggcggaacgtacggtccttcatggccggcaaaaggcagtaagcctatatagttggaaattaaaatgaataagaagaaagtcgcaataaagggaaaatatttcggtgcttttttctcaccgacaataccaccgataaagttataaagtccttccacaaccatctccaaaacattttggagcccccggggtacccgttccatttttcttgtcccaaggtaggaaaggatcgccaggaaaaggataatcccccaggaagttttaacataaagacttggatgcaaaaggccttctaaaatcccggtactttccgccatgctcccgaacacaattactcacctcctccgcccggtaatcccaagcctaaaaggctcagtttaataaaagaaaagcctaaaagaaaaccaataatctcccctacaccttttctcactataaagaaaattaatatggctaaaaggattagtcttaaataataacttatcaggactaacccctttccccgcccgattttaccgcctaaccaaacggtaagtgaaatcgcgagcaaatttataaaccccacaagaccacccagggcaaagcctaaggccaaggagggctggttaaggcggtagagaaaataagttattgctacaaaaaatgcgccgctaaaaacagtaactatcttttttttcattttatttttcccgggtgaagtcaaagattgctttaaaagcagtcattacgccaagcaccaaaaaaataaaggtaagccaggggtaggtagaaaattttttatccaggatgccacccagccaaactccacccaccacggagaaaaccatggtggtggctaactgcaccgaacgggctaaaaaataataagggttttttttatcaccgccgttatccggcatcccgccacccccgcaaaatagaccattttactttattcaacacgataaggcaaattccttcttagtgataacattctctaacgtagttattaaagatttttatagagaaaattcctccggaggtgaggagtcgattttataataatactttaacgcccggtaaatccgcaaagaagccttgccatcaccgtagggatttatggcattggccatctttcggtaggaactctcatcaaataaaagctctttaagatttttatatactgcctcggtaccgctaccaataagcctgaccgttcctgcctcaaccgcttccggcctttcggtagtgtcccggagcaccagtaccggcttaccaagggaaggtgcttcttcctggatgcctccggaatcggttaaaactaaatacgagcgggccataaggttggcaaaaggttcgtagtccagcggctctaccagatgaacccggggatgctccccaattacttctctaaccgcttcccggaccaccggatttttatgaacgggaaaaattacccttacgtcagcggcttcttccagtacttttaaaagaccccggtaaatgttttttaacggttctccccagttttccctgcggtgggtagtcattaaaataatccttccgggccggtttaagattgcctccagctccggggcaaaacggtagttttcccggacggtgtaatacaaagcgtcaattacggtattaccggtgacaaaaatgttttccggtaaaaccccttctctcaatagattttcccgggaggttttcgtgggagcaaagtgcaggtcggttaaagctcccgtaagtcttcgattcatttcttcgggccagggagaatatttgttcctcgttctaagccccgcttccacgtgacccaccggaatttttttataaaaagctgccagagctcccacaaaagtagtggtggtatcgccatggaccagcactaaatccggttgacagtcttccagtacttccgaaagacccaatagcgcccgggaagttaagtcctgaagggtttggcgcggggtcatcaggtttaaatcatagtccggggtaatgttaaagagctttaatacctggtctaacatttcccgatgctgggcagtaaccgcaaccttagtttcaaactcggaggaatcttttaatattttgtataccggggccatttttattgcttccggtcgcgtaccaaagattaaaaggattttaggcatcgcttctcctttctaaatggtggtcggtgataggtggtgggtggtcggtttatttcttttacccaccacttaagacttaccaccaactaccgttttaagtaacctttttcaattaatttatcaatatgctctcttagagctttttcaatgtctacaccgtacatttcttccaaaacaaacatcatggatactgccgtctgagccacatcgaggagttctttggtgataagttttgccacctcttcctcggacaatccctgctccccggaaagcccccgaaactttcctatagcttgagccagttctcccgcttcctccataagttttagagcagtggattccagggtcggcgtaagaccgttcagccggggcagcgcgattattttttgttccaccccttaaccctccccgtatttaactacctttatccctgcctcggtaaacaggttaatcgctaaagaatccggataatcgcctttgtaaaccacccgttctactccggcatttatcagcattttggcgcagagagagcagggttgatgggtgatataaatggtgcttccagaagttgaaaccccgtaaactgccgcttgaatgatagcattttgctcagcatgcaacccccggcacagctcgtggcgctgaccggagggcacatgttcctgctcccttaagcaaccgacctcctcacagtggggcacacccttcggagcaccgttatacccggtagccaaaacccggttatccttcaccagcaccgcgcctacctgccggcgcaggcaggtagaccgggttttcactacctcggttatctgcatgaaataatcatcccaggatggacgcatggaaacaccccatttaacagtggtcagtggtcggtcgtgggtggttagaaaaagatttaaaatcaaccacataccactgacgaccaaccaccgtttggaggttggaaaaatcaacaggttttgccaattaaaaccgctctccgaaaattaatcgttgtacggaagtttatcgtacagagggaagcggtttaaaagatcccgtactttccgggctgcttcccggtgtttgtcttcgttttcaggattctttaagaccagagctattatttcggcaatttcggccatttctccttctttcatcccccgggtggttaccgctggggtaccaattctaattcccgaagttacgttgggcgactcggggtcgtacggaatggcgtttttatttaccgttacgccaatttcatccaaaagctgctccgcccttttaccggtaagccctaccggacgcacatccactaacatcaggtgattatcggtaccgccggaaactaaccttaagccctgctttttcagttcttccgctaaagctttagcgttatttaccacctgctgctggtattccctaaactccggcgataaggcttctttaaaagctacggcttttgcggcaattacgtgcatcaaaggtccaccctgtaccccggggaaaacggtcttatcgattttagctgcatgctccgctttacagaaaatcactcccccccggggaccgcgtaacgttttatgggtggtggtggtcaccacatcggcataaggaatgggtgatggatgcaatcctgctgccaccaggccggcaatatgggccatgtccaccataagataggcccccacttcatcggcaatttcctttaaatgcttaaaatcgataacccggggataggccgatgctccggcaacaatcattttgggtttatgcttgtaggcaagctcaaaaactttttcataatttattttttcggtatccggctctacaccgtaactcacaaagttataaagcttaccggagaaattcaccggacttccgtgggttaagtgaccgccgtgggccaggttcatgcccaaaaccgtgtcccccggctccaaaaacgccatgtacgcagccatattggcctgagccccggaatggggctggacgttaacgtgttctgccccaaaaagcttcttggcccgctcccgggcgagattttcgaccacatccacgtattcgcagccgccgtaataccgctttccgggaagtccttcggcgtacttgttggtaaggtggctgcccatagcctccattaccgctctacttacaaagttttccgaagcaatgagttcaatcttttcccgctgccgggaaagttccttttccatagcctcaaaaatttccgggtccacgtcttttaagcgtaagttcaaatgggtcacattattcacgctcccttttattggatgtttggggtttacaatatttctcttcaatacccgctatcttttctacccggcgggcgtggcggccaccttcaaaggatgctccaagaaaggtgtccacgatatccagggcaagacccactcccaccacccgggcccccagagctaaaacgttggcatcattgtgctcccgggctgaatgggcggaaaaagtgtccgaacaaagggctgcccggatcccaggaaccttattggcggcgatggaaattcctatcccggtaccgcaaattacaatgccaaaatctacttccttttgcaccaccgcctcggccacggcttccccaaaatcggggtagtccaccgattccgcggagtaagtccctttgtcaatcacagcaatcccctttttttccaggtgcttttttatttcttcctttaagttaaatcccgcgtggtcagccccgatggctatcttcaccgttttcagctccttccttttccaatctggctattaatttttggattaattcctttaattcctgagcggtttgccggtaaacctcgatatccccaccaaaaggatcggccacatctccttcttcgcccacatattcttttaaagtgtatactttattttcaagttcggggtaaagctgtaaaagagcttctttatgtcctttccccatggtgagaattaaatctgcctgctgggtaatttcggcaaaaatccgggtagctttatggggcgaaaggtcaattccttcctcctgcattgcaattaccgcgttttccgaagccgggtccccatcaaaggcaaacagtccaacggacagtgcttcgtgaggtaagcccttctcctccacaattttgttaaagaaatactgggccatgggacttcggcaggtgtttccggtacaaacaaataaaacgttcattctccctggctcaccccctgaaaataagcttcccggcaattaagagtaaaataagccctccgacaatctgggcccgctcccctaaaaccttgcttaccctccggcccaacaaaagcccggaaagggtcataacgccggcaacaatgccggtaattaacgccacaaaccacaggtttacctttaccgtacccagggtaaagcctaccgacaaagcatccatgctaaccgaaaggccgataagtaaaagtcctaccaggttataagttacgtgcggtagttcctcctcctgggaaattccgtgtcttatcattttgtaaccaagatagataaggatggctccaccaatataggtggctacttttcccaaaaacctcccggttaaatctccagcaaaccagccaagaatcggcatcacaatatgatacaccagtaccgtaagagataaggcgataatttcttttcgtttaattttccccattccaaggccaacacacagggaaaaggagtctgtaccaagggcaaccgccagtaaaaaaatttcccaaagactcattggttccctcctgggttaagatagatacctgccagccgcagctttctttaaccggttcatcaaagctaaataaagtccttcttcgggatagacctccgccagaattagttctacatccctccggtcaaactcccggagtttctcatataagttatgtaaaagctctgatgggttatttctacttcccagaactaaaagattttgcgaataatttgggaaaaactgctcttttgtttctttagatattaaaagcccaacatttttaccggctgcccccagctcccgcgctcgctttaaaatttcttcgggagtttttaccaggtacaccggcgctctgggagcataatggggatatttcatccccggtgctttgggagcgtccaaatctttggcgttaaagtaccggacctctccgataacttcttcaagcatttccggagttattccgccgggtcttaagaccaccggtggagttaccgttaagtccaataccgtggactccacccctacgcggcagttccctccggctaaaactaccggaataattccggataaatcgtcaaggacatgctcgtaagatgtagggcttggccgaccggaacggttggcgctgggagcggcaatgggagtttgggccgcttcgatcagcattaccgccacaggatgatccggaagtcttacagcaacggtaggaaggccggcggaaaccaccgccggaagatcttcccggcggggcaaaactatagttaaaggtccgggccagaatttttccataagtttttgcgcccggacgtcaaccctggcagctaccctgtaaatgtcttcgtgcctggctatatgaacaattaaagggttatcctgcgggcgacccttggcggcaaaaatttttaacaccgcggcagggttaaaggcatcggctcccaaaccgtaaaccgtttcggtgggaaaggctactaactcccctttttttatgtattccgccgcttcattaataatagtttgctccgggttttccgggtttaccttaaaaattcttgtttccatggaaactccttttgttacttatattttttcggagagttttcatatacaatatcttacttcaattaagtttttccggcaagttttcttaaaattccgttaaaatttatgtaaaatatattataaactttcatcggcgaaaaagtacttgcaaaaaaaccgcccgggcttttttagccccggcggctttaagctatctttttcgtaaaattaccagccggtcatgtccggccagatcttttttaatttccacccggtataatttttcggcctcggcggtaatcgcttttccctggtacggggcaatctccagaagcattaccccgtcttccgctaagagcttatgggcttcgggtaaaaggcggcggtaaagcatcaggccatcctctcccccatccagggcaatttgcggctccttttgcacctccggcatgagggtggaaagttcctcagtgggaatgtagggaagattggcggtaattaacgaaaattttccgctaaaatcgagtttggaaaggggctctaacaaatccccgtgtcctaaaatcacccgctcatctactccgtgatgatgggcattaaccctggcaacttttaatgcttcttccgaaatatccaggagaaaaaagagtcccaggggaatatggcaggcaagtgctacccccaccgctccggagccggtgccaacatcggcaaccagctttaacccccggtactggcgtaaaaaattaataccctcttccaccatgagctccgtctccggccgggggattaacacttccggagttacgaaaaagtcaaggccgtaaaactcctttttaccgataaggtacgctaagggaatacgggaagctcgcctctcgacatggtccacaaaccgttcccattcgtactccgataaaacccgctcgggcctggtgtaaatcgccacccggctaataccaagcacatgggccaataaaagttccgcatccaaagccggcatttcaatacccgcagaggttaaccggtttttagcccagaggagcgcctcccgcagggttttaggcattaccatccacctgctttaaccgttccgcctgatcggtggtaattaaggcatcgataatttcgtccagatccccttccaaaaccgcatccaggcggtggagggttaagccaatgcggtggtcggtgacccggttttgcgggaagttataggttctaatccgctcgctgcggtctccggtacccacctgggatttccgggcggaagccagctccgcttcctgttcctgccgggctttgtccaaaagccgggcccggagtattttcatcgcccgctccttgtttttgtgctgcgacttttcgtcctggcaggttaccacaataccggtaggaatgtgggtaatgcgcaccgccgattcggtcttgtttacgtgctgaccgcctgcccccgaggcgcagaagacatcgatccgcaggtcgttggggtttatctccacttccacttcttccgcttcaggaagcaccgccaccgtcgcggtggaagtgtgaatacggccgccggattcggtggtgggaaccctttggacccggtgaacaccgctttcaaacttcatccgggaataaactcccttaccttcaatggtaaaaataacttctttaaacccaccgaggtcggtagggtggctgtccataatctcaaccttccagcccatccggtcggcatatttagaatacatcctgaagagatcaccggcaaagagcgccgcttcttccccaccggcaccagctcgaatttccataataacgtttttctcatcgttggggtccttgggaagaagaagaattttcagctttgcttccagctcttcccgccgctcctttaaatcatgcagttcgctctgcaccagctcccggaaatccgggtcaagcttctcgtccagcatcctttccgcatcttctatttcttttacggttttcttatattcccggtaaacctggacgatctcctcaatttccgcatgggctttaacgtacccctgccacctttgggtatcggcaatcacttccgggtccgaaattaaccgggaaagttcttcatatttttcttccaactggtccaacttgtcaaacattagctcttcacctcatcttttattaccgcttttaacgatgtgatggctacttctaacatgctgtcatccggctcccgggtggtaagtttttgcagccaaagtcccggtgccgtcaggattttccccagaagggtatggctaattttcgccgacccttttaacacttcgtaacttaccccggcaaccaccggaattaacaggattcggctaaaaatgcgccagagcaggttttggtcccccaataaagagaaaatgagaatacttaccaccattacaattaagagaaaactcgtcccgcagcggggatgcagggtagtgtacttcctgaccctttctaccgttagctcatcccctgcttcgtaagcgtggatagttttatgctccgcaccgtgataggcaaacacccgctcaatatcttccatgcgacctattgcccagacgtaaaggaaaaataaaattacccggataattccctcgaccaggttttgcgcccagtacgcttttataaccggggctgaagcgtgggctgcccaggtaggtagcaccacaaaaaggccaataccaacggcaaaggctaaaatcatggataggccaagttcacttttacttaatttttccccttcttcctctaccgcctggttggcggaataaaccagcgcctcaatccccaaaaccagggcatcgtacaatgctaccagtccccggataaaaggtagcttgaaaaatggagtatttagcgccgaagctaacgggcgctcttcaatgacaattttccccgaaggagttctgaccgccacggcccacttttccggaccacgcatcatcactccttctatgaccgcctgtccgccgtaattaaatttcatcctctctccccatttctaaaaaaaacgcagagccaaagatgctctgctttgttttagagaccgtactttttcttaaactgctcggcacgaccccgggcttctaccgtccgctgcgaaccagtatagaaaggatggcacttggaacatatttcaacccggatctcttttttggtagaaccggtttcgaatgtctcgccgcaggcacaaataacccgtgctttgccgtactccggatgaatgccaggtttcattcctatcaccccattttcgaatattaacacaaggtaaattataacacacccaactttaactggcaagtataaaagtggggacggttctttttactatactttaagtataattttagggactgtccctaaactactactttgaaggtggtgccctggcctacggtgctttcgacccagattttgccgccgtgggcttctaccaaacttttggcaattgccagtcccaggccggaacctccggtggttctggaacgcgacttttccccccggtaaaaccgctcaaaaatgtacggcaaatcttccgggggaatccccggaccggtatcggtaacctctattaaaagttttccatccagcagcttaacctcaagtttaaccttgcctccctcaccggtgtattgaaaggcattggttaaaaggttatataccacctgtttcatccggtcggggtcaaaactgtatttttctccttttgccggtaaagtagtttcaaaactaatactttttgcttccgccaacgaggtaaaaggagccgccacctccgagaaaaactgatttacctcaacctctaccggcaaaattttaagttcccccgcttccgccagggataattctcttagctcctccaccaaacgggacaaacgctttacttcttccgccagggaacgaagggtttcctcatccgcctcaataactttctccagcagtagttcaaaatttccctgcaaaatagaaaggggtgttcttaattcatgagcaatatcggcaatcatctgtcggcgcaacttttcgttcctctccagggcttcggccattctgttaaaagctctggccagctccccgatttcatcgttgctcgtttccggtgcccttaagtgcagatttttactgctaaacttgcccactacggctattaaagttttaaggggggcaagcaagcgctgggataggaaaaaaccgagtaccagagctaccgctaccgctaaaagtccaccgaagaaattggccctttttaccgaactgataaaactctcctctaaaaggccgtagacggtaaagggctgatagtaaagggtgccaattttttggccgtttaaataaatttcctgtccattttttaaaggaaggtctttctccttttggccaaggtattcccagttgttatccacaacaacggtgccatcgggggcagtaataattatcctctcctgccggggaccgccagggcctccagatctcctcccatgggacatttgcagtccagcctggacggcctcccagcctccggcaaaataaagctcccctatatagctcaaaatcattttagcccgggcatttatattttgttttacgtaaaaatcaaaagagtcgctgatttcctttaccgcaaaaaatgacgtgactaaaaccgataatactgcaacaattaagagcgccgcggtaattttaaccgtgattttcatccttttctcccctgggttttagtttgtagccaataccaaagaccgtttggatgtactccggatttgccgggtctttttcaatttttttccgaagattgctaatatgcgtgtcaatagttctctcgtacccctcgtaagcttccccaatagcatattctaatagttcaagccggctataagctttacccggattttttaaaaatgcttctaaaagtttaaattcagtaggtgttaaatcaagaggtttcccttttagaaaaacttcgcgcttatggggataaagggttaagtctccttcagtcagcacaatctcttcattgatagttttagcttccagacgttttaaaatcgttttaatacgagccgaaagttctcttaagctaaaaggctttactacgtaatcatcaaccccaaactcaaaaccaattaacttatccacctcttcggtctttgccgtaagcatgatgatggggatttggcttttctttcttatttcccgtaaaacctctataccactcatttccggcatcatccaatctaaaactattaaatcaggcttttctttgtaaaatgaatttaacgcttctcggccgttaaaagcggtgattacttcgtacccttctttcagtaagtaactttttaccatggtaacaattttcggctcatcatcaacaattaaaatttttctggccataaaaccctctccattgcttttttagttattatatcagtattttgttacaaacgtataaagatatctaaacataaaaaaccttacccttcagggtaaggttttagaaattaagttattgaattaccggaaccgggccaaagcccataccgtggccacctctaccccccatacccttaaaaccaaaacctttaggtccgggcatggtgctgttaaccatgtttttaaccctggtttcgatgttctttaagaagttatccgcctgggcctgggttattttaccgtcttttaccagctggttaatcttttccttttctttggtgacgataaagtttattagctcagtctcggttttccctttggctttagcgatttccaccagggtttttccgctgtgccgttcgcttattaaggtgttgacatcaattcccaggaagcttgctaattcgtcaggggttacgccaaagcctctgtgatgcccaaaacctttaggaccaaggtctacgctgttaaccatttgcttggtccgttcggttatattctgcaacatttggtcagcctgagcttgagttaattttccgtctttcaccagctggttaatttgggctttcttttgctcaaccaggtagttgaccagttcttcttcagatttacctttttctttggcgatttgggctaatgttttcccgctgtgccgttcgttaattaaggttgaaacatcaattcctaaaaacttggctacattgtccatcatgccaccaaaggccctgccaaaatgcctgccaaaaccgcggtaggtttgaactatttttgtggtggtagaggtggtaccgtcgttagtagtcgccgcatacaccgccggagctgccgccactaataggcccgtcagggcaattcccgcaatcactttcttaccccattcttttttcacttaaatcaccctccaggttaatttgtaaacccccgttggagctttcatttatatcataaccggagggttttaaaaagatttcagggaaatgttaaaaagttgtcaagattataaaagagctttggccaaagcccgggcaaaacgggataagccgtcagaagaatttactatttttatttcctctggattggtgataaagccaatttctgccaaaacccccggcaagcgtacgtttttgatgacataaaaggtagcggtttttagcccacggtctttaaaaccgaattcattgattagctgcttttgcactttagcggccaggctttcgctgtcctcccgccctgctttaaagtaggtctcaattccccgggcggtatggtcggtagccgcatttaagtgaaccgaaataaaagcccgggctcccgagttgttggcaattttcacccgctggggcaggggaataaaaacatctttatcccgggttagtaccacctcacctcccagcttttctattagtgccttgcccgccagggcaagctttaaggtaacttctttttcggcaataccgccggcgcctaccgctccaggatccttcccgccatggccgggatcgagaacaatttttttcccagctaaaagtttggcccacacttctaaaataacctgcccgccgtttaccctaacctcgtacaataactcctcttcgccctcaatcaccaaacgtaaaacgtcaggcttgtactgggccagccgtacttcttttattttatattttttaaccggtacttccttcttacctaccccctggactttggtaatgtcaaggacaacccggtaaggatttttcagggtaaaagatttgagcgaaggtttttggtcaaattccaggattatccgcaaaaccagttcggtttccaagcgaaaatttttcaataccgccatgataattccccctaaatagtttctactaattaaaatatgcgggggttttaaggagcgggataaaaaacgatgaaaaaggctctaaaagctaaaagctcttagagccttaaaattacccgttgatttctttttgaatttccgtagcctcttttttaaattccttaatggttttgccaaaggcccgaccgatttccggaagcttggccggaccaaagattaccagggcaattactaatatgattaaaagctccggaattccaattgagttaaacattttatccctgctttcctaaaagtaagtttttttcttcctgataaaacctgcctaaaaattccactatttcccggtagattccctgaatattttcttcccggcttttttccaccacccgctcgataaaggaaaggtggtctaccagaaaatctctctgaccgggatgattattttccaccaacatcgccataaactccagctccaatactaaatgatcgggcattcccgaaaaatcttcgggaacgataagccccgctttttcgtataaagccgccacatgcagggcgtggtcgctcataagaaagccgcggctattggccataaccgggtctacctcgggatccgaagaccacttgcggtacaccgattctatcaggcttactcttggtgcatagagcccaaagtaatcctgatactgccgcgaaagttccgggaaaccgggaagtttcccgaggttaactccaaatttcccaaaagctttagcaccgtcactttttaaccagcggtaaagttccagatccggttcgcttaaggcataggctaacaggcggtaaatttcgacccggttatgttccatagcccttcctcccttttagttcattaaagttacgggaactgctgccaataagattaacgcccgcaaggtaaagcctcctgccagtaccagcaaggcgtctaacgctttaatcccttttcccgctttcggggaagcggtagctccaatcaccccggggatgatgatacccagaaacaccagtactccccagaagtacaggctgtatttcccggacacaatcatttccgccgattgtctggcagcttccgggccatgggttgcaactatcaagaggaagaaaagaagtaatagctctattgccgcaaggccagtgtgcaggggcttaaagaaatcgggcagggttttgccgccaaagacaaagcttcccaagatagcggtagccattccggtaactaatgccgatacgacaaagagcaccggaattacggcattgttccagaagggtaccgctttaacaactcctaaaagcacgccggtgtaaacggaggttgcaaaggccaggaccgctccggcacagcgcagcgctgtattggtataatagggattttttagcttcatccagccgtaaacaaacgatacgggcataaacagggttaaaatccaggtaccccaggtaatcatcgaagtaaagtgggtgtaaaggtaaaatatccgccagggttcaaattttcctgcctccacccaggtaaggtctaagaccaggaatagggtgccaatggctaccagcggagctgctaagatcgttccggctttaattaatgcttcattatccttatttatcccggagcgctcggtcatgaccgctattaaaaaagctcccgctccggctccggcaaggaaaagatatatcgcaattatcattccccaagccatttaaatccctccttagcgtacgtagtagatggagggtttggtgcccaaatccccccgcaagggttttgcctgtttttgctgaataatccggtgaatttcgtcgttgggatcatctaagtccccaaaataccgggcttcgccaatacaggtagagacgcaggccggctttttcccctgctctacccggtgatagcaaaaccggcacttttccggcacacctttttcgtgatttatgacccgggcctggtaaggacaggccaccatgcagtatttgcagccggcacagcgcttatcatctaccagcactatgccgtcctcccttttatatgtcgctccggtagggcaaacttcaatacagggggcattgtcgcaatgctggcattgaattaataaaaactcccgccgaacattgggaaaactgcccgtttcccgttcttccagccgggtaaatttttccccggggggtagcccccattccgcttcacaggcaacggtgcacgcctgacaggcagcgcatttggtcatgtcaattaccatagcatacttaggcatttgccccacctccaacttttcttacctccaccagcacttcacagtcggccgatgctccggataccggttccacgtggcagggtatgataaaggaagtactggcaccttttttatacgcctttttctggtaaggtgaaaaacctccaaaaccgtgaaccatgaaaacagcatcgggatgaatggcttcggtaactttagcttttatggtaactttaccgtaatccgattttacttccactaaatcaccgtttttgataccgagcttttcggccgtccgggtattaatccaaaggacgttttccggcatgagagcatgcaggtactcgttattaaaggtggaagtatgggtatgaaccgcagtatgaccgtgcaggaagcgaagcttgccgtttccttcggtaacaccgggcggcacccaggtcggaacttttttggcaccggctttttcaaaagcacttgatgcaagttcaattttgccggactcagtcttgatttccggaactttgtactcggttttcccgtcatccagggcaataacgcctttttctacaagttgtttaaaggttacgttaaagggctttaacatctggtccgaaaactgctccaaggtaaagttaaagtactgccctatccccgcttcatgagccagttctttgataatatcatcaacacccatggtattatgaagcggttttaccgccggctgccgcagagcaacggcattaccagcaatctgcggcgggtcaaaccgttccaggtacgtggattcgggtaaaacgtaatgggccatcatggcagtttcgctcatctgcacatcaataactactaacagctctaatttctttaaagcttcaatccatttctgggaattaccggccgagcgcaccggattgtggtggttgacaatgtatgctttaatcggataaggctgaccggacaaaatgtgctccggtaacatttgaatcatcccaaggcctttggccaacggccatttttccccaccggcaccgtcaaaccgtttagccttcggtttttctaatttcggccagagaccttcccgctcttctactttggtaaatttatatttggggaatttcaggccacctttcataccaaggttacccataagggcgttgattaccgctccggctcttaccatttcggtactgttcatgtaacgcgaggtatgccagccgggatctaccaccgctgccggtttggccttggcaaattcttcggtaatccgttcaatcgttgctgccggaataccggttatctcctcggcccacttcggagtgtatttctccacttccgccgctacttcttcaaagccaattgtgtaattttttacaaactctttatcgtaccattcgtttttaatgatgaggtgaatcattgccagtaagaatgcaaggtcggttcccggtcttatcggcacccattcggaagcaagggccgcaaaattggaataccggggatccagggcgataagtttggcccctttttccttggccttcatgatgccggtaacctggcttacgtttatcccttctaccaggttacgcccgcaggaaatgtagtatttaacattgccgtagtcaacggtaggaacttctccgtacattgttttataagccacatttcgcggagagtaacaggtcggagcatgggcactcaagtttggcgaaccaaacgcctgattaaagattacttcataatcgtaagccagctccggatgggtactccaaaccaaagcttccgggccgtatttggcctttatttcttttagtttttcgccgatttcacgaaaagcctgttcccaggaaatcggcacaaacctgtccccttctttctttaagggctgctttaaccggtccgggtcgtacaaaagcttcataccggcattaccccgggcacaaattttacccttaccattggggtgttctttgttgccttcgatttttaccacccggccattttttactttaacgatgatgccgcatttggtaccgcacatttcgcagatgctgggaatcaattttacctccccggtttccgccgccttagccgcccagcgttcaaaagacatcactccgccggataaggctgccagggcaccggtagcagcagaagcttttaaaaagctcctccgggtaagcttcatacaccttccccctttattcgtgctgtttttcactttctatgttaattgtaaaacaatttcgaattgtgaaggtaatcgcaaagacttatggggttataaagataaatttatacccataaaattattctttgaattgtttttgctaaaattaattttcagcaaagttatgatataataaatattgatttaagtgacgggggaagaaagcatgaatttataccagtttgaacttttctgtcaaattgctaaagtaaggagtttcacaaaagcagcgaaattaatgcacctgacccagccggccatttccgctcaggtgcaggcaatggaaaatttttatggcaccaaattatttgagcgctcggccaccggggtaaagcttacccccgccggggagctggtttataagtatgcccagcactttttggccgaacacgaaaagttagaaagggagatagacaatttacttggcaccaatgcccagaccattgtcattggggccagctccactatcggtaattttgcccttccctgcaacgtgtggagctttaaggaaaagtacccggaagccaatattcgtatcgaagtggataactcaaagaaggttattgatatggtaatggaagataaggtggattttgggctggcggaaggaccggagtttacccatcccgatctcgaagtaaaaaaagtcggggaaagtcaggtggtaataatcacctcccccgaacttcccctggcccggcaagattccattaccgttgaggaattaaaaaagcttcctttgatcatgcgggaaccgggttcttcggtgcgggaagtgttttttgacgcaataaaaaaagccggggtcccggccaaggagttaaatattgttttggaactgggaagctttcaaggagttttggaagcggtaaaaaaaggacacggggtatcaatttcctgtttggaagcgattaaaaaagagttccaccgcaaagaactccactaccttactttaaaagatatggaacttaccatgccgtttttgctggtttaccgcaaagaccgcgcctttagcccgctggcaaaaaggtttttaaggtttattattgggcctgccgctttagaattttgttaaaggatatatttttttaaaaacaagattccaagatacgtaccgataatcagagaaccaccaaaaatccagccatgcagcgaaaaagaagcgattcctcctaccaggttgccaatattacagccaagggccagccttgccccaaatcccattaatataccgccaaagatccccaggaaaaattttcccggggactttatttttttaggtctaaattcgttgtgccacagagcagcaaataatcctcctaaaatagtccctaccaccaggagattttcctgggaaaacaaagtggttttaaaaaaggcctcgggataaacttcctggtaatacgcccacttttccggatgcatgcccaaaactttcaaccaccaggtaccccagtcggtaaggatgtgggtaacaacccagggcttaccccaggttaatagaagcaagatattcaaaattccgaggactatgccgccctttatctccgaccagccaagatcaacttttttcactttttctaccccttaataacgctgacttcccaaattcccggagaaatttcttctaaatcgtactcgtactttaaccttaccgccagatcaacgatattgcgcaccgaacggctaaaatcggtaataacggtaatcttatcccccggttgcagtttttttaattcttcctgcacccgccagaggggaaccgggcaaacttcgccggttaaatctatttttatttccatttacatttcctcccgtaaggctttaagtaaaaggaaaaatattattgcataaataataagtgtcgggaaccagccgataatgccgggcagccagaatttttgcgaggatattaatatatccttccagtacccgtaaccaaacgccccaagaaccgaaccaattactattcccagtaatactccccagtagtggaaaaatccctctcccacccgtaccaaagtgctaatcacacagccaccggctaagaccatgccggcgccaaaaataatgccgccaatcaccagatgccagcccaccggatttattttcccgggaggtacgttcccctgtaagactgccaaaaactgaacgacaaaaaagccggcagccgaaacagcaattaacaccgtaactccccggctcatggctttatcccgaaacataattaaatcccgaaaggccgaagcaaagcaaaagcgggagcggctaacggcataaccaaagccaatgccgagagcaaagacagccgcccgggtaaaattttgatttgcaagaaaatacagtggaactatcaagaaaaaaaataataagccgtaagctacctttctttgcaccttttatcacctaagtacattatatcttatccgctaaatttttgctttaaaaaagtttttccagaaaataaaacgcccaggagcgtcgtaatgccggctaaatttaaagcgggccaaagcccgctttaaatcttttttaacctccctgaaaatggatgctcacagaaccgtccctaaaaccaccatttttatttcgtttaagaggaggtctaatttttcttcgctttcagcttcgccgtagattctaaagaccggctcggtaccggaagcccggaccagaacaaagcttccgctcgcaagttcccacttcattccatcaacgcggctttcccgaagtactttttctccggcaatttctgttagttttaatgaagacagccgctttaagatttcttctttttgttcgggggttgttctgtaatcgtcccggcgagtataggaccggccgtagcgggtataaacatcttctaaaacttcagttaaaggctttttaaagaattcccggatttttaccgccagtaaatcggccaaaatcccgtctttttccggcacatgtccggcaatggataatcctcccgattcttcgccgcctaacaccgctccttccctcagggctttaccgatgtacttaaagccaacgggcgtttcaattacgttaaaaccattggcccgggccattttatctaaaaggtgggtggtaggaacggtccgggctacatctcctcccctgccgctttcaatcaggtaatggtaagtaaggattaaaacttcgttagcagtaaaaagccgctcaccttcgacaattccaaagcggtcggcatcaccatctaaagcaaggcccaggtcggcctttttattttttattgcttcgacaagaggttttagttctttttgtttgggttcgggcatgctcccgccaaaaaggggatcccggtagtttctaatagtacttacggtataaccgaagtccgttaaaactttttccagatacccctgtcccgctccgtacatcgggtccacgactaccgtaccctgtccgtagtttagaccggtaagcttttttaggtggtcaacgtaggcactctctaaatttaacgttaattttttccccttttcctttaaagaaggaactgccccggcatttatgagctgctccaggcgatcggttatatcaggtaacgccggtcctgcgtaatcggggatgaatttaaagccgttgtactccggcgggttatggctggcagttagcattaccccgcctatggccttaagtttgtttattgcaaaagccacgtaaggtgtcggcacaaacttctccggaaggtaaacatcaaagccgctttttaaaagaatttccgctaccgtctcagcaaaatgctccgataaaaagcggcagtcataacccactactaccgctccagctcgatatttctcctgtaaataagcggctaatcccagggttaccttttctaaactggcaaaggtaaaatctttagcaataatgcccctccacccatcggtaccaaatttaatcactcttatcccccttttctccttggttttttatcggtaatatccaccgtcatggtaagcttatcgtgttttaagtcaatataaacctggccattagcatcgatttgagcataggcgacatctttaatatcgtttatcccctgttcttttaagtaatgaaaaaaccattgtttggatattccatgctgttcaaaattttgttcaattagttctccgtcaaccaccagttctgccggaattccttcgtatggcggatctaagcccaggtcttcgggggttagcgggcgcttgggagatttaagcaataccgaaagctctccgttgggttccgcaatggcaaactccacgtcagcaatgttaaaagcacccttttcccgcagttgcatcattaaatcgtccatcgtataccgcattaatttcatgttatgttccaatatttttccgttgtgaacgacaatagtcggctcgtcctgtaaaagttttctaatattccggttttttaagcttgcccactggacaaaaatcgtcagcgccccaaaggctaccattcctgtcaggtaatgaatcacgttggtgcgcaaatccaccgccacattggcagcaatcgagccaatgacaatgccgtttatataatcggaaatggtaagctgccccagctgggatttcccaattaatttggtaattaccagcactgctataaaagctgcaattgaccgaaggattacttctgttaagtcgtgcacaggaacacctccacccctattttgaaaaaaaccgacggattttattccgtcggttgcataatttttgcattaacgggatagccttacagtagaggtgatcctatggatgaacgggaaagggccccattactaaagggaagcttttacggggtggttttaagtcttcccttctggtggttattattttatctccttttccactaattcttttaagtaagctttaaaaccttgagccagctcctcccggtccagggcaaactcgacagttgctttcaaaaagcccagtttatcgcccacatcgtaacgcaatccttcataaacatagccgtatataggtttcacctgacagagcattcttagagcatcggtcaactgtatttcgccgccggctccggggggagttttttccaggaactcaaaaatttccggttcaattatgtagcgccccattaccgccaggttcgagggcgcttcttccggctttggcttttctaccaggtcatacacccggtacaaacgctctccgacctcctcggcctttataattccgtacttgcttacttcccggggctccacggcctgtaccgctacgatactcgcttccactttttcgtataagtcgatcatctgctttaagaccggagtcctggccttcattaagtcatccccgagtaaaacagcaaacggttcattgccgataaatttccgggcgcagtaaatagcatggccaagacctaaaggctctttttgccgcacgtaatggatgtccaccatatttccgatggaacggactatttctaaaaggtcttcctttcctcttttttccagatacatttccaattccggcgacttgtcaaaatggtcttcaatagcccgtttgtttttaccggtaacgattaaaatgtcctctatccccgacgccaccgcttcttccacgatgtactgaatcgttggtttatctacaataggaagcatttccttgggctgagctttagttgccggcaaaaacctaactccaagtcccgctgcaggaataatggcttttttaattttcatgtcccttacccccctcgtgaaatttttaaaccctccacttttcttattataataaaattaccttattatggcaaattaccatagacttcatcgtaaatttctgccgctttttgcacaacatcttcgtttaaaacggtgtaacgctccggtcgcatagagggggcaaggtaaaccgcttctaaaaattgctgtttgttaaggccgatactttgcggattttcccataacccgaattttcgataaaagtttaaaagttctttgaagtttttcccctgcagggcagcggtaaacaacgccgccacccctacctgctcaccgtgaagggccggacggtcaaaaagtttatctaaagcatggctgattaaatgttcggctccgctcgccggccggctgtttccggcaatcgccatcgcaatcccggataaaaccaaaccttccgctaaaagctttaaaaattccggtgctaaaaggttatctcccgaataatttaaaatcgatgaagccgctttttccgaaagcatgtaagcaaaaccatccattttatctttacccttttgacaggccagctcccagtcgtttaaggcagttatattcgagattaagtccccgatccccgcttttaatagcttcaccggagagtttttaatgacctgcaaatcaatcaataccccaaccggcatgttaactccaatactgcggagcttttctccatcccggattaccgccaccgggcttaccaccccgtcattagctaaggtcgtgggaaaagtgataaggggtaacaacttttccgttgccaccacttttgccacatcgataacccgtccaccccctacagctaccagcaaatcggggttcaccgtatttattttttcctttaagttactaatttcctgtaaagagttatcccctacctggtaaaaattatatctttccgcctcaaagccccgggaaacttcttccgcaatcccccaggtatttgctcccccagttataaagagagggttttcaaaataaaagttactttcccggataacgttttttaaatgataacggaggttttcctcgatacggataaaaagcggtaaacttataaaccggttaaataacggcataaaaatccctcttaccagttgattttttgagctatttcccgggcatattctaaatctttaaaatcatcaatttccgtccataaataaccccgggtagataccgggcgaattttcagctccggtaaaagagtatttaaggcagtttcgtaccagccgtttacttccccggcctccaccatttcccagcagcgattaattacctttcgagctatatcccggctaaaccttaaaattcctatatattctccctgcgcttcgcggggatttacctttttgctgatatgggttataaagccatcttcaataactactttcatatcttcttcatctaacgggttaacgtcatctaccaccagtacatcgggataattttctgaaaaaagctcatccaatatttgcggagcaaaaactacatcggaattaaaaaggataaaaccgtcggataagtgatcttttaacagagccaccgaatacacgttatttttggtattgtactcagggttttcaataagctttaccccgggcggcagtactttttttaaagcttcaatccggtaacccccaactacataaatatcttccgctttaattcccctttttagcgcttgctcaatttgtttttcaattatggtcttgccgtttatctcaatcatcgctttcggccggtcggaagttaaaggataaagccgacttcccactccagcagccaagataaccagtttcaccaatctttcctcccccgcaacttgtaatcaaccagcactttcagggcaaatttcggtaaaaccatcattcttttgtaccgccagggctcctggattaaccgccagagccactccagacctgctttttgcatgaatttgggagctcttttggtaacccccgcccagacatcaaagcttccgccaattcccactgctaccatgggctcaggggatttagcaagtaaatttctgataaaaatttcttgtctcggaaatcccattccaaccaaaacaagttcgggattgcctttaattatttgttcgattttttcctcatcattggtaaaatagccgttttcaatacccacaatttcaactgtattgttaaattccagtaatttaattgctgctttttccgcaacaccgggcttggcgccaattaaatacactttcaaattgtctttttttcggataaccccttccacaagctcaatccccggtaccctctctttaaacgattggccttttatcttcccggctaaaactatccccaccccatcgggcaggattaagtcggcgtttaaaactaattgttttaaatccggattatttaaggctgcataaatcatttccggattaatagtgatgatatgggctttccttctttcttctattaattttatcaccttatttaccgcttcgtttaaacttaagctggcaaccggaaaatcataaatttttattaccgccatttatctcaccttgactgccttttaaaaatgcctttaccatcaccatatttatagctatcaagaaaatccccaggatgcttcctaataataaaccgtttccggttctaattaaacttacccacagaggatcgtactggtgagcaaaagtattgataaccgtaaccggtgctaagcttccaataaccagagctatataccgtatctccggtctcacttttgtccataatccccaaagaagcaaaggatagccaatggcaaattctttaaatctcggccttacatacaggtacttatttagcagggcgcgaagctttatctcgccgggtaaaaccagcgattccgcagcatttcccgtccgcaacaggtaataagcaccagccccgaaaacaattattagcgcaaatagctgccacaattttaattctaaacctaaatactcaaaaaccacttgttttaaacttttttcccgtactaacaaaacccttgcagcatagatagcaaatattaataccggcagaagaaaagataattttacaccccgaaataaatcggcatgaacaaagtaattatttccggttaaaaaggcggaaatcgcaaagcctccaaaaacactgattaaaactacaatgacaagagaagccaatgcctttaaaaaggagtttggattcttaatatcgatactaaatagcgcaattagcggatataatacggacgcaccaaaagcacaaaatttaaagtacaaatcgaaattcaaggtaaataaagcaaaaccaccaataagtagaattacggtaaaagttagagcggttttaatatttactaaatcaaatagcaccagggaatatccaaataagacaatgagcaataccgataataaaagtttttcaagctttctttcgggtattttctttagaggattaaccgggacaaattgataatttaaacttttcatcgtttcataagtttgggaagtaacggtctcaaaagcaagaacggtagttttgttaaactcttttgccggaattttaaaaacaatagctttattcctccgttccctgatgccaatttttaaactttctattttttcctccgtagttgctaaaatattgccgccttcaatggtatttattgtaacttgccgtacccgaaaaacagggagcttagtccggttaatcatagcattagtttgaggctggtcaataccatctaaaagccctacggaaaagttttcttttaaaaaggtatcggcgaaaattttggtaaatttgttgttttccggcaaattcttatcggcaaaaacaaccttgggttccgggcaaaaagtttttatataggaaagataattttttacttcttgttcatttgcgatactccactggggaataaatagcagaacatctaaattgtttttccgggccatttccaaaccttgaggattaaaacccagtagcaacttttccgtgcttttatatggatagtttatttttagaatatattttttatttacttgctgtaattgatttttaatattcctggcacttaacgcgtgaattgccgaatcaacaatctccttgttatcggtaattaaataagtataaggtgcttttagttcaatgaaatctttgaattcaggaaaagttgcaactgcactaactcccaaaaaaagtccagcctcctggttaaatatttcctggctgctaccattctcttcatacaatgctaagccaacaaagcccgttttctttagcctggctatggtttgctccggtgttaaaccccagtaactacttaaatttattaaagtttcgtaatccaagtaaaaccccgtttcttttttcttatcttcagcgatccgcggaggcaaaagaattattgaaaaagcaaaaataaccagcagtaagattgctaaaagtatttttccttttttcaccctaaatcccccaccctgcttagctaagaattttatttaaataaccgtaaatttttttgttacgtataagttgcggcagtgctaatcgttccatttgtcttaatagctgttcctttccatggggaagttttttttcgcgattttgggcctcataaagcgtctttgctataatttccccggaatttcccgcagtattgctaaaaattttagctttcatagcttccctttgacttaagaaagcatcgttatgcaataattcttcaatcacccctctaacttctgccggttcattcacctgccgacagtagccgcgaattatattttccaagctttcttttgaacttaagtgttccggaatttgcggtaaattaaataataatatttttttgccggccagcatagcatcaaaaatcgcccccgaataatcggaaataaccacatcagcaattttaagtaaacttagtaaatctgcagattcatcacgaattactatcttatttccttctgcaactttgagaccgtggtgtaatttggcaatcaccagataacgttcacttaaatcttccaaagccttttggtaatatccccaggaagataattccccgtaggtgggcaaataaagaattaccggtcttcctttagctaactccaagaccttatcttctactacttcccctttaaaccaccggtcaaatctgggattgccagctttcactaccggcgcatagaaggaaagtttttcggcatcgtaatctccataaacaaagattaaatcaaaaaaaatattccaccaggcataattccacccatcttttgctaaaccataaaccatccggaaatgatgggcctcgggctttaaccggtagaccgttggaaagaaaaacggacctaaaaatactttaatattttcttttattaaattttgttcagttttatcaatcatctgccaaaattctattcctttttccgttaaaaattttcttgcttcccggacattgcggacatacccttccgttaaaataatcctgtaatcacttttgtttaaatgtttaattattggttcgtataaagtatagtgaaatttggtattcattaaaaacccaatcataacctcgcctccaaattaaatatccaccctctctcgggtggactaaaaacgctttcctaaacaattttaattattaattatagtttttcccttactaagactttcccctaacactcctatcttctgtgctccaaaagttatcgccgctaaaataattaatataagcaatgctgcctgggtaaaagttaaaagatttacatacaacgcaacaatgccaagtaaaatgtttaataaataaattatcaaaacggtttttctttgggaatagcccaaatccaaaatacaatggtgcaaatgtcccttatccggtttaaaaatcggacggcctgcaaaaaacctccttaaaatcgcaaataaagtgtcaaaaataggtatagccataactaaaacaggaacgaaaattgaaatcaaagttggacttttcgcggtacccaaaaccgacaaaatacccaaacagtatcccagaaacattgaaccggtatcacctaaaaatatttctgccggattaaaattaaattttaaaaaagccagggccccgcccgttaaggcaatcgctgcataataagcaaattcatttccccgggtcaaggctgcaatcccgataaacacagcagaaatagcagcagtccccgaagctaacccatcaagaccgtcaattaaattaatggcattaacaattgccacaatccagaaaatagttaaaaaataagaagcatctcccagccaaattaaaccgccaaagggattggtaacgtaatttacttttattccaaaagcaaccggaataacggctgccataatttgccctaaaagctttactttgggatttaagctataaacatcatctaatattccaaaaattattaaaacaacacttcctgccaaaatagccagaaccttctggtcaattggtaacagtaacaaaactgcggcagtaaagccccaaaaaatggcaagacctcccatgcggggaatgggagttttatgaacttttcgagcatcgggaatatcgattgctcccactcttaaggcaatttttttaaccatgggagttaaaattaacgttaaaattaaagcaagggtaaatatttgaaaagttttaatcactaacacttaaatcatctcctataaaaaataaccctaaagattattgtaacattttcggcatttttctcaatagcaattttttctttttttaagcaagggcaaataaaatttccgcttcaaccactaactcaccattaacttttcccgaccctctggctttcccaagactcccttttatttttaagagttcaacttcaaaaaccacctgatctcccggtaataccggctttctaaagcgggcaccatcaataccggcaaacatcggaagctttccggcataacgttcatcggttaaaattgccacagctcctacctgggccatggcttctaatagtaaaacccctggcataataggccgccccgggaagtgcccttgaaaaaagggttcgtttattgtgacatttttaattccaaccgctttttccccgggtacaacctccagaatcttgtccaccagtaaaaagggatacctgtggggtaatatattcataatttcggtaatgtctttaattgcctcactcattattttcttgtaacacccctttaaaaattattttcttttccacaatattatttaaccgtttttcaatttctttaatgtcggtagtttttgataccggataagcataaacgatatctccctggccaatttcatttaccagatcgtaatttatcaggacttgatatttaataccgctctgccgaactgcagccatatttaaagaattattttgtttagccttccacaaaaatccctccacaccggtattaagatttttacccaccagttctctggcggcatttacatcactgataatccggcttttatactgttctaacgactcccccggtttttggctccaaaagccgttatccggaattttatgaccctcaataccaaactcagccaatcctaactggcttatagcccgcacttcctcccagttcatcatttccggccgtacacctatataacctgttattaaaaacaaactaaatttcatatcataagctttaagtaagcccgccccatcgttaaaaaatcctttatagccgtcaataaaaattagtcccacgggtttaggaggaggtaaattcctttccccaacataatcggcaatttcaccggcggttgcggtctgaaagccgccctctttaattaattccagaatccggtcaagggtctggggatagagggcataaatgttttgatcatccaccccgggtggtttaatatcaagaaacagaaaaaccggaatatggtataactctgcttcaacctcaaagcggtatctatcttcggttaataagttaccatcattgtcgcggccatcccaggtaacttcgttagtgcctttttttattctttctaaattaatctcacggaccaggtcatttacctcgttataaatttttatttttccccgggctaatattggagagtcaaaataaattttatacgaattattttttgctccaaaaccaataactttaaaagtctttaagtcatcgggggtaaaaaagtcaaaaacatcaccttcaataaaaaatattccgagagtaaaaattgcaacaaaaataattaactgaattaagataatctttaaccaaaatttcattaaaactgcccccaaacggcaaaaaatttatcatcaggggttttcccacaacaaattggggtgcaaaaccaaatattcctattagcagccaaagtaaaaaagtcttttttcccgttcaccgaactccctcggaaacctggctgttataggtctccccagcggtagtttcgggaatactgttcagaggtggtggttgttgctcagtcggtggggaataaccgacgggaccattctggtaagtagtcccgccggtagtactatctgagctagggggtggaatagttttctgattatcattttgagctggcggcgtagtttgttcggatgtacccggaggcaaagtagccttgtcaccatcagtgcccgaaccatttccgggatttggctgataagtatcactacctgtggcaggttttttctgataggtttccttagtagttgaagtttttggagtcttaacagtttttttcttcttgacaattttaaccccggcattttcttccttggtaccaagaacgatattttgttctatttgtcccgcaaacagcatatctaccaggtttttagccacttccaaatccgcctgccagtagcttacgccattgtagttgtagaaatatcccggaagggtctgggtaatgatgctatccttattgagctcccgactaaaggctaaaagcgacatcaggtctttggtggacatatccgtttcaaccatttgaataatttccggaatgagtttgggaagctttaaaagcgttcccggttgcaaagcttgttcggctaaagcttttaagaatttctgttgcctttgggtacgactaatatcacccaaagcatcacttctataacgcacatacattaaggctttttccccgtttaagtgctgccgaccctttttaagattaatggtatagggatactcatcagcgtgatacatgtctttctcaacgtcaatggtaaccccgcccaaggtatcaataacttttttaaaatcttcaaagtttaccagtacataatagtccaccggctttcctaaaaggtcagaaaccacttgtttggttaaatctatcccacctacaacatgggccgcatttattttatcccagccgtgccccggaatatttacccgcgtatcccgcggtatggaaaccaggacaactttttttaaattgctgtcaatgctggcaaaaataatggtatcggtacgctccctgcggtttttactatggcggtcatcaacccctaaaagaagaatatttaccctcccgggtttttcgctggcaacggctatgttatccccctgggttcgcgggggggtaaagacatctttcatggtatagtaaaagtaagcaaaagcggttccgataacaaatagcaaaattaaaagggataagagtaaaacctttcgccgccgcttttttttacgaagaatctttttctgcactctttccattgcggagtccaagcttatcacctcatttcctcatctattttactttattttaaaaacttccacaatattaaaatcttagaaaaaagaaaaagcggaaagggtcttccccttccgcccttgataagaaatttgggactggataaaaccttgattctgttgacggtgcttaggttctttataaactcctgaaatagacgagagtaattataattactgaagttttacgtattttttgcttacatatccaaattttccgctcgaggtttttacataataccaatcgccggtagacttattaaggtaaacagtgaggcgtgtatttaaaggcaatttcgcaatgatattattgcttgaaacctgaggtgttttccttaagtatagattattagttgctactatcccaactcttgttgtatcaggaactgcaggattagaagctgacaattctgcaatttttttctccaaagcagcaaggcgagcttttaaatcatttacctggtcggcaaccaccttcacctgtttatccacataacttttagctaccagtggatcctggggtgacccgggaaccacatcttcattctgagccaagatttttccccccaggattagcccggcagtaaaagcgataattatacccaaaatcacatatacgttttttttcataaaaaccaccgccttcaatcgttttaattatattttaacactttttcggcagatttgtccaaaaaaactggtaaattatccgttatccttctataattaaatatataaactacggccaaagggggtggaaaaatgattaaaacttattactacaaccacaaaactaacaccatggaacatgatgtggatttatccagacttgcggaacttttagcggatcccgaaagcatgctgtgggtagatttatacaattttgaggaaaaagagctttactacctcgcccgcatttttaactttcacgaattgacggtagaagactgtttaaccttcagcccccgggccaaagtggataagtacgaaaattattatttcttcctgctccacgccttaagatacgatgaagaacaggatgaagaaatccttctggtgcagttaggcgtttatctgggcacaaactttatcgttaccgttcataaaagtgcccttcccagtctcggtaagcttgctttggtatgccgccggagttccgaaatctgtgtaaagggcaccgaatactttctttattcgatcattgacggcattgtcgatgaatatttccccatcctcgaacaagtaaccaaccgtatcgaggacctggaagatgaaatttacgaacaacccaaccgggaaattaccgatgagtttattgacttaaagcgtaccattttagcaatccgcagggcaatatcccaccagaaaaggattttcggtaatttaattcgtccacctttcccgttaagcgaagagataaagccttatttttccgaccttgccgaccatttagagcgggccaccgatacggtcgatagccagcgggacatgctcgatcaaatcttaatgacttataactctattattactacgcgaaccaacgagacaatgcgggttttaacaatcatttcgaccattttcatgcccctcacctttgtcaccgggtttttcggaatgaacgtaccatttccggcccagaatcattatatctctaccggcattatcaccgcaggtttaatcgctatttcttacggcatggttcgctggtttaagtataaaaattggatgtgataatggtggccaattagacattggatagtggaagtttgaaattggaaaataaaatgcaaatactggctaaagccagccctaccataacggagaacgccttgatgtaagaaaaaagctgcgtactttgagcgtacgcagctttttttcttttacatcttctcaaaagcatccttgtcggcgccgcagtcggggcaaacccagtccgccggaaggttttcaaaaggcgtacctggagctatcccctgagactcatcccctacttccgggtcatagacatacccgcaaatactgcaaacatatttgtccatcccaatacctcccatgatatttttaggaaaaaagttttcttacttcatttacaagctttacatcacctattaaaagcgcccctacaagtttttcatccttgtagtaatacttaaggaagttatctccccggtcttccctacgggaagttacaccttcacccataaccgttcctatactgaaaacggttttcccaaaaacctttaaaacattttgaggaggaataggagtataaattttagatgctccggcagcattagccccggcaacttttccctgctccattgccaccggccaaatgcccggcatctgcccctcaaactcggctacatcaccggctgcataaatgttttcccgggaagtagccatatacttgtccactataatcccccgattaatgcctaaagttagcatatttgctacttctaagtaaggccgaacccccgttgaaaataccacaatatcggttgctactgaacttccatccttaaatactaccttttctacctgttcgataccttcaatccggtctacgtctcttgcaagataaagttctacccctgcttcttgagcagctctggaaagaattttggaaccttcttcatccacctggcggggtaataagcggtcgttatgttctacaacccctacccaaactccccttttgccgagataatacgccacttccagtcccaatactcccccacctattaccaccgctctccgggctttttccgcacggtcccgaatggcctttaaatcatccaaattccttaaggtgtaaacaccgggaagatccccaccggaaaccgggggtttaaaagcataacttcctgtagtcagaataagccggtcaaaaggtactaccgttccgtcatgtaatgtaagctccctggattcaaggcgtgctccggtaacctttttccccaggattactttgatcttcctttcctcataccaggaaggagggtgaagcaaaagactttcttctttcagctcgccacttaaatattccgaaagctttaggcggtaatagggatagtatttttcggcggaaataagggtaatttccgcagtatcgctaacctcccgggcagcggcagctgctgaaacccccgcaatccccccgccaacaatcacaattttcatcttatcaacctcactttgttgtggtcagtggtaggtcgtcggtggtcagtataataattttttcctaccacctaccactaaccacctatcacctactacttaccacctaccaccgtccttacccccatttctgcttggtcatgtgggtagcaagctcggcttttatcatttgccgaagctcataagcggctttcgtagccttttcaaaaatatcgacgcaaccagggtctaacttaatttccagacccctttgagcaagctcagcaacaattgccaagtgtttagcaagattcatatgtatatcgttggtttcccgggactttaaaacaagttgggctacatcctcttccagttgattgaatttttccttgggcgcaccgcatttcgggcatttatccggggcatcagccccatcccagataaatccgcacaccgagcatttaaataacattaggatatgcctccttttttaattgtggtaagtggtctgtcgcaagtggtaggtaaaggttttaccgacgaccaaccacttatgacttaccaccattaatagttttcacttaaaggcatgtagtagcctttagcgtgtttacaaaccgggcagacttctggtggctccgtaccttctacgataaagccacattcactgcattgccagcgaatagccgtatcccgttttaaaagcttcccctgagttaccatctccaaaagcttttggtaacgctgggcgtgaaacttttcgatagttaccagcctctcaaataactcggccgcctcaatctctccttcttcccgggcaattttagcaaattccggatacatatcggcatactcgtaagtttcgccttccatggccgcttttaagtttgctgcagtatcccctaaagcccctaaaagcttaaaaagctgttcggcatgctctttttcgttttgggcagtctcttcaaaaaaccttgcaacctccactaaaccttcttttttggccaccgctgcaaaaaaagtatacttattgcgcgcctgactctcgccggcaaaagccgccagcaaattatccctggttttgcccatttcaaaaacctcctcaagggaaaattttgttattttcattatattagtctcacgtctaaaaatcaatgcacttaataataattattatttaaatactgcaatttcagcaaatttttctacatttttttcatctgcataaattttttatctgcaaataaaactataaataaagcgggaagaaatcccaatcgtttcgttgaggaagccccttaggcgaaaccgggatttccgcccgctttaaaatttatcccagcggcgggcccgggcttaccggcagtaagataacatcaccgggcattagcttttgcgggtctttcccaggatttaattttataatttcttccaccggcacgccgattttcttggctattttataaaaagtatcaccgggttttattacgtactccatcgtttccggaggcattcccgccacctctcctacttccgttacaacatcctgggatacggtttccgtaacttttgctcttacccggaccaccacttcagcttgaagggtgcaatgctcgatcacttttacgttggcgtattccaccttcggccaggtataaagattttggccgggtttggctccgggaatgctcaccgtaagtttaaagggtacgtttatatcaagatggcggatttcctccgagccttccggcaaatacattaccccaagcattgcttcgccctgaatttcgctctctccatcggttaagcgcgaagttttcaccacggctttttcctgatggatatggaggatttttacctccccatcaagtttccattctttttgagctgtagtctgggcggtattttcacccaccaccctttcggctataagctttttagtggtgtattcggcaccggtgagtttggtaactattcttaattgtttttccattaaagcttgagccagaagttttagttttgcttcaattctaaactcccgattgccaagttttcctgcttttatctctaaaatttcaccgtttacctcgcctatcatcccttcttcggccaatggcacttcgataaattcaaatacgggaatggtaaaacgaaccgtatattcgggatcctcatggtgataagtgactttggcttcaatttctccttccaccaccacttttccggctaaagctctcgccgatttagcccgaaactccccggtaatatttaaaacaccatcaatatccggcttatctttgggaattttaacccggctttgataggatttttccttttcacccgtcccaattactgcatctactttaattaaagtcttttcgggaagtaaattatccggtacgtcggttatcacctccaatacggtggtttttaccgcccgtaccttatttttaagagttacttcgaccgacaacttttccccctcatcggttatttttgctttaaaatttatgacctccgaagttccctttaccagatctcctttgcttactcccggtaaatccagtaaatcctcaaaaggtagatttttttcataatgaaaaacttcatcgtgccggttttgagcggagtagtatatatgaacggttacaaccccgttaatccttactttgccattttccaccatagccttttgaattttactttcagcataggctcttattattttccctattggcagtaagtagtatggcagctctatcaagctcattaactttagctctttttccgcttcccccaccaaaatgttgacctttaactgctcttttaaaatatccatttttttcacctccttcttttcttaatttatagtatgattttgcggctcatgacgtttttccagaattttatggattaatttaatcatttttatcttttataattaagacaaggaggggtaacatgaaaaaatttatcactattaccttgcttgcgctttttcttttagtaaccacccttgtttccgtttccgcttataccttgaatattgtaatcgtaccaaaaaccactcctgcggttactcccgtgccttctgcctcggttgctgccaatactcagggaatagtgctgaccgctgatgaaaaaagattcttagagctgaccaatcaggcccgaataaaaaacgggttaaagcccttagcggtcgatccgcgcctggtgcaaactgcccggctcaaagccgaagatatggccaaactcggttacttcggccacatctctcccacttacggtaaaccttccaccatgatgatagcttatggcattaaagattaccggtggattgggggggaaaacttagcgcaaaactctacggtagaccgggcttttaacgctttaatgaacagccccacccaccgggccaacattttagacccccgctacactcatatcggggtagcttcggtccccgggggccgttacggcaagctctgggtccagcacttttgcggcaagtagtaatttcgggacagtccctaaaattatactttaacggtaattttggggactgtccctttttttatactttaaaacccgccggagaggcgggctttaaagttagtcttcatttaatacgaagagaactaaaatgaacaggaagaaaaacatccattcgttatttctccagctcatctttctccctccttttggtttctaccttataatattcaattaactccttcggggttactgtccggcttatactccaggatttcccgtagattggatatggtaaagcttatcgttgataaagttttctttaccgtatccagcgtaaagcttattgatcttatgtgtctttccatatcttccgatagggcaattaaaacaacaatgattaagaggatttttaagtttttattcgttacaaaattaaacgatgcctgttccggcagagcatttaccgcctcctccataacttcacccccattattaaaatatgaataaagaaaagccggggttcttttcctcttcttttgcataatatggtatcaaagggtaaacaggaggtggaaaaattggatttagacaaacttttagctcagggtaaaaaggaacttttagctaaaaaaattgaaacggtaagccccggcggcggaattaaagtagttttaaacgggcttatggaagttatggaaataaaaataagtccgtccctctttaaagaggaaaaagtggagtatttagaaaagctattaaaagaaacctttaatttagcagctaaaagagctcaaaaaataatagccgaagaggtagaaaaaaatctttctaactccccgttaagcaatctttttaatctctttggctaagctaaaaaaccctctcaattccattcctggaatctgagagggtcacatttttctaaagggtatggtaaagggcttgaaatttttccaggtgtactatttcgtcgtttctaatttcataaattacccggtccactttttctaaagtggaataatttataatctctaaataatccctgattgccgcttcttcccctttaattgccttttgcaccgcctctttaatattggttactttttccggcaaaaccccggtaattaccgggcttttacccgtcagatcccgatataaatcggaaatttttacaatatgttcccgttcatcgtgtcttgcctcaacaaaagcttcccgcaccaaataatcgttagtcgcttttaatacttccgtgtaaaaaagctccgcctctttctcatcttttaaggccttatctaacatttccacaagtttatccaagttcatatctatcccttcttccataatttttataaataaagccctccaaggagggctttaaaataggattaatcttctattccaaatagtaagaggattaaaagaaagaataataagaagttcattggcctatgatgatgttcatggttgccgttgtagcccatacggtgacctcctttcacagtaactttaacctacttttattcctccataccaaagagcaggaggatgaggattaggaagaagaagaaatccattcttttcttcatgaagcccattacactacctccttttctgcagtggtacaagtttcatgttcatcatcatggtcatttagcccaaagatcaacaggatgagaatgaaaaacaagaaccattggttgcttccattcattgacattagcgtccctccttttactctgtctaatttaacttatgaattttagggcaattaggttactatgagttctaaaataatcttttaaaacatatgctgttaaaagacaccgataagttgaggtggtaaaatggcagaggaaaaagaaagtagaggctctttaatcgacaccttgctttaccttcttgatcttgaaagtaaacgcggaattgatactgataaggttttactcaccatgcttttgctgaatattaccgcggtaacaaatctcgttctccaccggatctccccgataagctttcaaggagcggttccaggccctataccccccggtgagctaaccagcctgcttcctcttttaacatccctgatgcaaagcaaaggtgggagtggaggtaatttaaatcccgctctaatgagccttttgacaaattttttatctcaaacttccgaacccccaaaaaaagaactccctccggaaaaggaggggaaaaaggaagaccaccgaaagtagcaaataagctggtctggcgcatctaacagcagtcttcatccagtaaaactaagaaaagcaaaaggagcaggaaagcggcagcacagcgccggtggtggcgttcggtcataaaccagcacctcccttttctttctttgctatagaatatgaaaaaaattttttaaaggtttcttcaccgcacccttttcaaaaaaacgtcatattatacaatagcaccgaacaaataaaagctttggaagggaggaaattacatgcgccaggttgaagtaaactgctgtccggtggttatggacgcggttaccgagtcaggaattaagtgctttcacaacacccatatcctgtgtaaagacaccaacggcaattgcattccaattgacgcatgtattttaaaagctattgtttatgatttaaacattatttccgttcaacaggtcaatggctgcatgaacattaaaggtacctatagggtaagggttctttacgaattcgataaccagacccaggtaggtactgccgacgagcaatttgattttgatgtaaacataccattagctaaaaccgactgcatcgttgccaaatgtgactgctgtgaagaagaatgtgcaaccgctactaaactccatgtaatttttgccaccgtggaaatggataccaccggttcctgtcagggacaatgcacgggctcccctgtagtgcgcatcagagtaattgtggaaaaagaatttatggcgtttaagcactgcaaagccgtggtatgcttacctctctgcccgcccgagttctgcgcccccggcgaaggacctccggcaggagaatgccccgattatgtggaaactaccgaatgcccatcctggtgtcaggataaccccgattctccgtataatgaatgcacatcctgtccgccaccgcaagttaccggaaccccataaaaaatcccccctcaatgctggggggatttttcttttaaaacacaattttaaatttctgaaaaaaccagtcgtcagcgtattttctggctttaaatagttcctgccttcttgtccagggataggaaaatattacttccccgagagcttcgggaaaatccgaccagcggctataaagctttaaaatttttttcacccgttcttcgcttagatggttcagggctaaaataaaaagattttttaaagcagcttttctgctggtagggtaaggttgacgctcacgaaataaatgataaacaacaacctcaggcactaccaagaggcggtaccccataagccagagtcgcagggacagctcggcatcttcccatccccacctctccatcaatccttcaaaacccccgacctcaaaaaacaccttgctttttatcaccataagtcccccgggtactacaggaatttcagcaactttcccgggattggcaagccaggtcaggcgaaactccggcgaaatagtctgcccgtaaccaattcgctcgggctcggccagggaagcaatcgccgggcatatacctccgacatctttttccgccaaaaatgcttctaaatggtccagccagaaagtttgatagctcatatgcgcatcggaaaagactaagtatttgcccgaagcatatttagcccccaagtttttggcccgggcaagaccaataccttcggtttttattagttttatctggttatatcttgaatctttttcaagaaaagcggtggagtgatcggttgaaccatcatctactacaattatttcaaagggttttcccacccggttatgggttaaagaaaaaattgtattcttaagatttataccttcatttttcgaggttattatgatcgaaaacataaaaataccccctttttttaatttatgaatctttgggggtaaaagaacctcctaaattttaaaaatcaatcccaaatcttttaaaataccagtcatcgtccttaactcttacttttaaataatgttcccgttgctgccagagcttttgctcggatgctaaatcttcgattatttttgctccaaaggggaaacggctaactttgttcagtacctttacaattctttggggtttaaaatgcaaacaagcaagtcgtcctaaattaaacaagacgttttcattataacctttataaatttgcccgcttctgaataaatgaaaaacttttgtcctgggggtaaccagtaaattaaaccccataagccaggcccgcagcgaaaattcacaatcatcgtacccccagatttttaaaccttcatcatatcctccaagagcaataaaatcattttttttaattaacataaatccccccggtaatactggaacatcttctaccgagtttgtcgtataacttcgccagcagggtaaaagttcgttattaaaggtaagccccatcccaacccgttggggttctaataaggaaactactaaaggggataaaatagttttttcttgaaggtcttccagcatcttttccaaccagaaatcttcaaccaaaatatgagcatcggaaaaaattagaacctctcctcttgccttgtttgcccctgcatttttggccctggttacacccgaacgcggtaattttattaagtcaatatttttgaagtttccggagtttaaaaaaactgtactctggtctgtagaaccatcatcgataactataatttcaaaaggtataccggtctttgccgcaagaaaactttcaacagtttttcgtaaccattgcccttcattataggaaataataataattgaggtcagcaccaatagttagccctcccatcactcttttaaagttatccccagtttttttaaaagcattttaacctccaaacttttgggaccattaatggttatttcatttccatactttttcataaaatttaaaaattcatgccagagcttatgctcctccatggttaaaatcgaaagtgaaccatcgttaaaacccaaaactttaccttctgccaatcctctttcgtaaccagcttcaaaaccttcggcaaaaccttcggtatacccgagttttttcccttcaaaaaatcctttttcaaatttatcgctattcatgtaaatttacctcctaaatcatcggaaaaccaagccttaattttccgcgagtatctactccaccaatgcctttggcaccggtaatagtatttgtaactacctctcttacggttaaaggatcataaattgatgaataagctattttttccgcaacaaaaaccggatcataagcgtgaattaaaactctttccggggaacttgcaaaatttgcacctgcttctaagagggcttcaaaatacgattgacaggcaccggcaaaaataacaaggttatctttatctcgatctattttttgtcttaaaattttaactgcttcaataaagtaacgagaattccgataactatttaaatcatggaagtcggccttattttttacaagggcatcgtgaccggttaaaactataatgtccggtaaatgtttgaaataaagttcttcaacaagacggggctggtctttttccgccactacataaccatacgccgggatatttaattctttataagtgtttaagcacatttccagatattccgggtcaccatctaaatggaggacagctcctggccttttaaagtactgttcgccctggtttccccgcatgtaatatctaagatttctttctttatgaatgcattcttttttttcgcgcaccagcgctacaacccgattaagatatctttgataatcggcggtgttaattttcactaaatcagataaaggagcatccgcccataaacggacatctattccttttaaatgggctatatctacgttatgttttttataaatctctattacacgaaagtaaacatccattccataagacttccttgcaactatatcgcctactgaaatcattaatttaacctcctttactcttttttattaaaatattcaatcttaaaaatattggtgaaattaattacccttacacttttttatgagttaattaaaaagaaattttaaaaacttcgtccttgaaaataaatcttaaacttagaacctcgataagccacccgggcatatcgggtaatcacgttgggaattaagattaatatttgccctggtaataccagttttacttcgctatcccttacccaggaaataccatcagcgccaacttccaaaacaacctctccgggagtgtttccgatattttcaatgataaagctataatttaaagttaaaacatctattgcaggaagaaaattccaatttattccggactcaacaataaatttttggtcgattttattatttaaattttgaaaatagtgtatcgtaagctttggccagtaatcggaatagccttcctcccggcttttaaatccaattaaattattctggacctcattggccatccgtaaaagcactccaaaattggcactatccccaattaaccaatttctaaccaggtttgtaatgttaaaatcgataaaggtgttcacttcgccggtaataatagcctcgccttcctcaggtagagcaacgaaaggttggttgtaccagttaagaaatttttcatcccaggaagaaatcacccgaaagagttttaaagatttgctatttacaggagacgaattaaaaaaaagatataaagacaaagttgccgacctgatatcataaccttcaagaccggtcaggtcaaagagaatatatgaacggtagactttattataagcctttcccacaagtagctctttttgccaaaaggtagaaccgtataaataaggataaactacgtacgtatcacttcccggtggttttatagttttgatcatttttcattccccctctactttaatttattcaaatcgccttttattggtttagtaaccaaccgttgttttttttcataagataaatcagaatccccggaatcttagtaaaaggaggtctttttacatgcccaactttaaaattctgcaggatcaaccggaaaagctaaaaaaccaggcttacggctttgacggtaccaccgtgcggccccttaaaactgataatacgggacggccggatatcagaccaataaccaattccaccgatagtatcttggtttacggcaacgatggtaccgccaaccaggtcttaaaaaccaatagttccggtcacgtagccgtgtacaccgacggtgccaccgctttaaacattaccgcgactgaccttgatatcagaaatctttccaacatccaagacaacatccttatttacggttacgacggcacccagaatcgggccattaaaaccgatgttaacggaaaccttttgtccgctacgatccgctcttttaccgagtacagcgaaaccgcaaccaccaccgatacctacaccggctccaccgcccaggacgtatcaaccatggccacctacaccatgtttgtgaaaaataccggcgccaccaattccgctaccgtaaagctccagattagccccaacaacaccgactggttagacgactcggctgaagtaacccttactcctggaagtagcaccgctttgtccgcttctacttttcttagatacatccgtgttgcatataagtccacccttctcggtcaatccaccgatttgagcatcatctttcagggccaatcctaaaaaaagccctcttgcaaacgctgcaagagggcttttttacgaaagtaacttattattttgtatacttatccgccactgacgttgctccatacgcttcgggctttattttcggagtaaagccggaacccaagaccatccccactacctctttaataagctcccgggtttcgccactatttcccacatcgatatggatttccacgggcagctccgcccggccgtgttcggaaaagtaatgggccacctgacttcccacttccaggcttaaggccgtttcaaaaaaaattttctgcctgaggcttaccacatgccgctcgctttttttcttgtagtagtagcgagcccctttaccgatccggtgaacgacaatggccgttacaaacaccgtttcgttgttttttgcctgggaatcggagccaatgattattttatacgatgaagtaggaaggccggcaatatattcttcaatatcttccatcacccgggaaaaactcataattcctttagtcgggcttataaaataatcttctttttttcgcgccatgtatatcccttcttaattgtggtcggtggtaggtggtaggtcgtaagtaaagagaaaatgctttttactgctcatttaacactgacaagtgaacactgcttttatagtgtcgacaggagtcgaccctactacaatggtcgtcggtggtatgtggtcggtataaataattttttcctaccacctaccacttaccacctaccacctcttggcttagacgatagaaactttcagggggtatttgttcagcccgtaagtcgggtttaatccctacttttaaaagtacttcttccacataattccgctttaaatttaaagccccggataaagatttggcaatggttttccgccgggtagcaaacgccgctcgcactatctggaaaaattttagccgttcttcggaggtaagagaattttcttttaaagtaaatcttaccaccgccgactccacttccggcggagggaaaaagaccgtccgcggtacttttaatacgattctcggctccgaaaagtactggcaggctaccgataaacttccgtagattttactccccggttttgccgttatcctttccgcaacttccttttgcatcattaaggtcatggaacttaccttgtagccttcctcaaacaccttaaaaattaagggactggtagcgtaataaggtaaattggccacaattaagtaaggtttcccctcaaagccaaattcaccgccggtttgttccgccatcacccggtcaaaattaatctcccgggcatcggcatttaccaccactacattccccaggtctccggtagtttccgccagtaccggcagaagctttttgtctatttcaatcgccactacgtacttagctgcttgggctaacagccgcgtgagcaccccggcaccgggaccgatttccaataccgcatcgtctttagtaatttctgctttctccactattttagctaaaatcccaaaatccgtcaaaaaatgctgtcctaacccgtgggacagggtaaggttatgtcttgctaaaatttcttttaaagtagttggcgaccagagattcatggcatactcctttatacgtttttaatttccaatctctaatttccaacttcaaacctctaaaatgggctatgataatatattataaacaaaaaaaggcagtttcctgcctttattctaacacatatacgcgggtataccttcgaccccagctaatcgcttctccgtaagtatcaaagaagaggtcaatccttgctccgcgaatagcactaccggtatccaaagcagtaccgtaaccgtaaccatcgatataaagcctggtcccgtagggtataacgtccgggtctaccgccaccactccccggtggggataaacaccggtagcagtccggtaaccggtatgggtataagcagtggccactacatcaattacccgggaaaatcttataatccttccgccccgggaaacggtatttttggttccaaccaatattacttcatccaccggcttttttaccacttcctgcttaataacttctcttttcactactttaccatcatagtaagtaattttatagtaggtgcgggcaagacccgtcttccctttggttaaaacttttgtccggcctttaaaaagactgtttgaaggccttttaattgtccggtaggcaagaactacctcctctgttttttcttccaccttaacccgaattatttttacttcggtatttaacccaactaattccgcaggagaaggctccacgatgtcctgaggatttacggtaattccggcttctttaatggcatcggcaatggttttggcaaccgtcaagatttcaatttcccggccatctacttttatttttaccggcttcgcccggttaataacaatctttgttccttcttttaactttgcggttaagggcatattaatggtatccttcagccctaaggtccgcttggtttcggttaaaagttcctctacagttgctgcctttgtttttaaaaccaccgtttttccgtcatcaacaatggtaacttccttaacaagataaaaataataactaacacttaaagccaagattaaaattagccccaacgccaaccacagaactccggtttttttgcggtaccggggtaaagctagggctttaacatcgggtatataccaatctttcatcgattcaccaccttatgttagaagaggttggaaatttagcaccacttttaaattattcttctaactgccaattaattcctgcttttgcaggcaaaaaaccttactacattatatgccattcttttcggttttacaaccaactatctactcccgtacaggaaagtataaagaagtattacaatgttaaaaagagtttcttcaggatttttaaaaatacaatttacatagacgccatttttctccaaaaacgccgaaaaaaaatactaaacccctaaaccgccaacaggggtttaggggttagttttaaaactctattcctttttgggcaggaatacctttttggtaggggtgtttcacttcccgaatttccgatactaaatcggcagcttcaattatccgctccgaagcattccttcccgtcaaaacaaggtgcagtttttccggtttaatttttattaaatccaatacctgttcttcatctacaaggccgtagccaacggagtaaataatttcatcaaggataatcatatcccagtttcccgatagaatctctttttttgcttcctccaaagcttcctgggcagctctacgatgctcgtcaaatttttcttcggataaaaagccttcgcccatctggcgcatcacaaagcgttcccctaaagcttcggcagcttttaattctccgtatttccagccacctttaataaactgtaaaactaaaatccgcattccctgaccccaggcccttagagccatccctaaagccgaggtagtcttccccttaccgtttccggtaaagaccagaacaagccccttttccttccccatgtaccatccatccccccccaattagaagttagaagtcagaagttggaagttagaataaaaacattataaattaaataactttgtagtgttttcggttaaagcctggaaggcttcttctttggctatgcctttaatccgggcaatttcttcggccaccaatgttaccagccccggctcgtttctccttccccgaaagggttccggagtaaggtaagggcaatcggtttccaccagtagatactctaaaggtacttttttagccacttctttacctttgacgttgtttttaaaggtaagcggccccgctaaggaaatgtaaaagttaagctctttaatataccttaaagcaagctctgccgaaccggaaaagcaatgtatcacccccggaagcccaagagcgtgttcctttaaggtatcaaacacctcctggtgggcatcccggtcgtgaattattactggctttcctttttcccgggcaagttttagctggcggataaaagcttcccgctggacctcgcggggagataagtcccggtaaaagtcaaggcctatttcccctaaagccactacccgggggtggtctaaaagctgttctaaacggctaaaaacctgatcatttagggctttagcatcatggggatgaattccaacggcagcataaatttccggatatttttccgaaagcctaaccgcttcttccgaagtaggaagatcatagcctacggtaataattttttccaccccgttttgccgggcacgctttataacctcttccacatcgtctttaaatttctggtcgtttaagtgagcatggctgtcaatgagcataagccttccttctcctgtttttaatttattttaccttgctccccggggggatttggtcatcaacaaatagtacctggagattgccattaccggatgctgccaaaaccatcccctgggattcaataccccgaagctttgccggttttaggttggcaacaatcaccaactgtttgccaatcagcgcttccggttcataatactgggcaatccctgccacaatcgttctctcttcgtctccgagagtaactttaagctttaaaagcttatcggtcttgggtacccgttcggcctcaagaaccctggctacccttaaatcaatttgggaaaattcgtctatggtaatgagagatttttcttccccttgttcggtcacggtcttttcctcctttttgtcggtagcagccgttcctgcattaattgtggtcagtggttggtcgtcggtagtctttaataaaatttcaggatcgaggcgggggaataaaggttcgccttttttgatttttactcctgccggaagtcgtccccagttggaaagcgactcccaggtaaagagggattcgtcgttaactccaagctgggcggaaactttagcagggaagttgggcattaccggttttaaaagaacggtaataaaccggtaaccttccaacactacgtaaagaaccgttttaagccgctcaattttgccttctttgtttaaactccagggggctacttcgtcaatatacttattaagccgggttaccagtcgccagatattagcaagagctccggcaaggtcaaatttatccattaatttttcagtttccgccggtaaagctaaagccagttctattacttcccgatcaatttcctcatattcagaaggaaggggtatctctcctccaaggaacttttctaacatggacagcgtacgatttaaaagattacccaggtcattggccaaatcaacatttatccggttgattaacgcttcttcggaatacaccgcatcaagccccagaggcatttcccgcactaaaaagtaacggaccgcatccactccgtatttttcaactaattttaccgggtcaactacattacccttggatttagacatcttgcccccttccagaacaaaccagccgtgccctactacttttttgggaagctcaatccctaaagcaagaagaattattggccaaataacggtgtggaaacgcacgatgtctttcccaactaaatgaacgtccgccggccagtatttttggaaaagatggtcatcatcggtgccgtaacctaaagcagaaatgtagttggtaagggcatccacccaaacatataccacatgctttttatcaaacggcacaggtattccccagttaaaagtggtccgggagacgcataagtcttctaacccctgctttataaaatttatcatttcgttacgccgggactcgggaactataaactccggattttcttcaatgtgctttaaaagccggtcggcatacttggacatcttaaaaaagtagctttcttcccgggtccactctaccgggcgcccgcagtccggacacttgccgtcaatcagtttgccctcggtccaaaaagcttcgcagggcgtgcagtaccatccttcataggccgacttatagatatctccctggtcgtaaagcttttgaaaaatcgcctgtaccacttttttgtgccgctcttcggtggtacggataaagtcgtcatagcttatatctaaaagcttccataaatgtttaaaactatcgacgatggggtcaacgtattctttgggagaaagtccctggcttttagcttttctttcaattttctggccgtgttcgtcggatccggttaagaaccagacatcataaccggtcatccgtttaaagcgagccatcgtatccgctgccacggtagtatacgcatggccgatatgtaaattatcgctgggataataaatcggtgtggttatataaaagcttttgcccatttaaaacacgcctcctgccttaccggtactttttggtgatatcgtaccaaacttaaaattaaccgtcaactgctaagaattttttaaaaaaaattggacaaaccttattgactattagagttaactttggtaatatttagttgaaaaaattttgtcgaaaattgcaataataaaggaggagaattcataatgaaatctaccggaatagtcagaaaagtagacgagctgggccgggtagtaatccccattgagctgagaagaactttgggcatcgaagaaaaggatgctctggaaatttacgtagacaacgaaaaaattattctcaaaaagtatgaaccggcttgcattttctgcggtaacgctgcaaacgtccatcactacaaaggaaagctcatttgcaccgattgtttaaaggctttatccgaagaagcaaaagctatttaaaaagcggaagttaacgcttccgcttttactttttctttctggtaccagtttaaaaacttagaaaaaatctctttttcctcctgaccgtaaacttttagaaaagcttttgcttccccgcttcgttttgtctcctcaagaaaacgtagtagaccttcccggcctttttttgcttccaaaaacttaacaaaataataactctggcgataagctgcatactggttctcttcactatcaagatttttttccagttccttaatactataaaagacttcctcctcattcccccaaaatgccggtgcttcaccaaaggctacttccgcccactgggcaactccctcgtgtaaatagcgtgaaagtttgcccccggttttaatgtcgattaaaaggtgggatatctcatgggctaaagcctggctttcccaatcgtttgcaagataaataaccccttcccaatagtacccctgggagggcagggcaaacaagccataagaattaagattagaagttaatacaattaccgcccggtttttagcttgataggaaaaatattttttctctttagaaaaaaggttatttactctgggtaaaaaaccccggggaagagggtttttacttagtaccgttacctctctgtagttataaactttatacccgagtaacttaaagctaaaaactgtaaagctctgttttaacgaatgttttgttgcaaaaggcatctggcttaaaaagagtaacacaagtaacaataacccaattattctttttcggtcaaaaaataaagcccgcatggggatctcctcctctatggggcctttttacctgattataaaatattttaaattttaattatagtttaaagttctggtaatttattttttgttaagatttttttcaaactcttctatgatttttttcgcattttgagcatctgcggaagtaggatccgataacgctatagccttttccagttcagcaattccctctttgtatttttgtttaccgtaacccaggaaaataccataattaaaatgagctttaacgtgatttgggtcaatttttaaggcatcttccacctgttttatcgcatcatccacctggcccaggtaaaaaagcgcaatagcccggtccaccattaccggaacgttcgtgctattgagctctaaaattttcccaaaataatacgcagcttttaagtaaccttcgggagtacttttatcaaagagggtgacggccagttgatacattttattaacatcagtagggtttgccaggacttccgcctctaaagcaatcgccgggtctattacctggttattttggttttgattaatatttgagctattaccaatagtccaggcaacggaagaggctatcagacccaaaccaagaaccaccgcaacggtccataaaattattttttgctgccgctttttagctcttaattgcaaaatactcatattatctccccttgctttggctttttacttatataattcttttttcttttcgttaatcctgcaagaaaagttaaaatcttaacaaagatataaattaagccggcaggagccggccataattgtggtcagtggttagtggtaagtcgtcggtaattaagaaataaaaaactataacagccggctattgccggcccatcgttcttaaggtaaatattttaacggatttactggattaccatttattagtatttcaaaatgcaggtgagaaccagtagaacggccggtgctaccaattaacccaattatgtctcccgcttctactctttggccttcgcgaaccaaaattttcgataggtggccgtacttggttttgtaaggcccggcatggtccaagacaataagcttaccataaccatcttcccagccggcaaaagttacaacaccatcccgcgcagcccttaccggatccccggtagagccatcaatatcaacgccttcatgtatcctaccccagcgctcgccaaagggggagttaattcccccccgggcaggccagataaatctatccccttcatcccgggaagctattaaccgcaatttacgggaagcttttttggggttttgaacatcggctttggattttcgaacggaagtcttggttttcaaggtattttctttagctttagttaccaaagtaagctttgggtctatactggccaacaacgcagtggaaaaactatttactttggctatctctctattttcttcaaaactttgtcccaggataaataagctaattgttatgataagtgctggcaaaagtaagccttttcttaaaaacttcatttataacctccacttgccaagaatcttttaatattttaccaaaaattttcgactatgtccaagcaaaaaatgtaaaaggcagggaaaaccctgccctaaacacttgataaaacaaattgtttatgaagagcggtataaattgctactacctccagcggttgaaaatctttcaaacaacttacggtttttggaagttcgatcaccacaaagccttttaataaagtgactggcggaagagtttttccagcaaggagattatttacaatatcgctacaatcgatttccagtgcagcgttgggaagtaatgtttctgttattttatccccaattattggataattgtgtgctccttccggtagtgcgattaccgcctttttagtaaaggttagtgggtgatcggttaggtttattacattgatcgccgtggcataatttgcaggctttaaaggtggctcttcacccggtggcaatgttgcctctggaggttctgaagggtttggaataaagccgcaaataaattttaccgggtaaaccaaaattctccggccacctaatagctgttctcggggcttaatatattccacgtccagggaaagtcctgcaccaactgaaattgggagaggatttgtaataaccaactttactacctcctttttaagagaatttagtctcacctactattaagttatgaaaccaactccaaaaaggttaaagccccatttctggggctttaaataagaccttctttttttaaggtaagatataaagctatttctaccctttttcgcatcatttcacaggaagttttatagggctttaaaagacttccggtcatgtttaagttgttggcatgacagccaccgctgcagtaataccgggcccagcaggtagcacattcagttttattatagatatgggcatttttaaaggtttctggaatatccttacgaactataccttcttctacatttcccatgcgatactcgtctttacccacgaattgatggcagggataaatatccccttccggcgatacggctatatactcaaaaccagcaccgcagccggaaagccttttgtgaagacacggcccttcatagggatttaaattaaagtggaaaaactctacgttttttccttcctgccagagcttataaagatattctccaagttcatcgtattgcgcttttaaaacaggtaaaagttcttctcttaaggcaaggggggaagaatccggtaataccaccggttctaatgaaatggacttaaatccttcctgggctaaagccttaaaatcttctgcaaaatcagggttttgggcggtaaaggtaccccgaatataataaggacggtccccccacttttccaagaaatttttaatgttggtcagaaccgtttggtacgaagcttttcccccgggcaaaggacgcatccggtcatgaacttcttcccggccatctaagcttaaaacaatccccatgtcgtgctccgctaaaaactcccggacttcatcggtaaggaggagagcattggtggtaagggtaaagctaatatttttaccaaaagctttagctttagctttgccgtataaaacggtagctttgaccacttcccagtttaaaagcggctcgcccccaaaaaagtccacctcaaggtttttccggtacccactgttttcaattaaaaaatcaatggctttttgagcaatcgtcaggggcataagcccccgttcatgcccgtaactcccggtaccagcaaaacagtagcgacagcgcatgttgcagtcatgggcaatgtttaaacacatcgcttttatttctgtttttggaggcttataattttctttaaacttatcctcggaaaaaagctggccttcggcaatcaaggtttttatttcctccaatgcttccatcacttcggcaggggaataacgtccttctaattttggtaaaaccttttctaaggtaagatcttctaatggagctttcccctggtagccgtcatattcttttaatatttcgtaagtaatttcatctaaaacatggattcccccggaaaattcgtctacagcaatatttactcctttatagcggtaaatgtgcatcatagacccttccttctttatttaaataaaaaaattaacctaacccaaaggattaggttaatcttaggttagttcttgcatacctgatttcccaccgtgcaggaagttttgcaagccgactggcaggatgcctggcagttgccgcaacctttaccttcaaaatgaccaaggctcccttttaaagatttaatatgcttcatttaaaaaccccctttgccaaactttccttgattattatagcttaaatacttttgtagcgtcaaatttttatttttctacaatatttctattttaaaccagtactattttatgataagattttattgaagataattttaaagtcaatactcagatacatttgctgaaagaataatagaactcagacaaatcaaaggactaaccacaaaaaaacttgcttctggctattggaagaagaaaataactacaggtaggtgatgattacatggatattaccaaaaccgaagcccgcttagaccaaattacggacatgctaactgaattaatccgcatagtcggcaataccaacgctgcagtagaagggcttagaaaagatgtagaagggcttagaaaagatgtagaagggcttagaaaagatgtagatgaacttaaaagcgatatgaaggaagttaaacaaacgcttaaagaacacacagaaaagttagattatgtcctgtttaaacttgcccatcacgatgccgatatattcaatctcaagcgtattaaaccataaagcgatatttactcgtaggttacccttgaggttaaaaaaactgctaccaccaaaatagataaggcattaaaaaatgacaccaaaatggcaccaaaaaagggttccggaaccaactaaaagctccggaaccctttccttcttctggagcgggaaacgggattcgaacccgcgaccctcggcttgggaagccgatgctctacccctgagctactcccgcttattttcaaggctcccagccccccactttgccagtggtatcggattggccacacctcactatgtaatttgattctccacaacgttgtaaattccttcatatatgcgtaaaaaattttttgctactccatcaaatgatctatagcaataatacccttcaattctcatccatttgtccaacatgcattttaaacccttttttgtaaaactttttaaaatttttatgtctccaacgtataacaaatcaaatttttgcattacctaatatgtcaaaatatagctaaagccgagtgtataacttaaatcttttacaggcaaaagtgtttccttttggtcagcctcaaaatatgatgggtaagaaagtaagatggtatttaaacaaactttggatcgttttcgttgttgaaaataaaaaaggggactgtcctaattcaaacaatcccctaaacacgtatttaaaaaacctggtcacgtttttacttcgtctttaaaaattgcattattaagcaaaaatcctattttcaacccatctttaaacccctgttcgtataaaaaacgaaaaaccaaagcctccctttgcccgactaagtcttcatatttttcaagccacgacttgttattatcaaggaaacttgaaaatattttttcacatgctattttcacggaacatgttagttgcttatattccgaagaagttgcagcaatatggtttacaatttcgtctactctgtcatttttatagttttccaaagcactgtaaatgtccctcaaaagatattccctccttcatcctcttgtaaaaatcaattattgtatgtaaccttaattaaatccttttcccttaatccctacaaaaaatatgtacgccgctaccataaaattgtagcggctaataaatacacctgctttgtcaagaaaaagaaggaggcagaaaaagaagggagagaatgggaatatctataaaacagcacttttagtgctgtgggaaccccagcaggaatctcaagagttcttggtcaaaatgatgaaggagttttttaacccaatttcttcttgaaaaacttttacttgtaacatcgccatcataaacaatgatcctttaaaaagtcaagaaatttttctttatatcttttcaaaccaaatttttttaaatacaggtatatgaatttcggcaatgcaaaaaatagagttatgaaaaaatccagtaactttccacatttgcaatttaaaaaatggtgggatttatctaaacaaacttaattacacttttcacaaaaatgactttttgtcaaaagcgaccgagcccctttccttctttgagaaataatatttatcaaaagttatatttttcgttataatttcttttaacaaaattcgatgcatcatctattataaaacaaaaataattgcgagcttagaagaatttatctaaaaaaaatagagaggataaagtttctcagcctatattaacttttttatttcttcaatagagagctttgttatcttagaaatcttatcaatgcttataataccttctttcagcatttcctttgctattgcaattttttcttgctttgctcctttttcgattattattttgtatgtttcggattcttcaagaaacattttcatcacctcaatgtaattttaacaaaaaaagaaactactaaacagcctcacgataaacaaggcttctcgcttccgtctctgtgatgtaaaaatcttccataatctcatgcacaagtttttctttgtctattttgcttttgtctgcttgtatgctttcttttttcttttctgcttccatttctttctctttttttatttttcccgtaacacgagacaaaaaatatgcgtttacttcatctcggaaactcttttcttgtgttttttgcgtttctagtgtgtctgaggcaagtccaaactttttgcggtatgtctctatgtccaccgcctcatcaatcgcatgttgtatttttcttcttacaatctggtaaaaagccgaatcccgtggagcaaccatctcgccgaaatccttatacctgtcctttttgttcttctttggatatactaaaattttcactcttgaaaaaccaaactttttcatcttttcataagttgcaatatttgcttttattccatcatccgtattatcgtatgctaaaatcatctctatatccttcccaaaaacttccattaagagttccatctgccgttcagatatagaatttccgagtgtcgctacaaccgcaacgtcatcgagacggtagcagtaaactcgtgcagcatccttcgggccctcgacgatcacgacttttttatattcattcggattttttacatacttgtaaaggagatagagattttcatcgcgtttaaaaccaacagtattaataattctcgatgtcagctttttcttcttattgtttttttgttcctctgtaatttccgagttttcccaatactgttttttccaaaaattatcgcccaaaaccttatgttctcgttcttgttcatcgtcaaaaatgctccgtccctgcaagccaaccactttctcatttatgtctctgatggcgtaaatgacacgataacggaagtcgttcgattcgttgcaatcagccgattcactcccgtctctgtaataaatatcacactcttccatctcttgtgcattaaatcctaacttctccatatacatacattttcccttggcttcacttaagattttctcaacattcttctcgtttacaaaacccctcagtactgtcttacccattattttttgagtttctaaatctctttcttgcgaattctcctctaatatttcccacacagtttcgatattgtcaacaaaaagatcggcacattctttcaaaagcccccaaatatcccccgtaaaaccacagcgaaaacagtttccatgcggcagggcatcttcattcataaaaattgcaaaattttcgtgttcacaaattgggcaaatatcaagctttacaacataatcactaacatctataatttcataccgttgcttttctgtttctactcacataaaataaccgtccaatgctcagatttcgtggccaaatagaaaaggaatttgtttagataatggcgaataattggagaaaaaatctaaagaaggagaaaaaggaaaagtcttcgagtaaggtttacggagctgacactccccttaccgaagactttcctccataccgtactttgattgtaacttatcttggagcttcagtaaaggagtatttagaaaattacttaaattttttggaagaaaaccaatggtattgcccggtttgtagtgcaaagatgtcttttcacggatggtatcgacgaaaaataataaccttagatggaactactactagaattccaatagcccgctatcgctgttctaactgccggaaaacccatgccattttaccggattttgttgcgccttaccgccattattcccaggttttgattgcagctgtagttgaagaagtagtttccaagcaggtaccgccagaacgggtcgagggcaatcaggatattcccactactcggcgatggatacgccgatttctaaagcgatgtcatgaggttataggcgttttagaaagtatagcttttagatacaccgggcaaataaaatcgcttctaacggaagcacggtcgtcgccctgggagcaaatgcttgcggctttagaactactgccggcggtaaaagctacttcggtgtttggtgcggtaaatctctggctgaccatggacgtggtcggcctctggctttaactaatttcacatagtttggtctcctggccattcttgggattgtggtatggtgaatttaacaccatatttaaacaaggagatggtcaggttgccaaaggaattatcttatcagcaagaaattgctcttaaacgttttgctctgatagcacctttgctggagccggatttagaagcggcggaaaagcgccaacgccggaaagaaatcttagccaggagtgaaatttcctcccgtaccctgcgccgctacttacaactttaccgccagcagggtttatccggtcttatgccaaaaatccggtctgataatggaagcagtcgtactataagccatgaaataatcgaagaggcggtaaaacttaaggaagaacttccggaacggagtgtaagccaaatcatagcgattttagaaggagaaaagaaagttcctgcaggaatgttagcccggtctacccttggaaggcatctttctcgtttaggcctaacccaaaaggaagctaaccaaaagatatcagggcacaggcgttttgcaaaagaacagcgtaatcgcctctggcaagcagatatcaaatatgggccgtatctaccgcatccaaagaatcccaaacgcaaagtgcgaacttatttagtggcatttatcgatgatgctactcgtcttctttgtcatggagagttttatcttgaccagaagaggccagttttagaagattgttttcgtaaagccatcttgaaacgaggaatcccggatgcggtatatgtagataatggcaagatttttgtttcccgctggtttcgtttgggatgtgccaggctggggataaggccaattaatactaagccatattcacctgaatctaaggggaaaattgaaaggtttaaccgcaccgttgagtcttttatagccgaaatagaactgcaacaacctgagaccctggcagaacttaaccaggcttttgctgtttgggttgaagaaggttataaccaccacccgcacagctctttagaaaacgaaactccggctaaccgtttccagaaggatacccggcgtttacggtttgccagcctggaagaatgtcgggaagctttcctctgggaagcaagtcgtcgggtagataaaacaggatgtatcaaacttgaaggacggttttatgaaattggtttggaatggatacgaaaaaccgttgatctccgttacgacccttttgacttagaaagtatcgagttctggtataacggccaaaagcagggactggccaagcctttggttatccaggaatacaacaaccttgctgcaaaaaataaaaaagagcaagaaaataaaacaccaaaaacttcccgcctcttaacagtacttgaagaaagaagtattgaacgccgccggcgaaaattaggggccatacccttccgccagctggaagggggtaagtaaaaatgtttgaacacttttttggttttcaccgcacccccttcgggagggatctgccggtaaactctttgtttaccactcctgcccatgaagagctggtatccaggcttaaatatgcagcggaaaaacgcctctttgccctaattaccggcgaagtaggagcaggtaagtccacagcattacggcaactattatcgctattaaaccccaataagtaccgggttatttatattagcgattctggtctaactcccaggcatttttactgggaagccctgcggcagcttgactgtgagccacgctttaaccggggacaggctaaacgtcagctgcatcaggttatccttgacttagcagaaaatcaacagaaaataccggtagttattgtggatgaagctcatctccttgaccgggaaatgcttgaagaaatacgctttcttttgaattttcgcatggattcgtataatccaatgagtctaattctggtaggtcagccagaactgcgccgtatcttacaacttcaggtttatgaagctattgctcagaggattaaccttcgctaccaccttccgcccatggaacgggaggaagcaaaaggctatgtggcccaccatctcaggacagccggggcaagttcagcaatttttaccgatgatgccttggatatggtctatgagtatgctgggggtattgcccggaaaatcaataacctgtgcattgcttgtctaatggcagctgcagccgaacagaaacggcttattgatgaccgtatggtcaaggtagtaattgaaaatgaattttctgtataaaattatgtcaatggccaggcagtataaaaaactgcctggccaaataaagtgagcaatatttgcggccacttaatttgagctaaatgtggtcaattagtgtgagcggtaacacttttcaaaaatctttgcaattctttcagtgttccattttgcgtctaaaatttctttttttatttttgcaagtagaaatttttttgaaaacaacagagcaaaattcacaatatcatccatttctatgtcatttgataaaaagttttttagttgcttatacgtttcgtaatcagctttgtaaaaaatcggattccataaataaccatctttttgatttactgactgtttataattaaagtgtcgtaattgcttccagtctgcgtttcgtaaagcgttttgaatagcttcttcgataatgtcttgaaaagtcttttttgtttcaactatttcattatagcgtgataaaatctcgttgtattctttgtataaattttgtataattttcattgagcacatcactctcctttgattaggtttcttattctcctttttttgagtggtatgtacaagggaataactgggaaacatgaaacgcaacaaaaaaattttctgtaacgggaagaattcccgctttttttgtttaggtatgtcagcccgccgttaagcgggcagtttttattctcgtaaactttcaaaagtttctacaagctccgtaatgtcgtgcaaagactttacgtcaagtataaacggcattttttctacgcaaatattgtaagaaatatcttcatataaaatcaaattttactccgactttttaaaaaaataagtatacaaaatatttctcaccagacgtgagacagacatcaaatgtttctgagcaaggtcttgcagtttctccaactcttcatccgtcacttttgcaactattttgtgcccttttgccgtggtaaaagtgtaatcatttctgatttccgtgctgtagtcaaattgttcaaacagtatccaaagcataacttttgttatcgtcataccagtttcctccgagagttcgcgcaatctctgaaaagtccgctccgaaactaccgtccaaaactgcttttgttttctcatacagaccacctcgcttttaattctctacaaacataatagaaaaatattcatgtttgagtcaagtttttatttaatatttttttgcaaatattgtcaagttgcaaaaaatatgatatgatgtagctaagaatgatgagtaagactctgaaaggagctggtaagaatggtagttttcgaaaaattcgtatcctcgaagagagggacgttctggatatacgtagttaggcacagtttttggaaagcagaagtagtgctgcaggttccgcactggtacggtaagaaaacagtttggcgcaaaatctttttcttcccatttgcagcaccacttattacaatttctgcacggcttgctgaggcattcacggtataaaaacgaaagccccgaaaaaatcggggcttctttgctttttacatagcacttttgagtcctctactacgtttctcttgaatttttcgctttaagactcttagtctatgccttttaaaaacgtgctttattacctcaaccatgcaaccttgtccgtgaagattttaaggttttacaaactcttccgctgtttttgccaattcttcgtttctgccttcatgtatcaaaaccatactcccagcagtgctgttgcagatcgagacgaaatagtccgctccacagtctttaccgtcttgtacctgtctgagaaagatttagtctttggaatcttcctttgacattaagtttttcacaccactttcaacatcatcaaaatggtttgttatattttcggccagcatcagcatctcctcgctctatctttgccatacattaatgcgagaaataaagcaatatcaaatagctaatttaacgctaagcttagctccaaaattgcattagttcaaaaactgcaaagcaaaatattcaaaaacgggggaattccctgggaagttttttctgctatagcttattatacttttgttacgcctttgaaaattatgttttttgaaaatttggcttttgttcaaatcccctgagattcccccgttgtagaaaattttttttacgtcatccttgtgttgtaagctcaagttgaaaagctcaagcaaatggattaaactaatctcctaagtttgtttataaagttttataagcaaacttaggagattggctactctactcctttatggctcaagctaatggcttaggctaaatgctaaagctaaaatcttaagcttttggcttaagctaaaagtaatgttgaagctcgcttttgtttttttcttctcatgatcagtttcttatctcatttttctagtaaaaaaaagaaaggggatctattccccttttaaacgatcaatttctgtttctgccgtttcaggtcaagttcattaaaaaccttgacatgtaggctttataaaatgctttttcatttttgctttctttcattctctttcataagttggcaaataaaacttcagcgtaaagttgacaatatcggaagcatctgctttcctatccgaaaaccactcgagattaaagtgaatatctggtatatttattttaacgacatcatcatcttttataattgataccacttttctttatatctttaaacctgccttttttgaaggtgatgatatttctcttcaatattcatttttttcattaaattttttacatatccaattttcaagtggttcgcaagcgtatcctggtctgtatatcccagcgcctcacgaacctctttttttgtaataatgcttttttgagaaaactgcgtttttagaaactcacccagctgtagaacttttttgttgcgtttgctgccgtgtgttaagtaatgcttatagaattcctcaggataccatgtttcaatcttggcattggggaaatatgttgttagaagttcaagcagtacaggttctccaataaagctgtaaatctgaacctgttcatttgttgacttcctcagcgcggtcctgcaaaagttctggatcatctctgtgaaaaggtcactttcgatgacccgtttcactttttcagcaagtactactgctttatcatccgcactgcttaaatcgtcgaaatcctgtttgttgctaactgatacggccttggcaagatagtattcatcacctttatggttaatgccaatatttagcatgaccgtacagttagcataaatatttttgcctttaatattgttaaagtggtcaatgtaaacacggttgtttttgtaaaacatggtatccatcagttcttttttgatggtattaacgagtttttgataggttaaaataaacacttctttatccttaattccctccaaatcctgaaacagcttcttgaaatcaaacctcgcactgctttttttgctgaaaatgtttgtacggctcaaatttacagggcagttgtaaatggtaagattatcgtagtttcgaatctgaggcaaatccaatattgcaaactgcccttctttgtactcggcgtcatattttgccgtggcatcaaagataatcgtctttaatccgtccaatttggcaaattcaatgtaatccgtagtaatagcttgggcttccaagccgatttttgtttcttcggcgcgcagaataccgccttttctgataagacttgcaatgcactcgagtatttcgacatcgttttctgtatatgcttcttcaaaaaaactcttgaacttatcagacagcttaaaacatggttctaaggctgacaaaaacgggcttgtaaaatcaaggtcatttaatacagtattgagctttttcaagtggctcataaggtgctgagcttcttcatacagttctgatcctggctgtatatagcgtataacttcgtatgccttccttatgtcctttctatttacaggcttattaattgccagcggtggtttttcgtcaatgataaggatgtttcgcttgtgctcaatcccatccttatcgcagaatgccaaaaaatctctgaggtgccgtccatagagcatttccaatcggaatctctcactgctcatcaaaagcacaggataatttttctgctcgctaacggcttttttcatcctgcaatcggcgtcgcagtttctgcatgctatccgctgatattctttgtaaccctgcaggcagtggtcgggataaaagctgtacacagccctggcttttcctttcagcttttcttcgagggctaaaatatccttaatcctttctttaacgactatagcgccaaaattattaaaatcatcgtcaagttttaatcttagaaactcttctatcattgttgacttgccgagtcccgtttccattggaacaactactggtttgctggaatcaattaaggggaaaaggagaatctttgcgactgtccttaactggccgtagtgttcaaggctaacagttcctccatatgcttttatcttaaccatcacagccatggctaatttactggcttcaaaagaatctttaggataacaaatttcattgtatttataaagccgatgttgaaagggctgaatttttcccatatgctgtatgaatcccctcccttctgtggaattcttttatcattttagaacattgagaggcttaaactcaaattttactccccccattgttgttaatttttttagaaacagattctgtagataataacgaatgaaaaataaaaaagcaactatctttttgatagttgcgtaaatatcattctttgttaggctttccttttattctgaaaaacacaatatggtttccgagggctaccttctctaccttccacttgcccaccatgttttgtgtctataagccgatggagaaaatggtcgatttataatcctctcaatttctttaaaagccaattttattgaatcttcagtgatcctttttccagaaaaactaacaactcttcataaccacttctgcgaacaagtacacttttattgttgtattcgtttttagcagtattaacctccctaattaatcttaacaataatttaattatttccatcccgacatagattactttctcttctccatggtatctaacgcctcacacagctttcctaatcagctttgccaacatcgatgtgatatttcaacttaaaggggtgttatttaacttaatcttccgttttgcctcatcaataaactctaacgtcatattaatccatgtatttccaaaataccgagaaaattatcctaacaagccttggatattggcaaatctctcgtaaagcagataatgcaataaagcattatatattcactcatcctcttcgtattggacaaggttttgaacctgctctttcaattcctcaaaactcaagccttcacgaaactcatgcgtatcaacaaattcgcactccatgaacattgcccagtatgcttcatttattcttcttggatattttgcgagcgaggactcaaagaaagacttatgggtttcataatggtgagtatgtataaagtcatcccatgcttctcttaattcttcatcttcttttatatctataatttgaatttgttctaaatttctttcacctgggcttccccaagcttgcttgagcaattcaatagcacttacatctgatttcggtgcactatacccaaaaactgtaaaagaataagcatattttaaataatgctgaatagcatcccactgacttttgataaatggatccaaatgataattcttttttttaatcggataaagtagccttgacctttttaattgcttcccacatttactacatttatcttttataaaccccactctcttacattgttcacacacaccaactgccacattcccatgcaagaataataattttggcagttttgaggtaattttgtatacccttctatatgcttgtaaaagcaatggatcccagttaaacgtcgctataacatctttcttacgaagagacaaaagcaaataatcatatatagttggataatcgggtaattcaagactactaaaaataatcccatatagcatcttccagtctcttacatacatcctcatattcaggtttaccatgtaattcactatatatatcttccaagttgtcacttttaaaagttaaattcacaccatctaatatattttcaagacctgttgttttcaggaacccattcataacgggtaattttcttccattcttatcaccattaggtaaagcagccctacttgcaccagctcccaatattaccacatgcggccgtttcatatctgcatttctaacaagatcacccatagcaacacctcgacactcatactccctattccactcccaaagccttgaataccgcatcttcgggcgactggtaaaaagatatctgaaacttggcaaacagttctggcggaacagtagcgatgtcagtagccgaagacattggcattaagactttttttgctcctgcgtcgaaacatacctgcagcacattggccagttcttcgactttatttatggtaccaccaatactcattgagcctaaaataaccatctgactctggcagggcctgtccaatgcacctgaacacaaagcaacaaatgcagcaagcgaaagttcggatgtaagccctaccccattaatatcttccacatgcataaggtaatcctttgtagtagtacttatacttccgcttattttcttgctgtttgccctgaaaaatctgaaagccgtttcaatcgcctctttagcctctctgtctgaaccaagacctgtcttttcaaattttccgcttccacttacaacctgtgtttcaatcttatataccccaatcatacctgttctgccacgtgcaacagtatagacatgacctggcttccccagcccctcgggaataatcttgtcacccccttgttcaggaacagaaacaaactgctcattcatagtttcattgtcaatatatgagaagtggacatcgtaaaactccatcccgccaattttcttaagctgttcttttactcttcttctgccaataagtgcataccttaatatttcttcaatatcatctttgtcgaattctccattggggtaaataagctttacaagtcccgacacagtttttcttaccgcaataacatccctctgattaaggttgttcccaagcttaaaatacctgtcaaacgcatcggaaaaagaacgcttcctcatctcgcgaagaaattctgccaaataatctgtaatgaatccatactcatctgtgaagaattctggcctgaattttggaatctcccatccaggcaaataataatgtattctatcaaaaaaagcagtatcattagctattgcttcagggaatggttcaaacaaatgagaagtttttagtagtgcatcaacactctggtttatattgcctataaacaccattgaagctgttgcggctttttcctcttttcctcgagcaaatgaccctgaggccatatagtctttcattatttgtatcgcgtctttatctttaaaggaaatacccgccacctcatcaaaagctacgcaatcccaaagtcctacaaggcctatctgtcttgaagccatattgtaaaataaattagctaccgttgtctgcccacccgaaaccaaaatgctgtttggagatatctctttataaatatgagattttcccgttccccttggcccaagttcgcaaaggttgtaattattttctacaaggggaaccattctctctaacatatgccatttaacgttgttggacaattttgtcggctctaaaccgatcgaccttataagaacatcaatccattcatcctttgtaaagtgccttctgccgaccattatttcttcaagttctaagttcggcaactgtataggagtaagagagtttatgcaaaaaggacttgaacccttttgttcttcatcaaaataataatccatcttgatgatgcaccaaataccaccagctaaaagcctctcataattcttcacatacgaggaaggcataacaactcccttaatcccaagattagaaaattcggcttcatatacgtctttcttttcattgagtttcaccgttaccctgtcgataatggtatacctgccatgctctcggatttttgacttaaccttctccgcctcatcgggcctaacaaagttctctgcaagtatgcttttgaccctttcaactccttcacgtatgctgtcctcatcctcggtggcacaatacattcccaggaggtattcaaggacatatacaggcacattagcgccttccttgatctttttcgtcaggtcttttcttaccactctgccagcaaaatgctgattcaattttgcacttaattcatccattctatcaccgcctcattttaaaacccaaaatcttcattggtaattgcaagatcaatggtaaaaggtatcctgtcatagatgttctctaccgtttcttcttcatcttccaggataagataatattttttcgttttatcatacttcatgttcttcagcacaaatttttctctaaattttctttcttcaggattctctgatttactgtcagcaataataatattttcgtttgaaactctgttgccgtcttcatcagcaaaataaaccttcagtctgcacggcaccattttatcgcctaccttttcggtttggaaaaactcaaggtaggtgattgtgtttgttatttttcttgtaaggcttaacagggtaacccgaaccttctgaacatcttttgcggactttccgcgctcattcttaaaatatataactggtatcactatttcctgtagagatgaacccccatgtacataatttgcaccagcaccttttaattcgaatctgtttgtgctccgaggagtaatgcatttaagctgtgtagcctctcctaaaagatacttcatatcaaatgataatgtgccttctatttccataggcttatcagttaagataaaccttctgttttcgtacgcatcttcaatcttatccatggaagttttttcactcttctctacactaccacgcttgtagacaaagccatggtctgaaattatataaatatgggttgcggaaagatgatttacaaggttgttgacaagggacttcagctgttcaaaagcttctgccaccgcatcaaaaacttccctttcggtcagatagtgatcacctctagcgtcaatgctgttgtgataaatatagatcagttcttttccacccagaagctttcgcaaatcatccctgcgcaggtcaatgatatctttatactggactgctatgcttttattcacatgattttgcaatatcatgtttcggttatcggtaccctcaacagaaataccgtcaacaaaaacctcataatcggaatctatctctatttttttatgcggcagcagcgcagccattccaagttttgtataagaggggagcaccccctgcatagccgaaatttccgtggttccccttctttcagtgttcagcatttctgccaattcccttccagcttcaaaccgcagggcatcggagataattacaaatacccgttctcccttattaagatgcggtttgatcttctcacggaaaaattcccattgacatgggacagaactaatactccagtattcctgcagtgtttcgatactgttgctccatttgattgaaaggatattaataaaaccatttatataggtgttttctatcttttctttaagggcggcaaaccattctttgttatccaatctgtcaaagaaatagataaactttctgtaagccatgtcaaccttgtaatattcttccgtatacttcttgaagaaatcatgtggggggtattctttgatggtatccttctggtttttccattcctcaagtaatacgcaggcccagtaaagagcattatattcgttctcatagtcctcgaaccagtgctttgatcttctatccattattatctctttgtacctgtcaaactcgccgacatcagaaagcaggttgtcaagaatattttggattataccctcatcaaataagcggaagatatcgctgtctttatagctgtcaacatcccatttcgtgatatactctttaagcctgatcttctcctccaccatttgggaaagaagcctgaatgcctttttagtgctgtttcctcccataaaatggcttaagaatacaaccacattggtttgctttggtgacacaaagggctcccactgtttgggcagatctctctttagagagaatgccaacccagttatcaggagaaaaattgaaagcttctccaggtctttttgttccagattatagccatagtacttcctgacaagctcccaaaaagcatttatatctccaaattttatgatgttttcatagagagtcgactcaccatacgcatactccgcaagcagggttttcagtacttcttccaaatcgggatagggcagcttgcagaggaccgacagtacggcaatatccaggatttcttcggtataggaagataaggcatattccttgaatgctctatacctttccttgttgttgaaaaatttcaggtactttttgaaagcatcgtgcagggaataatcagtaacattgagatccatcatgatgattgtagctctatcggtagaaaattcaaagctgtatttttggatatccaaaaggtaattctcccgagctttcggtttgctgtaaggagcataaataagatagttgctttctttgtccacccgctcaagaatgtattttacataaaagctattcctgccattaagtttaagtattttagcattggaaagattaagagcatcgatatcctctttgaattctccattatcgtcgtaccagaaaacaatattcctcttcctgccgtccgtaagctctttatttaaaatttcttcaagtttctttttaacctcattaagttccatattaaaccaccatcactgtcaaatttttgccaaaagatttgctttgagggtttttttgccttctccctgcgggatctcaatgccctggaatttggcgtagtttactgccactccatcgtcaagatcaattttgatccgctgatttgctacgtgagcaataacttggtcataagcgaggcattcccgaatctgcttctgtatcttttcctttttcttgcgggcaactgccttttccctttccgatacatctgattcaatcaggatttcgagccttttgacttctgcctcatatttcctctgaagcggatgcaggtagtcagtcctgatcctggccacggtatattcgtcatacctgtgcatgtatataagtgccttgaagccgtcttccttgcctgaatcaaagagccagtaaataggtcgctttttatagacctgcacatggtctttataaaattccttcaggaaatatctcctgatggcctgccttggggtctcagaaggcttcctccccagagtttcggcaatatagttgatattttcttccagcttttcctcgccaaaagtcaccttaaggaattctataaacctgctcacaatatcatcatcgaagtattcatcatcaagaatcggaatgatattatcctcatctggcaaataggtcgcatctacccaggtatcggatatcacattaccgtcctcgtctttttcgatctttctaaccttaccgtcactccacttttccttccactcgccaccagcatagataagcccctcgacatcaattgagtacctgccgaacatgcagccgacagcataggaaataaaggacttgatgtctctaaccctatctgcttttctgatggttacatctttttcatcaacttctggagtaagctcatcctgcaacccgtatatttcaatgaatatacggttcagttcctcctcgttggctttgagcttataaaactgctgttcagcaaatttagcccagttgttgaaggcttcttctatagttttgctgctgcctttatggataagcaaaggatgctttttgaaatcccaggaggtttcgaaggagtcccagtcggtacgggaaatatatatgttttcttcaacgagagaatctatcttagccttttcatcatcatttggtaatataacaggtaacgaagcaacatttcctacttgaaagttcagagtagggtttaaaaccttcattaataaagttgaaatcttggagcataaaaaccctgtcaaaaataaatggtatttttctggcggaaatacagaagaacctccgacatcaaaaataaagcctcggtctgaatacctgaccccaaaatatgatgaacttacaaatgaccaggttattgacttgcgaaaataataatcaatatttcttactgttgcaggtttaaaattttttaattcaaaaccatcgttctcccaatttataacatattcattgttaccataccattttctgtattctccgcctttattgtatggaaaccacttaaacctgctttcagctgctttttccctatttggataattaaatcctatcctatcaattgctacttcatgccacaatcttaaaaatctgctattgtccgccgttgttattccgagtttcggctcagcaatttcgcctaatggtctaccttttttaaagcaatcaataaccttttcactcacccaatacgcaattggcatgccaggaattttttcaaagttatgagggctcactgaatatctataaggaacatttcgattttgggctgcttcaagagtttttattggctgcaactcagttcctctaaagtctgatagccttatgtattctcctttcgcaggaatataagcgtttctaatagtaaaagtacaaatcggaacagttgcctcttcaaagcctgagtattccaattgcacaagagaagtaatagatttactcttgattataatttctcttaatttttcatatgaagaaataaacatccacacaaaaggagtcatatatcctaaatggccatattgctttgcatagttaaaatttcttactataaaaactgaaaataaatcatactttacatctttaaacttctcggaaatataatctttaaggctactgtttacccctttgttccccatatacggcggattggtgcacaccacatcatacttctgactcattattcttgcctgttttactaacgctggcatcttttcaagtatcacattcctatactgatactcatataaatcccctgtttcattcttaaactcttccagtcttttctcaatagcatcaaaatcaacaggctcaacctcaagtatagacccatactcttttgcatcatggaaaaccttaaccaggtattccacatccgctttaagtttttcatcggcacccctcaaaaagaactctaatgcttctttagatatgccattgctttcctgaatagcacagaggtttaggtcaatattttcatcctttatctggttaaatatccttctgcttttgcttcttgccttcatcatcaccgcaaagtaagcaagctgagctgccctgtcgtctatatcaagcccataaaggttattctttaatataagctttggaatatccctttcggaatacccagcactcttgtaaatgtcaaacagcacgtcaaaggcatagaccaaaatatggccgctgcccatacatggatcaagcaccttgatatcctctggcctgatgtttttactcttttctcttatctctgcaagctgtttttgtacttctggctcctgctccgcttcctccaaataatacttccatttgcttttcagttcttcatcagggtgtccctcaagccacagtctgccaagagaattttcaaccatgtatcttacaatccagtctggggtaaaaagctgggttgcagcaggaatattttctttggttatctttatattcttcttcaaatctgcgtacactttctcctttttttcggatatatagtactggtacagccaaccgataatctcaacatccctgaagtcctcttcctttatatcgcttacaagccgtcgtatgaccgaaccctctgcaagcatgttgttgggcagaagcagttccgtataatcttcaatcttttcaaaaagaaagggaagaatctcattgagtttgttgcactgcttaataaaaagatacctgaaaagtccttcatcatcatggttatcaagatactggtgcactatatcaggatcttggccaagatcaacataaagcgcattggtaataatatcaggcaccgctttgccttcttctatagaagaaagcacccttacacctgttggaaggtaatcatttacctccataaacctgattgcaattatgcggttgaaccaggtataggcaacttcctcgataacttcctgaaaccctttttcctttatcctggctataagtattcccctctgcttagcctcatgttttcccagcagcctgccgtttaccttaactgcatctgaggatacattttctgccttagcaattcctttctccgttatgccaatttcaaaggctttttgagtgatatcttctataagctttctccttgcccatacggcaaaatttttaacagcactcttatccatatccaacaccaatcccttatgaataattaaacaatcttaattatggtattttcatctaattcactttcaagctttgctctgatttcgtcaagaagtttttctatatcctcttttgattcgatatttcttatcccgtggaggagatgtgaaagacttatattcacaatttttttctgctttggcggttttattaccccttcaggggtttcggcaacaattgatgctcctccatgagaatacttttgtttttcaacttcattagctatttcttcaaaatagcgctgcttaagcctgtcgctttcttccttcatggcaattacttcataaaagttgtttgcatgatctaatctgtaaagcaggtcatcaaaaccttttctgaatttttcataatacttatctttaaaatcatatgaagacaactcatccaggactttctttttatcgctttcgactacttgtttaatgggcttggcttcttcctcaagcagttcagcaaatctttttgtgaacttatcaataagatctggtaatctgtaaatttcactgtaaggctccttgctgtttataatcctggcaatctgttcatagagttctatagctgccttatccaagacataagttttgtttttttcatataactctaccatacgcatccctttgtcgaagatctctttttgctttccttcgggatcaaagaatttcttgacatcatgggcataatccccgtaatcaagcaattcttccttcttattttgtatttcttcaaaaaactccttagcatccctgattttcagcaacgctgtaaagagctttttaccttcctccaaaacatcttttcctggatatttggcatacttgtagttctgaagcagttggtctatatgattgcactcatcttgcatatactctttgatcttgcgcatcaatccgtcttcatcgttgggtagcgcagttctcccaaaaacctcttttactatttcttttgcggtatttattaatactggcgatattttaattctcttctctataagcagcttttcggcatagtcacgttttgtaaggtatttcacaaggtctctatcatttatgtccagatattccccgtttaactgaagcttgacctcctgtgccttaaataattttgcaatcagaccttcgatgtcttcctcgttccagccgtaaggagctttttggaatacatttataaccgttctcatggttacaggtatgtttcttgctgtatttctttcgatgtaggaagaaacttcctcaagtgccagtttgttggggtcttcagccagtgacatctgcacagcttcctgtgtgagaatgttattgatatcgctgggggaatctataaatgcttttatataccccagtttggtgtaaagggaatcaatgagcacccttaaaccttcatttatcctttcaacgggatctttctcccttatgtccagcttttgggcgtttacgtatagttctgcagctttcaaagcatcgataataagggattttaccctttctttccttttgcttgcttcgtttctttttctgtttttaatttcttccatggtcggggttgaggcaataccaccgtttttcctaagatatgcctcaattttcaatacttcttccatttcctcaaggaaggtggtatctggaggcagtttcacaataagattgttttcccgctgcgacatttctttaaattcaagctgggtcatttcgctgcctgagtcgtaatatggagtgattatttttacgccaatctcactgccctgattccctctgaaaaatctgtcgtcaacaatctggttaaatgggaaatggtagcgggtagaatatttgaactttttgtctggataaatatcttcgaagataatctccgaaactttttgtataatttcagcagtatctatctgaatatttttgatctccctgttaatatcctgttcttcatgggttaagaaaatataccaatccccatccttttgaacaaggttctcttttatcaggcgttttaacgactcttcaattttcttcttaagcgcaatcttatcctcatcgatgtggctaaccatcagggtagccaggttttcaatattaggcggaatctcttttgttaaatatttgatcataaaaaggaccttcaaaagttccacatcaaagtcgtttaagttgctgttttcctgagcgtgaataataaccgttctgatatttgaatcaagaaatgtttcaatagtgtcgtaaaaagccgaaaagggtatcagcgttccttcctcgcagtcagcatagcgtatagcggcctcctggaaggaactgatcatggaacgctcaccttcggaaagatgttttcctgacgccccatgaattcttattgaggtaaacacctgctgcaatagattaaactggtaagggataaaaggataaacttccgcaaagtcattgctgtccgtataaaactttttttctggcgtatcggcagagaaagttatgaggtttttaaggatagaacttttattttcatacagcaattttaaagtatcggtagcaacttgggttttcttcagtaacctctttttgattacttcatccacattggcgctggataggctgattctggtattaaacctaccctggatcttggagaaatcgttgccttttaccctcgtaatcgaatcgatatcttcctggctggtaacaataacccatgctttcccaccgcattcggtacccaaatcttctaccagtgtctgaagatttagcataagaccagaattatctcctatgtactggccaatttcatcaacacaaaatactacgtgatgatttccccctttactctcgatatattccctgactctctttgcaaatttatcaacggtgagagtataattctcttccgctttgttataccaattacgtgccgcctgctcgctcattttggttgcagaagcaagcgcttttactattgcgtcttcttcataatagaagtcctctctggcttcttcccatttcctccccgaaattctttcaaattcctttttgaaatcctcataagtcccgtctttagacatctgtctttcaagatccgcaagccagggtatagaaccgcaaaaaccttgcatgtcattaaaaactcgattaaatactttaacaatagcgtctttttgagtttttgaatcagcatcagcttttgactcgatattaaaaagtataacatccgccgatatgtttccagccatttctatatctgcaagaaccatgggatcatctattttatcgcgaaaatattccacggcctttttccctttaactactctgttttcaagcaagtaagaaaggatttttaaaaagtgggatttaccgctgccaaaaaagcctgatatccatactcccattttgtccgtatatccgataatcccttttttatacgcttcaaaaaattcactgaaatatttttttagctctctggttaccacatactcttccagttcttgatatgcattttcctcatcttcttgaccaatttttatgacacctttgatatccctgtcaatttttttgtaaaacatatccctaattcgcatatctttactcccctcgcttctcttttaatatctctcaataagtctgaaagccctataatagttatcatccttgatttcatcaagcagaacaagttcgacgccgtcgtaagtgcctgggaaaaacataataagcggcacatgttctatcaccgaatgaaggttgttaaggatagtatgtgacctgataatgggccaggcttttcctacaccagtcaaaaatatgatatccttatcctctacccgttcccgaatgtattggacaatcaggtcattttcggtagttaatcttaatgcttttttagtggcattaaatacatattcgctacctttaatagcttccatctcaatattcttggtaaggtaacctttggcctcaagaatgtcaatcattatttcgtaaaggtcaaattctttgattttatacccattgataccgttcttgaatttttccttcaaaaattggatatactcacggacaagcagttcatatttgggttcataatcaaagatatagaaccctatttcgttacccagacctttattttcaacaaatgatttcttctgtattgctggaattaaggcatcaagcctttcatagattgttttcactttttccacctcacctttgttcaaaaaagcattaattaagcccgaggaatatattcaaaattgctttttcgcccttctctttcaaatgttcgataattgaaggatcaagaacaggcttaataatttttctatttcttttattactgataagccctgcttcatagagtatcctgataaaaacttgttttagtttgtaaaaggtgtaatcatcccaagaagctactttcttgctctgttccctttttctatcaaaaaagatgttaaaatctttgtcttcaataacatagtccttcactatcaatttttctttaaacacttcatccataaattcaaagaaaagcctgtcggttttcataatgctgtataatactatcagtttgcctgtttctatatccccatgaactaacttgtggagcaaaacctcatccagaacttttatcctttttaaaaccatagacgcaatttcttttctgcgagtctctgtgtttacctgaaaaatgttatcataaagcgctttttcctttatttcgttatctttcaaaccctggaggacaagatttgcagcctttttcatctccagaaaaaggaacggcaatgttttaatagtagtcttatattccatttcttctatcatctcaaactcactcttttctatcattcttactcttattattttaagcattggtcaacatgcaataatttgttatcctacactttttcgccattaacatcagttaagtcgctaactatttcccctttatcgagggtgtaaaaataggtataaaccatgttgcgcaaaagacggctaattgtcacattatgtttttttgccaggttttcgatataagaaagctcagcatccgacaccttgatgttaatcattttcccttccttcgtgcgaaaggtgtaatcctcaagcaactctttgggatgaaagttataaagtatatacataatcatcttcgctctcgttgcagcaattttgttttgttcagcatattcttttaatcttcggtgcatctgcggtgttaccacagtccagatttcatttttctttttcaccaagtcaacacctcgcacacagtcatccaagataatagtaaattttataacaatctttatcaagttttttttagatttttctttcaaatttatgcacagtaagaatctgtttagcggtactttttgtggttcctattagcttgtgaaacagttaataactaaaccaatatcgcaaaaattaatagaattacgctttaatattaaccacgacgaattattttgatttattccaagtattctatgtatttcttataataataacgttttttagtggtaaacattaaataacctccatgcatgtaacgtttctaaaatcgtatttttctcaattggctcttcaacctcttcagtcttttaatatgggccgatatgtattaatacaaattaatataaattaatacaaatcaattcatattaatttgtattaatgcgaattatttttccctacaggtatattgtctttgactcgataccctcgatggctgaaagctcttttttaataataagttcccgtctcttaattctttgttatcggcaatgtaacgatattatgtttttggtcaaagcgtttttaaaaatgtattgctttttgctcaagtttttattagagtaatttttatatttttttgtaaaaaccattgatgtattagaatataaatgctaaatgcatgtgccttgaaatccaaatccgaaaggggctgacataaataaatgataaaatatgtcagattcatttgcccaccgcgcggcattttttggatttgcgtacggcgaattgacttttggcgagatgaagttgaaatagcagtcccgaatgaaaaccaacaaatggaaacggtatacaaaaaaacattctttgcaccatttacttctttgttcacagttataggtgtaagattagctgaagcctttgtaatataaatatagatttcgattctaaaaacaaaaagtttattaaaaacatttatatcctcagcatttcgaatttaaaatcgtaacttgtatttttaaaatcataaataaaagcctctacatacgaattggatagatgtagaggctttcttattagttttggctaaacggaaatgatagatttgatctctttatccccaatctattgttgctttcattaatagtgataacctctctctgcaaagttgctatagtaaaattcgtaaagttcttctgtggagttaaattctggtaccgtcccctctacgaatggccttactttggtattgtattcctccagggtaagggccttgaatactatcatcccaaaatccctgataccttcttccaaagtattttctacccgatgccaaataaagccgtcctctgtctctttgaccagctttccaaaaaattgatgtcctctaccagtactatgaaacccaacccagttatcatgaacctcgacacagattgcaagttgcaacggcggatttgggccaaatgaagagtcttttactaaataaagaactttatcactaatcacactaaacacccctataccctgcaggttatcccaattatattccctttgcttttcttcattcactatgaattttgatgggcaatttctatttataacctcacttctcttgagtaaaatttgactttaattacccgttttaggtaatatgggaacgaataattactttagtatagcaaaggagtgtgatcaagatggaacaaaatgactgtagcataaaagatttcaagacacttaaagtctggcaaaaagcaagagaattgtctcaagatatctataaagtttccgctaattttcctggatttgagacctatgcagcaaaatctcaaatcctccgagcagtaaactccatcggcgcaaacattgccgagggaaatggccagctttacaagaaaaaacaagtcaattttcttaacaatgcgctcgccagcgcatcggaaacgcgacactggcttgttgtcgcattagataatggatatattctttaaaagattataataagcttgagcaaaaaaccacagaaatcatcaaaatgcttatcggctgcattaaaaagctacaggaaaaaacagaagatgaagaaatcgcgtaattccgagatttttgccattccaataaccttactcgccctttgcgtattgttcaaattaaattataagtatgaatgtaagtatttttcaatttcgattaaaacaagtcgaagtggcaataattaagcagatactgcttaaggatgtagggaataggtgtgcaagtctttactggcgtagcacttattccctttttcttaatcaatttttagctgctatttttttgccctttaatgttataattatggtgaataattccaaaaggaaggatatatatggaaacagataaaaaaagtattatacttaatttatactgtgatgaaataaaagaataccctcttaaaataccttttattaacacttttgaaaaatggacatatataggaatgcttattgtaccagaatttatatctgataagctctacaaagatttgataaacttacgatgtctttcacaaccacctaaaccgtggggtagttgctcagagccttgtccttaccacaatttaaataatacagaaatccattatcaaaacacagatgattcaataaaatataagatagcttccaattgggtaaagtattggcttgatgacagggaaaatatctacttttacatactcggtattaaccttacaaaattagatctggataaattcggccccaaaaatcaaaaagataaacactcaactatttacaatagattttttagaactgcactaaaaaaggctttgaaaacttattttagagattatgatagcataatcgtcaaaaatatttttcatgataaaggcaatgctgaataccatgaatatttcccatggcactctatttataagttacaatccgaagaagataaaatttattttgccaacaaccatataaaattcattaattccgaccaccgcaaacccgacggagatcctgtacattcacagtttatccaatttattgatataattcttggatgttttgcaaatagtcttcatttaaatgcgacgagtaaaaataaatattctctaacagttagtgcttttcctattataaggcgaattataaaaaaccctaataaccctaacagcagatataactactataaaagacaaatggtacagtttttccccaaggaagatttaaaaggtatggatgaacaaagccttgaatacagatataaaaagttaaatcaattctatactaatagagagttaccaatagaaagaaaaataaacggacaattatccatatttgatttataaaatattactcttaataaacaaaatcatttttctttacattaagaaagcaataaattacttattataggctaaaatctcccatataaaaattattatacaatacaaaattcttctcttatctcatctattaatatggctttccctgcaacataaaattttataaatattctatgctcctcatcaacaatcacacctttagacccatcagtaatcttatttatgtagtcaactgatttattaataatatttttcacccattgttttatagtctgttcatctgaaaacccgctttctctcaagcagtcctcggcaaaaattatttttcttggcaattataatccctccttacaacaacttaactgaatatatcaaagactcattatccttgtaaagatatcgttaaagctttttttagttatttggaaaaacttttttcccttttcggaacgacttttttactcacggaaaaacttccaccataaacaaatttttttcttgatccttatcccttttttccttgccactaactatgttaattttaaaaaaaaccctttccatttccaatccctcaaacccgcataaaatctacatgtcattttcttggaggtaataaagtttttccgtaattaagctatatttctactaaaatttcccaatgtatgctctactttgtgcgaaaaaagtctttctacatgaggcaggttcaaggatgaaaggaaaaagggataagtggcgtaaaatccgtatttatcaaggctctaccacttatccctttgtatttctttagaaacttaaccattcttccttttccctcattcattctccactaaggggaatggatcaaggttaagcttgctcattttacaatccgcaagtcttaaacatattttgtgcattaacctctagagcttctcatggacctgtacccacctaagtaactatccataaaccgagagggtttttgtttaaataaaagaaacataatttttcacccaatcgacgatcacggtaaccatcaacgaagaattgccatccgtaaactgtagtcgcccagtgaggctcgtagtacccccctggtgtaattttaactttcactgctgccatagggctaccgtataaggcaacataaaatcggattgttcctgtaggtgtaagatgagcaataattaccgataaaaagatcaaggctgttcagttacaggcattcccttacaattacgctacgcatcaaggaaagattataattggtaagtttagagccatgtttaaatacgccttggagctcttctggcatcgtactggagtttttgaataggagaagctttctcgtgaatttcttttatgtcatcctgcgaaagcctaacataacgccttgtcattgttaaatccgtatgaccgagtatcctctgaaggctaaatggatcaccgcctcctttcaaaaattcaatggcaaaggtgtgacgtaaaccgtaaggcgtaaccttcacccctgcttcttcacagtaacgcttcactatgcgagaccacctctgcgctgttagctgtctcccgttttcactcgcaaagagaggcacttcattactccaccatgaaggtcttattttaaggaacctcattaaagcctgtaccgtaaatggtgagattaccaaagtccttcctatgcgtgttttagcaacatcggcgcgcacgtaaatttcccttgcgtcaaggtttaaatcatcaggtttgatttgtagcagttcgctgggccttgctcctgtatcaatctgcacgagcataaggcagtaatccctcaaccctgcataagttttcttgtctggctgagccaaaagcttctttaccgcctcaatcgaaacgtgcctcacgttagagatatcctcttttgccttccttatgccgtctgtggggttggcagggagatagccttcacgcacacaccaattaaaaaacgccttgaggtattgcaatttgatgttcctatatcgcggtgaagatggttcgctcaaatgctggaggatcgcttttcggacggcctcataggtcggattagcacctgtaagctccatgaacttttcgatatgccaacggtaatcttctaaagtgcgcggtgctagtccgtcagcttgtcttgcaatgagaaattcttctttgagctggctcaagtttacttccaaagatttcttgaagggtatcggtttaggcataataaaagacccccctcagtggtatcggatttttgaggtagggtcaatccgcaaaacgcagatttttcaaggctggagcgggaaacgggattcgaacccgcgaccctcggcttgggaagccgatgctctacccctgagctactcccgcaggatggtgaccccaccgggattcgaacccgggttaccgccttgaaagggcggtgtcttaaccacttgaccatggggccaaaataaaatggtgagccatggaggactcgaacctccgacaccctgattaaaagtcaggtgctctaccaactgagctaatggctcatccatgcaaaaattatattacaataaatcattcacagtgtcaacaacttttatcaagaatttatactgttaattattaacaacgaagagtagccaccattcggtcgttattggttaataattttagtgcatccaaaggtgattttacgacaatatcagcgtttagtaaggcttcaatactggccccttcttcttcgataactaaaatccctaaagccgcttcctttaacattagtcggtcattgtaaccattaccaatagccaccgtcttttccgccccaagtttttttataaactcaagtttttctggagcaccgggatcccccactatcaccacttccacataaggaagaagagatagctcttcctttaccttaccaaaggtatcacgggttaaaacgtaaatttttaaattcttacttagctcttccaaaagttctttcaccccgggcaatagctttccgtctacggcaactgtaccattatagtccattaccaaatacgataaatttaaagtaaatcttcccggaatctcgatggttaacattatccttctctcctgttttccagtatatatttttctaaataagattcataaagagtccataatcgattggttaccgaatagtcatggaattcccgctggtcgagctgacctacgggaataatcccccgcaccgaattggtaaaaaatatttccgttgcccctaatatttcttcggcgggatatttaccttccgataccggaataccggctactcgggccagttctaaaataagctcccgggcaattccgggtaaaaccagatttttctccggggttttcaataccccatttttaacccagaaaagattcgccatactgccttcagccaaataaccttctaaagtaagccggataccttccataataccttttttctgacattctttagccgctaacacctggggaagctggtttaaagttttaatctgtcctataaccagtttaggcggtaataccggaaccgaaagaaaagaggtttttattggcttaaattcccttgaaggcggggaagacaaactcattaaaaccgttggctctaaatccttagccggcaaaagcccccgctcgcctactccgcggcttacgataatttttaaaactccgttaaccacattattttctttaagatactcccttatcttcgatatcaattgttccttactataaggtaactttatttctaataattgcaaccccaaaaatagcctttggagatgcttttccagtaaaaacggtactccggaaaaaacgccaattgtctcaaaaactccatcaccataggaaaatccccggtcaaaaggggatattgccgccttttcccggggaagaattttgccgcaaataaacaccttatccatttttaaaaaacctggtctaaaataatagtttgatcccggcgggttcccaccgaaataattttaatgggaacaccggtaatctcctcaatttttcttaagtagtttctggcgttttccggaagatcggtaagcttcctggctccggtaatatcttcactccaccccggaagctcctcataaaccggttcacactgggacaactcttttaaactggcaggaaattcatttatgacctttccattgaaccggtaccctaccgctatttttatggtttttagcccggttaaaacatcaagcttggtaaccgcaagtccggataaaccgtttaccctggcggcatagcgagcaattaccccgtcaaaccagccgcagcggcggggtcgtccggtggtagtgccaaattcgtacccctgttttcttaaaaactcgccggtttcatctaacagctcggtaggaaagggaccacttcctacccgcgtggtgtaggcctttaccacaccaattacttcatgaatttttgttggtccaatacctgcaccaatacacgcagcccccgccaccggatggctggaagtaacatagggataggttccatggtctaaatctaaaagggtcccctgagctccttcaaagagaactttttgaccgctttcaatagcatcgttaatcaaccgggaagtatcggtagcgtaaggcctaataatttcagcatattctaaatactcgtggtagagttcatcataggaaaacccttctaccccataaattttttccaaaagattatttttttcttttaaatttaaagccagtttctccgcaaatagttccttatctaaaaggtcacataccctgatccctgtccttgccgctttatcccggtaagcgggaccaataccccgtttggttgtacctattttgttttcccctttatcttcttcttccagctcatcgagtttcttgtggtagggcataataagatgagcccgcaagcttatctttaagttagcggttgtaaccccccgctgtctaaggtattccaattcttcttttaaaactttagggtcaattaccactccgttaccgataacacaaattttttcagggtataaaatccccgagggaatgagatgaagcttaaaggaattttcccctaccacaacggtatgtccggcattatttcctccctggtaacgaaccaccaggtcagctttttctgccagaaagtcagtaatctttcctttcccttcgtccccccactgggttccaattaaaactacagttgtcaactataaactcccccttaaaggcgtcttgccagctcacggccaataagtactcccgaagcagaagcctgaataagtccccgggttacccctgcaccgtcgccggcagcaaaaagattttgaattttagtttccaaaactggactcaattctaagcgtgaagagtaaaactttacttctactccgtaaagcaaggtatttctattaaatactccaggagcaattttgtccaaagcttgaagcatttctaccaaagccattaaatggcggtagggaaagaccaaacttaagtctcccggagtagcatcttccagggtcggccgcaccaaaccttttttgagccgttcctcggtagtccggcgaccgtccattaaatcccccagccgctgtactaataccccacctcctaataggttagcaagccgggcaatgtacttgccgtaggcaataggttctttaaagggatgggtgaatgttttgctgacaagcagggcaaagttggtgttttccgttttcttgtgggcatgagaatgaccgttaacggtaataatcccatcgttgttttcctgtactacttcgccgtagggattcatgcaaaaggttcttactttatcttcaaaagttttcgagtagtaaataaactttgattcatacaccactttggtaattggctccagtactaccgcgggcagctcaacccgcaccccgatatctacggggttaacggccgttttaagcccaagctttaaagactcttttaaaagccattcagccccttcccggccaggagcaacaatcacagcctcaccttcataatattcgccggaagtggtctgaactccttttactttcccgtgatcagctataatttctgctaccggagtattggtagcaatatccaccccccgccgcaaaagctcttctttcattgcggcaactatttctaaggcacgaccggttcccaggtggcgaataggcgccggaaccaaccttaaatcggctaagatcgctctcttttggatttcccggatttcctcttcccggtctataccataaacctcgttcggagcgccaaatttaagatatatattatcaacgtattttatgagctcgtttaattccttttcgccaatgtactcacccagatgtccccccacttcggtggacagggtaagcttaccatcggaaaccgctccagccccgccccaaccggttacaatcgcgcagggcttgcaattaatacacggtatgcccctttcttttgagggacaaatccttttattaacgtcagggcctttttccaaaataagcactttcgcttcgggtttcaacgaggtaatctccagggcggcaaaaattcccgccggacctgccccgacaattatcacatcatactttttcatcaaaattacacctccttcaaaacccaatttatgatagcagttaggtatcaatgtgtcaagaaaaaaggggcttataaagcccctttttacatgtatactttattaaaaaacagctacaagatacttaagtgctgttaataatattattcccggtaaatccaaaacacctgcaatcaccacagttaccggatttatcggtaaatgccagccaattttatcaccgattaaattaaataccccaagtaaaataaagccaataacaagccaaaaaaagatttttttaagcaccaaacccaaaagctccaccggatatccccccggtaatacttatgaagcttttggacaacttattccaaaactcttcgaccttctaaggcttttcggatagttaattcatcggcatactcaatatcgcttcccaccggtaaaccgtgggcaattctcgttactttaaaatttaaaggttttaaaagggatgctaaatacatggccgttgcttccccttcaacggtgggattagtggcaattattatttcctccaccggctcccgggaaagcctcaataacaactctcttacctttaaatcttccggccctatccctttaattggcgataaaactccgtgaagaacatgatatatcccattaaagctcccggttcgctccatagctgccacatctttggcttcttctacaaccattaaaagccggtgattgcgaccgggattccggcaaatggcacagggatcagtatcggtcaggttaaaacagatggagcagtatctggtatttttccgggcagttattattgcttctgctaaagcccgtgcttcttcttcaggaatttctaaaagatagagggctaatttttgcgccgtttttggaccaatccccggaagtttggcaagatgttcgataagttttgctaccggttctgcaaaatacaatttcccgcttcccccttaaaacaatccgggaaggtttaaattaaggccgccggtaatcttattcatctcttccgctaccatatcttttgattttctcaaagcttcgttcacggcagcggtaatcatatccgccagcatttccacatcttccgggtctaccgcttggggattgatggttaaggataccaattcctgcttgccgttcaccacggccttaaccattcccccaccggaggtagcttcaacggttttttcatttagtccttcctgaagcttagccatatcctgctgcattttctgtacctgctttaacattttttgcatattacccatgttgccaaacatctttattcctcctctttattgataatgacaactttatcatcaccaaaaagctcttttgctttctttagagcttttggttcatctgttttttcttctaaagaatgtttttttacgttaaaagtaatttttaaaccttcccccagagcttcggtaaaaacttccttaattatcgctttgacctgagagccttttttgtagtgaataatccagtttagaggctcttcatcggtaaaaactatttttatgctatcggcagttttaaagggaatacctttacttaagtgaatcgcaagagggggagaaatttcccgggttttctgtaaaacttcctgccattcagaagtttttaaaagatttatggcacctaaagatttttcttcatttaacttctgcttttcctttttactttcctctttgctatcctctactggttttaaaatggtcgctggctttaacaattttccctctaaattcctcgccacttttaaaagacctacttccgcccagatccggggaaaacttgcataacggacttcccgctcaagacgagctatatcatcccacaaaagaaaaagtttatcctcctcccaaagggccgcttcactccttaatttttccagtacttcaggcattagttcttcaacttctataccgttttttattaaatttaaataacgaacatactgtaaaatttgctgaacaaaaagcttgacatcaagcccccgctccaccacttccgctatttcgttgattatttttagttggttattttcccggatagcagaaataagttctaatattttcctccagctgacaaaccccaggacttttaaggtatcttctaccgtaattttgggattaaacaccagtatctgatccattaaacttaaagcatctctaagtccgccttcagaagcctcggcaattaaatgtagggcttccgcttcatactgaagcttctctttttccgcaatattttttaaatgctcccagattgttttggtgctgattcttttaaaatcaaagcgctggcaacgggaaacaatggtcaccggcactttgttaaactcggtggttgctaaaataaaaattacatgttccggcggctcttccagagtttttaaaagggcgttaaacgcttcattagtcagcatatgcacttcgtcaatgatgtatactttgtatttaccctgggccggaaccagtttgatagattcccgcaattcccggatttcatctatcccccggttggatgcggcatctatttcaaacacatttaaaaggctctggttgttaatcccaatgcacgaagggcactggttgcacggctctccctctacagggtgttcgcagtttaccgctttggccagaaccttggcggtagtggttttccccgtcccccggggtccagagaaaaggtaagcatgggccacctgcattgtggccaccgcattttttaagattttcacaatggtttcctgtccgacaatctccgaaaaggtttttggccgccatttgcggtataacgccagatacataactttcacccgaaaaatttaatctatagctaaaatcctaacacttcaatataataaattataaagactttggctctaacgcaaaggagactaccatgattataggcgtccttactttagagctttatatccctcaatcccaatcgttaaaagaaaagcggatggtcttaaaaagtatcaccgaaaaaataaaacataattacaacgtttccatcgccgaagtaggaaatcaaaacctctggcaaaggtctaccctggctttagcagcggtatctttaaaaaaagacgatatagaaaaggtttttgccaagatcgaaaacatcatcgaacagaatggtaacgtcttaattaccgaaaggttcaaagaatttatttaagtttgggccgaacaaaaataagataaactattattcccagtggaaaggtaacgaataaaagaacagtggcaattaatcctaaaagaaagccttttttattgcgtatccctaaaccaatgtagagagcgataaaaaagtttagcagaataatccagggattagaccacagaataaggtatttcgttaacatttttccacctttactcttttaacgtattaaagttaaatacccactagccaaaaggacgttcatttgctgaacttttttaataaagtccttttgttcttctgttaattcaggtaaggataattctttagttacaaccaagccagcaggaataaatttttccgctttaatttccatatcctgaacaatcgctctatggcctacaaaaacccattcatttagtaccgctttaaataccaacgccccaaaaccaataaagcagttttccctgatatctaccggaccgtgaataattgcaccgtgggctattgatacgttgctgctaatttttacttctgttcccgccaaagcatggattattaccccatcctgaacatttacattattaccaatcgtaatcgggcttacctctccgttttcgggctcatcggcccggataaccgcgttgggaccgataaaacaattgtcccctattatcaccttaccaattatttgagccgagtgatgaatataagtattttgcccaatcaccggaaaatcgccaaatgggttaggagataacatttaacccctccgtagtaccatttttatatatattttaatatttttcggtgaaaaaaaatagcctttaagcttaaaattaaaaggaggtaccgctatccgatacctccttttaattttaatgccgtgcaactgccgtcgagtttatcgtacgagcgttaccccggtagttggctcgattcaggcacccttgcggcacccggagggatttcccttagtgctgcttccttccggacctgacacggttcgggagtctccgctgcgcaagacccaaatctcattgctacttgccggggccggtcctcacaaggtaaaccctcgggcagccttcagccccgctatagcggattgcgggtacagggcaccgctacctccccgcctagcacggcaaattttagcatctttaattaaattaatggcggagagggcgggatttgaacccgcgagacagggattgacccgtctactcgctctccaggcgagcgccttcaaccactcagccacctctccgcgtgcttgaacacaaaattaaatatttaattccatgcagatgatattatacaactattttaatgctcaagcaagaggaattaaactggcggagagagtgggatttgaacccacgaggcgggttttggcccgcctactcgatttcgagtcgagcgccttcgaccactcggccatctctccgcactttttatgcttaattattttagcataattttacctggtggacaataattaaaattttcctctgttccttttttccctgaaaaaatctgttattattttactcgcctcagcggcaagtaccccggatatcacctctacccggtggtttaagcgaggatttcgcactaaatcaaataaagtatccaccgctcccgctttaaggtcaggagctccgtataccagggttttaattctggcctgataaatcgctccggcacacataggacacggttctacggtaacataaagggtacagtcctttaactgccagtttttaagtttactggcagcttcttttaaagctactatttccgcatgggccgtagggtcagaaaaggtctcccggagattgtgcccccgcccaatgatttccccgttatataccacaacggcgcccaccgggacttccccttggagcgccgctttctctgcttcctttaaagcttcagccataaacttttcatggtccatggaatcacctgaagaaataaaatggtgcgcccgggaggactcgaaccaccgactcgcggtttaggaaaccgctgctctatccacctgagctacgggcgcactgttttgcaacaaatattttatgccaaagataaatacctgtcaagatagtaatttttgtaaggctttagcaaaatcttcctttaaatcttcaatattctcaatccccacgctaacccgcacctgattatctgttatgttaagaattttcttttcatccggcggtatcttttggtaaatggtagaatccagatgacaaaccaaggttctgacatcgccgatgttggtggcaagccgcgctatgttaagattttttataaaattaaaagccgtctctttatctttaaaacttaatacaattaaatttccgcccttgccgccaagataattaacacaattttgccactccacgctatccccaagacccgggtaattaactcttatttcctgaaagctctgtaagaattcggaaagctcccgggcattttgcaccatacgttccattcttaaagccaaagtttcacttccaattaatacctgccaggcagcgaaaggagataaacacatacccatgtcagttgctaattccttttttacataagccgaaaaggcaaggggtcccgcttcccgcactaaaggataaagattctggaagcgttcgtcccattcaaagtttccgccatcgacaatacacccgccaataaccgttccctgaccggatatatatttcgataaggaatgaataacaatattggcccccaaagaaaggggtttcaccaaaagaggggctacagtattgtccaccaccagaggtattttgtgcgcctttaaaagagaaaccaatccagcaaagtctggtattttcagagtaggattgccaattgattccacaaataccaggcgagtgctggaggttaggtgctttttgactaactctggatccggtgcaggcagtaacttataggttatcccacaggttttagttaaatttttcaataaatttaaagtcccgccaaataaaccagcacacaccaaaaattctgctccgggctgggcaaaagccataaaggtaagggcgatagccgccattcccgaggaagtggcagtggccataactcccccctcgagccgggcaaccttttcttctaaagccgcgaccgtaggattggccacccggctataaaaaaagccgggggatttgccgccaaaaatttgttcaagcttttccggctctttgtaaaaataagcagtctgtaaactgggtccttcgatcgcacgttttaccagaaaagtttcgatgtgcacttttccccaacccccttatttcaccgtaataattattttataaatctcctccccttcttcctcaatcttctctaccctatggccatccattttaaggcttttcgtaacatccgctaaggtattttttcctgctaaaattgcggcaattttatccccggaatttaagtttgcaatttccgcctgaagaattacataagtcattgggcaaacatactcccttaaatcaatagttttaattaccttcattttccccttccccttcgttcaaatattgttctaatttagcaaaacctaccctctccaaagttttataaaaccgttcgcctgtttttccttccttccggtaaaactccagagtcttatcaaaaatagcaaacattttttcttttgaacttataaaaggaattaattttttcccaatattaattttccggccaaagcttccgccaaagcttaaactgtaaccgtattctcctctataagcttcaaagggacaggctttaacgcaatcgccacaaccgatacacacctcataatcaacacttatttcctgctggtttaaggtaatggcattaaccgggcaaattttagtacacaacccgcaggcggtacaattttcttttatccagtttgggcggcatactccttttatccccaggtcgttttcctcggcctttaaacagttgttggcacagccggtaatgccaaatttaaatttatggggaagagtttggccgtaatagcgggcagcaatttcccgggccaattcctgggtttcaatgcagccgttggggcaaatactccgtccctggcaggcggtaaccgtcctgacccttggcccgcaggctcccagttctaagccgtagcttttaagtttctcaatcacttcttctaaatcggcaatatggatatacggtatctcaaccccctgccgggcggttaaatggagagtaccgtttccgtaccgggaagccacttcctctaaaccccttagctgctctaaggttaaattaccgccggttacttttaggcgcacggcaaaatatccatcttccgtctgccgcatgatgccaccgctttttaacgctttataatcaactttttttaccgtaatctcttcttcgccgacctctccttgcaaaactttaaatcctttgaaagttgggggattgtctttcaaagaaaaaattacataaaccagattagggtctaacatcaactcccggtcttcagcagaaggtcttgccggagtcataggatgactgtgaaaattccctaaaagcacctcgttttttgcccgcatttttttgataatttcgtattgttctttggcctcaatgtcaaaacggctttccgattgggcaatattttgagcaaaataaaccgattttacaatcttaactccgttttcaatttttcccccaagtaaaccgcaggcttcaatgggatactgttcccggcagtattttaaaatattttcgatttgatattcaaaaaataccagcactttaattttccccctttaaatcacaaaccggctgactgtaatctactaaaataatctcttcggggtctttagaacaaagacagctttgtcttttctttaaaggaattttgttaaattccattaattttaaatcaacaaacaataaatttcctgccaaagtatccattcccagaagatacttgatacactccgtcacctgcagcgagcctataactccagctaccgctccaataacccccgcttctttacagctgggaacacttccgggaggcggtggttctttaaaagcacagcggtagcagggtgtttccccatcgggccgataggtcaaagtctggccccagaaccgcaaaattccgccgtgggaaaaaggttttttagcttttacacaggcatcgttaattaaaaacttggcgggaaaattatcggtaycgtcgataataaaatcatactgctcgataatacttaaaatatttgcggaagttatcggttcattataggtaatcacctgcacctccggattaagagcttcaattttactttttgccgataaaactttttcggtccccacatcccgggtaaagtgaattatctgacgctgcaggttggttaagtccactacatcgtagtcggcaataccgatggtccctatcccggctgctgccagatacagggccaccggtgccccgagtcctccggcccctattaccagaactttagaatttaatagtttttcctgcccttttacccctacttccggcaaaagaatattacgggaatagcggaacagctgttcacgcgaaagcatatccgccacctcccatgaaatacatccattctatttcgtctccttcggaaacttttacgttattaaactcttcacgctttacaaattcaccatttaacactaccgaaacataattgggcatctccacctgaaaatactctaaaagttccgcaattgtaaggctttggggaatctctttttccgctccatttaccactatcttcatagcctacctctcctttcctttaaagactttgataatagcgacgtaaaacttccgctacctccggacgggtaaactcttccggcaacggctttccttccctaagcatttcccggactttagtaccgcttaagcttaaatgatgttccggaccgtgagggcaggtttttttcgtagccatttgcccgcatttagagcagtaaaaagcgttatcaaattttacaatcttaatttccaaagcattttctggaaaagtatcaaaaatctcctgcgcttcaaagggaccgtaaaaatttcccaccccggcatggtcccggccgacaataaaatgggtgcaaccgtagttttgccggataatcgcgtggtgaaccgcttccctgggtcccgcataacgcataggtgcaggcaacgtagcaaagacaaaccggtctttagggtaatagttgttcagtaaagcttcataacatttcagccgaacatcggcaggaatatcatcccccttggtttcaccaacgaggggattaacaaaaagcccgtcaaaaatctccagagcgattttttgcaaatattcatgggcccggtggatggggtttcttgtttgaaagccaactaccgtcttgtaatttctgcttttaaatatttcccgggttttctgggggaaaagagagagatttaaatcaatctccctgaaagccggcgggtaaattttaatcttaccggcaactgcccattcgtcctctccgagaattttttgcacccccggatgctcaggggaagaagttttaaatactttttccacttctaaaattttatttaacttaaacgcccgggggctttccaaaagacctaaaagctcaccgtttgcagcagttagtaaaactttttctctgccgtcgtaaagccgggcttcttcttcactgacccttaagactatgggaatcgaccataagaacccggagcttaaggtaaactgttctaaagttgaataataatcgtcttcatccataaacccttctaagggagcgtaaagtccaacccccaaaagaaataaatcaaaatattcggtttttgaaaccgatagctttaaaaagttttgcccttttagctcctcatattcttctgacgttaagatattactgacttcttttcgcccgtgataattaaccatagttactcctcctccagaactttaaatttaaaccctttatcgtaaaacaattctgcattaaccagggctaccgaaggatgcaaagcaaggtatatagctttttgagggcactttttgacgcaagccgcacagtcgtagcaaaaagcttcatggtaaataaatacttcacccctatcccgataaagtaagtttaaaggacaaatcgcttcgcagggagctactttagctttaggacaaccgttacaccgctccttcgaaaagcgcggaggcatttaacttcctcctttccacaacaggcctgccctcttttaattgggagataagaaggtagtcttccggcgctttaccggggtagtccccccgctcctgataacagggcaaacggctttcagttctaaaagccatatgtttaataagaaaagtcgccagcaatatttgattttttacctcaaaaaattgcaataaatcaaaatcgctagtaatttttgcaagtcctaatttttcctttaacgaataaagcttttcttcgccaatttctaaacttcgaccggtataccggtaattagttttcttaccgccggcatactcttccatgattacgtttaagccgtactttaaagataacggagaaaccaaacctttaaggttactggtaaggtttaagacaatttcctgaatttcaagtcgacctccaccttctttccccgctgcatcctctgccgcaattaacccttcagccatagccccggtaacgtatttcttgggtgaaccggcggcaatatccccacaagcccagaggttttccaccgcggttttccggtttttatctaccatgactcctgaaagcccatgtccaccgttaatcaggggttcaaaaccatctacttccaggtaaattttttcgcctttatcttcccgtaaaagtaaagctgcaccgggacgcatatcaaaataagcccttatgagttcatcccggtaaacaccctcaaccacaaaaaccggaacttccccggcccgcctttcctctataacagctttaagccgttcggcggtattggccggttgatattttgtttttaactcttcacctttttgattaacaagcttgcctttgacattcatagccaaagttccggttggagcggccactcctttaactcttagaggaataaaacgaatttctaatgattttaaataagcaccggcctttaccgccagtacatgcccaactccgctgttagataggggataccaggtactcccgggatgatagggatttgccccctggtaaagtccagcagcgcccccggttgccaggatgtatttatctccggctattcttaaaaacttccgggaagttaagtcataggccagtactgcaactatttgattttgctccgtttcgacatcaaaaacaaacgtgcggttaaaaatttttattccggtttttaaagctttttgggcaatgacttcttttaagttttccccgtaaacgataatgctccgttttccccggcggaaaaatttcccattgtctttgggaatatttgccccccagctttctaaaagctccaccgtttcgtttaaccttttggctaaacttaacggtagttcatcctcaattaaaccgggaaattccttttttaaaaaatctacataactttccggagtgtcatcgagtaaaacgttgtttaaagcattaaccccggcagctaagcaaccgcttctcagcacatgagcacgctccactactaccacttcttcacggggtaaaagctcttttagtcttatcgctgcggttaaccctgcaacgccaccacctattattaccgttgccacctcacccacccccgatcagataagaatttttagcgaaagagccgttgttagggaaagaaaaattacccgtaccactttcggggagaggtaaaaatttaattttccgccaagtaaagcaccaggaatagaccctaaaattaggtaaattagaattttcggattaagattaccgaatttaaaatggagaaaaccaagaaccagggccagtattaggccgtgaaaaatatcggtacccactaattcccggctatcaaactttccggtcatataaaggtataagcccaccaaaataccagcacctatggaagttaggccaacaattatgccggtaacaaatcccgttaaaataattcccaagtcttcctgcggtaaactaagtaaactccctttaaaattcaaaaactcttttaacaaagaaataatacttacggcaattataaaccccgctaaaacatgggtaagcaaagcggaactaccagcggttttttttaagtgttctaatattaaaaccccagtaattcctccgggaatactcccatataaaagttttttagcggtagaaaaattgattttattttcttttttataaggataaagggccatccccttggtaatcgaggcaaaaaccagatcatttcctacaacttgccctggggccactcctaatagcaataaaagcggtgctaagatagaccctccccctactcccgtcagcccaatagataaaccggtaataaatccggctaaaataaatccgaccatgaaaaattcccccagagatatttattaattcttatcggaatacttatatttaaaggtataaatttttgcgtaaataagtaagaattatatctacacactcttctaaggattgctcggcggttttcagcgtaatttccggttttaccggcggctcataaggagaggtgatcccggtaaattcgggtatcttcccttcccgggctttttgataaagaccttttacatcccttgcttcacacacttccagtggacagtctacaaacacttcaataaatttccccgccggtaatatcgagcggaccttatccctgtcagcccggaaaggtgaaataaaagcagtgatgacaataatcccagcatctacaaaaagtttggctacttctccgatccggcgaatattttcctggcggtctttttcggaaaagcccaggtctttatttaagcccatgcggatattatcgccatccaaaacgtaagcaagcttaccttgccggtacaataccgcttccagttcccgggctatcgttgattttcccgaacccgaaagcccggtaagccaaataaccactcctttttgccccagtaatttttcgcgatcttccgccgttattttaccttcgtgccagaagagattatttgccacaatcaatcacccctatttccgatatatttatatgtatttactttcattttattaatttttgtagtattgtcaagtatttttactggtttttatggaattaaaaaaataaaagcgggttgtaaacccgttccgaaaaaaaataaaaaaccggggacttttaccccggctttatttaccacatggcgcgcccggcaggactcgaacctgcaacctccagattcgtagtctgttactctatccagttgagctacgggcgcctttataaaattaaatggcggagagagcgggattcgaacccgcggtacaggtttttagcctgtacaatcgcttagcaggcgaccgccttcgaccaactcggccatctctccgcaaccaaatcgccatggcggagggggtgggattcgaacccacggctcgcagggcgagtcaccggttttcaagaccggctccttaaaccactcggacacccctccctgcccgccactttctgcgatagcataaataatatatcacagctcaaacaaaagtgtcaagtaaaggatttttgttaagtccaaggtaaagggtaagaaaatatcttttaattcattataaatatccgcatataaaatagtcctatttcgtccctcaggaaggtctcgcaaaaaaaactgccccgatatcaaggtcgctatcacaaacctcttttaagcgtaaaaatttttccataaaacccacgccttattttttataaatccggtccactcccatataaggccgtaaaacttccggtaccgtaaccgaaccatcttcattctgataattttctaaaatagccgccaccgtccggcccaccgccaggcccgagccgtttaaggtgtggacaaactccggcttggccttgggatgctctttgtagcggatcttagcccgccgggcctggaaatcttcaaaattactgcaggaagatatttctttataatcattgtaactgggaagccatacttctatgtcgtaagttttggcagcactaaagcccaggtccccggtgcaaagcaccaccacccggtaaggtagtcccaaaagttgcaggaccctttccgcatcccgggtgagtttttccagctcctcatacgagttttccggtttgacaaacttaactaactctactttattaaactggtgctggcggattaagccccgggtatcccgtccggccgctcccgcttccgctctaaagcatgcgctgtaagcacagtggtatatgggaagcttatccccgtctaaaatttcttcccggtaaaggttagttaccggtacttccgccgtgggaataaggtaataatttaacccttcaagtttaaacatatcttcagcaaactttggcagctgcccggtacccatcatcgaatcggcattgacgataaacggtggaaatacctcgacgtagccgtgttcccgggtgtggaggtcaagcataaagttaataaccgcccgctccaacatcgcccctaaacctttgtagaaagtaaagcgggccccggttaccttactcccccgggcaaaatccaggatatctaactcttcccctatttcccagtgggcctttggggtaaaggtaaactttcgcggttcaccccaccgccgcacttctacattttcgctgctgtctttaccaaccggcaccgactcgtgggggatattgggaatagtaagaaggatggcatgtaacttttcttcaatttgggccacttcatcatcaagtttcttaatttcatcggataacgcccgcatttctaagattaaatcatccgccgggagcccctgttttttaagcctgccaatttcttcggaaacggtgtttctcttatattttttttgctcaacatccaccaaaagctttcttcgctcttcatccaagcgcaaaaactcatcgaggtttaagtttgccccccgcttttttaatgcttccaccactatttccgggttttgccgtacttttttaatatcgagcatttacaaatccccctattacttccgttttggtaaatttttcacgttcattataacattttttacggcatttgaaaattttaaaggtaaagttataaactcaccgcctttacttcataaatccccggaattgctgcaattgctttaatgctgtcaccatccgccggatgatccagcgataaaaccatgaccgcatctccgccgggagttattcggccaagctgcattccggcaatatttattcccttttcccccaagattatgccaacttttccaatcattaaaggctggtctttatgcggaacaaaaagtttatacccttcgggtaccacatcaacccggtactggtctatttggacaattcgcggctcattatttctgaacaaagttccggcaataattcgttcacccttttcggtagttacttttaaggtaatgaggttggtgtaatccgcaccgttttccattaccgtttccctgactttaattcctctttctttggcaactaccggcgcattaacataatttaccctttccatcaaaagcggatctaataatccttttaaggcagctaaggttaaaggacgggtttcttctttaaaagccgaaccattgtaaactatttccgcggccagaagccctcccgataaaatctgggccaggaagtttccgagtttttctgcaagattaatgtaaggctttagccgttgatagctttctttgtccatcgccgggaagttaacggcattctgggcaagcccgccctttaatacgctggcaatttcccgggccacatcgatagcgacgttaatctgtgcttctttagtagaagctcccaggtggggagttacaatcacgtttgggagctcaaataaaggagactcggtaagaggctccttgctaaaaacatccagtgccgctccggcaatttctccggcttttaacgcttcgtacagcgcttcttcgtcaataattcctccccgggcgcaattgatgataaacgctgactttttcatgagctttaaccgctcccggttgattaaattccgggtttcgttatttaaaggaaggtgcatggtaacaatatcggaattttgtaaaagttcttctaatgacattaacgtaataccaagcatttgagcccgttcttcggaaataaaggggtcataaccgattacccgggtttcaaaggctttaactcttttggctaccgccgttcctatccggccaaggccgataatccccaccgtcttgccccggagctcatagccggtaaactcttttctcagccattttccttcttttaaggcagcgtgggcctggggaatatttcttagtaaggccatcatcagggcaaaggtatgctccgccgccgcaattgtattaccttccggggaattaaccacaataattccttttttggatgcagcagccaggtcaatgttatctacccctaccccggcccgtcctattatctttaagttttctgcggcttcaataattcttgcggtaacctttgtttcgctccgaacaattaacgcatcgtactggggaataattttaattaattcttcttccgaaagctttgttttttcgtcaactataaatccttcttcccgtaaaatatttaagcccttttccgctatcgggtcggaagccagaattcgcactacgcttcacctccggtaattacttccattgcctttttaacaccagcacccagctccaccggatagccaatttcttttaaggccatttctaatgctcctattgccacaataatatcgagcttatcaacataacccatatgaccaattctaaaaatcttacctttcaggtctttttggccaccggcaaaggtaacgccgtatttggttcttaacacttttcttaactgttccggatcataacggtcatccccggctactgccgttaccgtatcggaagcattttcctccgccgggaaaagttttaaacctaaagcttttactccttcccggcaggcttttgccagtaatttatgcctcttaattaccttgtccagaccttcctctaagattaaatcaagagccgcttccagcccgaaaaacagcgatactgccggtgtataagcggtattccattccgccaaggctttcttagccgccggtaagctaaaataaaatttcgggtttttgttatcctgagctgcctctaatgctttttgactgaaggaaataaacgctaagcccggaggcagcataagcgctttttgggaaccagtaactaccacatccactccccagccatcggtatcaaactccatgcctcctaaacttgaaaccgcatcaacgataagtaccgcccggtggtttttggttaatgccgcaatcccggcgatatcgtttttaaccccggttgatgtttcattgtgggtagccaaaaccgccttgtaattgggattctgccttaacttttcctcgaccaccgctaaatccaccgcattaccccagccaaaatctaccatatcgactttggcaccgtattccttggcaatcttggcaaatcgttcaccaaaattaccggtggataaagccaaaacctcatctcccggatttacaacgttggctacggccatttccatgcctccggtaccggagttggtgagaataaaaatgtcattttgcgttttaaaaacctgttttaactttgctaccacccgctcatgcagcttggcaaaatcaccgctccggtggccaatcatcggccggctcatggccaaggtaacctccggcggaataggtgtaggtccgggaatcataagatattttttttgcacgaaaaaccctccctttaaaatgtaaaatttttaaaatttatgctttaatgaaaaatatttacttttgatgtttaaaaattttccttttctaatctcctgccccaaacccctaaacaaaaaactcctttcatccctcaagggacgaaaggagtcctttcgcggtgccacccttcttggcagaataactctgcccacctcgtttggttaacggctcggccgttaccggctactttactttcgccggtacctcttgggggcggattcgcaaagcattcccaccggtttccaccagccaccggctctcttcagggaagaggcttgctactactccccggcatagagtttacaatttattttgcttattaatctaaaagattgcaaacagttttgtcaagggggtaattgtgtatacattttatttttttaaagattggtctttggaaaaaattaagcgcaccaaattgtgcgctttaccattaactataagcctttacaaactttttcaatgaaataacggtgaatccgcaagtcatcggttaactccggatggaatgccgaaaccaacatgttatcctgccgggccataactattttatcatctactttagccagtacctgaacgctgggcttcacctctaatatatacggcgcccggatgaaaaccgcccgcaccggctcctgacccacttcgggtatttccagatctacttcaaaactatccacctgccggccaaaagcgtttctggcaacttttatatccatcgttcctattctcggctggttgctgttttctatttccttggccaaaaggatcattccggcacaggttccaaacaccggaagaccacttaaaattctttcccgcaggggttccattaaattaaagtcccccaaaagctttccaatggtggtgctttcgcccccgggaataattatcccatcaatctgagatagctgttcagggcgtctaattcttaacgtttcaacccccaaccgggccagggtttgctcatgttcacgaaaagccccctgcattgctattaccccgattttcatctccttttcctccttctattaattagcacgttaacagaaccgtccctataggttaccagcctcgctcgctcattctttcggtttgggaaatggtcttaatatcaataccgggcatagcttcccctaaacctttagaaacttcagccaatactttggggtcgtcataataagtagtagcagctacgatggcttttgctctgcccaccggatctttggatttaaaaattcccgaacccacaaaaataccgtcagcaccaagctgcatcattaatgccgcatcggcaggagttgcaataccgccggcagcaaaatttaccaccggtagccgaccgtgttcatggacgtataacactaaatcatacggagcgcccatttctttggcagcagtcattagctcttccctgggcatgttctgaatccgccggatttctcccattacctgccgcatatggcgaaccgcctccactacgttgcccgttcccggttcacctttggtcctgatcatcgcagccccttcgccaatccgccgcaaagcttcacctaagttccgggctccgcaaacaaaaggcactttaaaggcatgcttatcgatatggaaaagttcatcggcaggagttaaaacctcactttcgtcaatgtaatcaaccccgagagcttccaaaatctgcgcttcgacaaaatgtcctatccgaactttggccattaccggtatggttactgcatccatgattcgcaaaatcacgttaggatcagccatccgagcaactcctcccgccgcccggatatccgccggtaccctttctaaagccataaccgcacaggccccggcttcttcggcaattttagcctgttcgggagtggtgacatccattatgacgccgccttttaacatttccgcaaggccctttttaaccacccatgttcctttttcacccattttgtgactcctcctaaacacggtattaatttttatcttaacttaattttggttttttctgcaagcctcaaactttaatcattttcttcgtcttcctgggcagcaatcttagctacggccgtcaattgatcatctttattgagtttcattaaagtaaccccctgagttgccctgccctgggtcgatatttccgcagcttttacccgaatcattatcccttccccggaaatagccattacctcatcttccggacgtacggcaacaataccaactacttccccatttttctgggttactttcatattaataatacccttaccaccccggccctggacccggtactcgctaaaaggagtcttttttccaaagcccttagaagttaccgttagaagttccgcctgctcgtccaccacttcaagaccaattacctcatccccggggcttagggttattccttttactccgcgggcagtacggcccatggggcgaacatcggtttccgaaaatcttatagccattcctttttttgtcccaataattacttcttcctgcccggtggaaagcttaacatcaattaacttatccccttcttctaacgataaagcaataattccgtctcttctggaactatcgtattcggataaaacggtctttttcacaataccgtttttcgtcaccataaagagataatggtcatcggtaaactcttttaccggaataatggcggtaatcctttcgtcctggtcaacataaagtaaatttacgataggagttcccttagcctgtcttccggcttcgggtatctcatggacctttaaacgatacaccttccctttattggtaaagaacagtaagtaattatgggtagaagttacaaacaaatgccgcacaaagtcttcttctttggtagccatggcggtaaccccgcggccaccccggcgctggtttttataggtatccaccggaagtctcttgatgtaaccctggtgggtaatggtaattaccatgtcctcttcggcaattaaatcttcctcatcaaagatagattcttcattggtgatttgcgtccgccgggcatcaccgtatttttccttaatttctaaaagttcctgacggattacccctaaaagtaccctctcatcggctaaaattgagttaaaatattctatcttcttaattaattcccggtactcttcatcaattttttcccgctctaaggcagttagtctttgaagccgcatatcgaggatggcctgagcctgtttttcggtaagtccaaaacggctcattaatccctcccgagcggtatccacatctttggagccgcggatgatttttataacctcatccaagttagcaagggcaattttcaacccttccaaaatgtgtgcccgctcttcggctttatttaagtcataccgggttcgtcgcgttacaacatctttttgatgctccaagtagtaaaaaagaatttcctttaaatttaaaatcctgggttgattgtccaccagcgctaacatgataataccaaaggtatcctggagctgagtatgtttaaagagctgatttaaaacaacctgggggttagcatcccgctttaattcaataacaatgcgcataccctttctgtccgattcatcccgtaaatccgcaattccatcgattttcttatcccggaccagctcggcaatcttttcaataagcttggctttattaacctggtagggaagctcggtaacaatgatcgctgtttttcctccgcttaatttttcaaaagtggttaccgcccgaactttaatcgttcccctaccggtagtataagcctgcctaattccctgccggcccataatcttaccgcccgtcggaaaatcgggacctttgatgattttcataagctccccgatttccacttccgggtcatcaatcattttcacaaccccgtcgattacttctcttaaattatggggcggaatgttggtggccatacccaccgcaattccggaagaaccattgaccaaaagattgggaatcctggacggcagtactaccggctccttggtcgaattatcgtagttcggcataaagtcaacggtttccttgtcaatatcccgcagcatctccaccgttatttttgccatgcgggcctcggtgtaacgcattgccgcagcactatcaccgtctaccgaaccaaagttaccgtgtccatcaattaagggatagcgggtggaaaaatcctgggccattcgtaccatggcatcgtaaaccgcgacgtcaccgtgagggtggaatttccccaaaacctcccccacgatgtgcgccgatttacggtggggtttgtcgggagtcatccccaaaatatgcatggcatataaaatacgccggtgaacgggctttaacccatcgcggacatcgggtaaagcccgaccgacaattacactcatggcataatccaaataacttgacttcatttcctcttccaatttaaccggcaagaccttcccaatactaaacaaaataaatcacctcaaagttaagaattaaatatccagattccggacaagtttggcgttcttttcaataaattcccgccgcggttcaactttatcgcccattaaaatggtgaaaatctcatcagcttttgctgcatcttccagggtaacttttaaaatagtccttgtctcgggattcatcgtagtttcccagagctgttccgggtccatttctccaagacctttgtatctttgaatggtaacgccttcccggcctatctcgtttaaatatctttccagttcatcgtcactgtacaggtacttttctaacttccctttttttaccttataaagtggaggttgggcaatataaacgtaaccgttttctattaacggtcttaagtaccggtaaaaaaaggttaaaagaagggttctaatatgcgccccgtcgacatcggcatcggtcatgataattaaccggtggtaacgggctttttcaatatcaaaatctttatcaaccccagtacctaatgcggtaatcatcgcccttatttcttcattggccaaaattttatcaagcctcgatttttccacatttaaaatcttacctctaagcggcaggattgcctgaaatcttcggtcccttccctgcttggccgaacctcccgctgaatccccctctaccaaataaagctcgcagagggaaggatccttttccgagcaatcggcgagtttcccgggaagggtgttggattccagggcagttttcctgcgggcaagctcccgggcttttcttgccgcttcccgggcccgagctgcccggattgcattttcaattaacttctttcctactgcaggattttcttccaggtaagtggaaaggtaatcggaaacaatactatcgacaatgctgcgaacttccgtatttaccagctttgtttttgtctgaccttcaaattgcggatccggtacttttacgctgataatcgccgttaatccttccctgatgtcttccccctggagggagaggttgttttctttaattaagttgtattttttcgcataatcgtttatcacccgggtaagggctgttttaaagccaatttcgtgggttccaccttcggtagtgttgatgttgttggtaaaggacaggatattttccgaaaaagagttgcagtattgcagggccacttccacaactacttcgtctttttctttttcaaaataaataattttgtgaagaggctctttatttttatttaaatattttaagtaatcctttataccgcccgaatgctcaaaaatttcttctttattaatcctctcatcttttaaaattattttgacgtttttatttaaataagatagttccaaaagccttttcgctaacgtatcgtagttaaattccaccgtttcaaagatttcggcatcgggtttaaaagtaataattgttccggtagacttacttttgccaataattttcaattccgtaatcggctcgcctctggaaaatttttggtaatagaggttaccatctctctttatcctaacttcaagccactcggaaagggcgtttactaccgataccccaacgccgtgcaatcctccggatactttgtatcctccaccaccaaattttccgccagcgtgaagcatggttaagacaacttctaccgccggtttccccacttccggatggatatcaacggggatgcctctaccgttatcagctacggtaatactcccgtctttatgaataataacttctatacgattacaaaacccggccaaagcttcatcgattgagttatccactacttcataaaccaagtggtgtaagcccttttcgttggtgctaccgatatacatcgccggtctttttcttacaccttctaaaccttttaaaacctgaatttcctcggcgccatatttaattccgtttttttctaattccatataaaacctccatttttaaatatcctcatcttatttattataacataaaaattaaaactgcagcaaagctgcagtctggacgaaataatgttaacggcaatcttcttcttcgtaaaacaattccaggttttcccaccgtttttttaaggtaagggaggaaatttgcgtaagaaaaattttattgttggttaaaaccaacgacttaaatggttcttcaccaattttttctaccggaagtttaaacgaaaaatggcttaaaagtctaccataatccttggcagaaaaggtttcaatatcgaaaattccaataacctctttccccggtaccacaacatcgcttcccaagtgtaaaaacatcttattcctcctaagatacttttccattttcgatgaaaactacctgatggtaattttttaaatcaatgggttcggtagcagttataaatacctgatcactgtactttaagaaaaaaccttcaagggcctctcttttttctttatcaaattcactataaaggtcatctaaaagtactaccggtttttctcccgaaacctttgccatatataccgcctgagaaagtttaaataacaaaagtgcgccttttttttggccttgagagccaaatatttttaaatctcttccgtttacgtaaaaatttaaatcatcccgatgaggtccaaacaaagcctgctttttgtctttttcttcggtatatttttgctttaaaagctcaaaaattttttctttatcatctgccccggaggttttataagaagcctcgattttcccgggtaaaaaccttaattgagcatttagttcatttattatatcatttaaaatctttaaacacttttccctttccttgataatttctgcaccaaactccgctaacttataattccaagcctcaattaaattatccacattccatacctgttttaaaagagcatttttattggttaaaactttttggtaataaattaaatttaaaagatatgttttactagtttgcgctaaaaataaatctaaagcttttcttcgatttgccggaaatccaaaaaaaatcaccggctcatccggggtaaataacactcccttaagatttcccaaaatactgctaaagcttttttgtttttggccgttttttaaaaaaaacttaccttttaccgagtattccacccctaaagttgttttttggccgtttttactgatttttgctcctatttgaaagctttccgctccaaaacggatcaaagaattatcttttccgcgaaaagacttaccgattaccaaataataaatcgcttcaatcaagtttgtcttaccctgaccgttggccccataaattaatatcttccccggagaaaaatctattaaaagttcctcgtaattgcgaaaatttaaaagctggagtcggtcgacaaacacgttaccgctcctctgcttccacaatcaatacagggcctccggctatttccacccggtcaccgggatatatttttttctttcgccgggtttcaaccacgccatttaccaaaaccatgccactttttatcatttgtttggcttggccaccggtcatggcgatatttgcccattttaataaagagtctaactcaatatattccgtgtggatgtaaactttttccataacaccacctatgaaggtctaaccgggagtaccaaacagagatagttctcatcgttaaccggttttaccactcctggatttagtggcccggttagacttaaataaatttcctccgtttctaaaacttttaaaacatcaattaagtaccgcgtattaaaagctacggtaaactcttccccctctaacgatatcggtaattcttcccggatagaaccggactcggactggcttgtaataatcatgttttccctttccaaataaaatttggcaacgggagttttgtctttatcccgcggaagtaacgctgccctttccagcgagtccaaaaaatattttttatttatgagaatgttagatttaaaagcggtgggtattacctgttgataattgggaaactgtccttcaattaagcgggatgtaagtttaataccgtttccagaaaattctacctgcccttcgcttatttttattaacagttcgtcaacggtaccaaagattcttactgcctcgtgtaaggttctgctgggaatgatcacattaatatttttgccggtgtcttctcttttaataaacgtttttctaaaggcaagccggtgagtatcactggctactaacctaagttcctgaccgactatttcaaataaaactccggtaaataccggtcttgattcatcggttcccgtggcaaacagaacttgtttaataaaggtggaaaattcttccccgcttatataaaagctttcaccatcaataacttcttcatttttaggaaactcctccggccggtaagtggcaaccgatacttccgatgcaccgtattttattacgcattttccttcatttggcaggtattcaaacattaactccgtttccggaagttttttaattatatctccaaggaactttgaagcaaggaccacgctgcctccctcaattatctttgccggaaaggaagtctcaacggacatttgtaaatcggtggccgtcagggtaatggtgctattttgttcgttagcttcaaaaagaataccggttaaaacaggaaatgggcttttagtggaaactgctttttgcgctaaagagatattttcggaaagaatggaagttgggcaggtaaacttcattccttatcctccttttaaaactgattgtaaagtcgtagtaataatcaggtttgtggatattgtggaaaacttaaaaaaacatctttaaaaattaaactatccacttgtgaataagctgtttaaaaacaaaaattttatacacaaaattaaaaaagagaagacgttttgacctaaagtttaaattttatgttaaaaattattcatcaggctttgtggatttgttcggtaagctgccttattacggtttttaagtttggatctgattggaggtcttgttgaattttttcgtgcgcatgaatgacggtggtgtggtcccggccgccaaattcctcaccgatctttggcagggaggcatccgtaagctcccggcataagtacatagcaacctgacggggaaatgccaccgacttggttcgttttttggcttttaagtcgtctacggtcaagccataaaagttggctaccacctgttgaattaagggaatagttatgggtttaacgtgatttgatggaagtaagtcttttaatgcttttgctgccaaatcgacggtaattggctcgccgtgcaggccggcataggccacaacccgaattaaggctccttctaattcccgaatattagaaacaatctcattagcgatgaaatttaaaaccgcatcatctacatgaagattatccagctgggctttttttcgaagaatagcaattctcgtttccaaatccggaggttgaatatcggtaataagaccccactcaaaccttgatcttaaacgatcctctaatgttgaaagttctttgggagtacggtcactggatatgacgatttgtttattagcttcgtataaagcgttgaaggtatggaaaaactcttcctgagttcgttcttttttctctaaaaactgtatatcatctattagtaaaacgtctatgctccgatatttgtttctgaattcttcggttgtgtcatccttgattgagtttatcaaatcattggtgaacttttcggtggtgacgtacgctactttcatttccggcttatttttcaaaatgtaatggccgatagcatgcatgaggtgggttttacccaggccaacgccaccgtagataaaaagtggattatacgcttcagcgggagactcggctactgcaagacaggcggcgtgggcaaaacggttggagttacccaccacaaacgtttcaaaggtatacttgggatttaaggtaaaaaagattccttcctccagaaatttgcttggttttttgggtgaatttttcttgctttttgtttttccttcgctatcctctattgccgattcattggggacgaccagtttaaagttaatgtcttcattggtaattaagtttaaaatatgtttaattaaactggcgtagtgctcttctaaccaatctttggcaaatttattgggaacctctactaaaatggtgttttctaagaatccaaggggcctgatacttttaatccacatgtcccagcttggtttgttgacgtgatttttaagtacttccattacctgttcccaaagctcttcaaccggatttttcaacatcattaccctcccgaaataaaaacgtctataaggcattaaaaaccaggaaggaaaaaatcctacctggttgatgtaaacattatcctaacagtttttccacaacttattcacaatttgtgcatatcttattacaaaaagttatccacaagatgattaattcattaaaataatagcataactaacgataaacctgcaataattatttaaaaagttattcac
